United States Patent 9,567,581 (SELECTIVE REACTIVATION OF GENES ON THE INACTIVE X CHROMOSOME) - sequence listing, part 20

SEQ ID NO: 2994 - DNA, 438177 bp, human
  misc_feature (63100)..(113099): n is a, c, g, or t
acttgccccagcccagcctgcttgaaggacctacaggtttgtctcttccagatcagaactgaggaacaaaaacccccatcctgggaaaaatggggaagctggtgagtcttaccactctctctctgcttgcttctgctaagtggcacgcctgtctgctctcacccaggaagcaaagtaagaggcgttgctcagcctctaaccccacagctccttcctgaacaaatacaatgctttgcgaatacctccagacaactttttctgcctgttttgcacaccgaaaatccacagaggcaatgatttttagcactttagacattccagagagtgtttttcctaggcaagcgtttctatactgtcgtgatgagcaaactttctcatctttgttacactctaaaacagtggaaattagccttggggtgctttgtgaggaaggctgagtccccaaggaagtgatagtaaatctaaatggggtttttaaaaccacaggcagtgtgatattctgcaaaagcgtaatttgtcactaaaaaggcagtctgaaggtatcatttttcattcacgcagcagcaaaatccttgcatcctgcatatgtaataaaggacaccttctgagacactgaggaaaaatagaagccgagctggcctctttgttctagacaatgtaaagaaactcgctcttgcgttttgacaaggagcgtatgtctatttatatatatggcgagaacggtgaataaaggctttatgtcaaaggtattgtggtcaattgagttaaaatctggctatattctatatgtgtacaaaaatctcaatctgaatgtaattaaacatggaaatgtgaaagtgtttaacagacttgcagggaaattttaattatacttgggaacagccaattgtaagagacaactgggaaaggaaaaaaaatgtttcagctgagttctggggcataggtaaaacttttgcaaagaaagtcaattttttatagctgtcaaaagtgatttggaatcaggtaaaaaaatttatttttattttttcatggtgatgtggttttttgagttgaattaacttggataattgtgttgaatgatttgactgctcgtctttcaaaggaatactgttgttttctgtcatatacagactttatcctgagttttgggagcaggtttgtgctactgactgcaacaagtggcacaaagactcaatttcagatttctgatattatgaaattaattgcttaagttaatttaaagaaaagtaatcagtgcaaacaaggagatttgagaaaatgaccacgtttttaaaaaatgcaagtcatagtccattccctagtgagactattgatttcaaacaggcattggcaactgcctagtcataaggacaaaagctatggccaattttctctaggatctttgactctagaaagcataactttcgcaaggacacagtttaaatgaaacttgttcacctctgtgagaatgaaacatagaaaagcaccgtgtataatacaatagacactttagtaaataaaattcttaatagcacaagccgcagaacagaagggacaatgcaaatgttttaaagtttatcttttcagtgctgctcagaaaaatatgagtcttgacattctgttgctgtcgatgggagtcagcaacccaggagacacaaaacactgttttagaatatacagttaataacagatggtttaataccaggttttctcaccctgctgatgagatggccccaagccaaatcagccagcacgtctgccgtttttcctgtgagttgatatgtacatagttattatacactaattacactaacagccaagggaatatataaccagaaagacagataagtctcctggggtaaggagggcaagggggcggtgtatgcatagggtttttggatctcatgtttagaattatccttgccagtggcatatgaattactgcagattactgggagtctcacggctagaatctactcatccccggctcctcagcagcctgtttgggggtaataatattgtttatggtatttaacactttagtattaacaaagttccaggaggattccttcttaaagattaaagtttttccagtgtctgaactaatcctccaattaaagacagttaggacctatattgttgcattgacccttttcaagtcacagtactgcgtgcttgcatggagggtttaaccaatcggcagcctccgtagatctgcaagatgttagtaggtgccctggttaaaagaggttggaaaatactggacaaaaacaaacaaacaatgggaaataggtcttctcagagccttaatatgttcatttattaatacgtgttttgactccctgagagaagtatagtgtgcaccatatgaagtatggtttgctgcaaacttacttgatggctcatttctaggctgatcattttgagaaacattctttaaaacaaagcttctcaatggatggacctcagagcactggtaaatgatgagtgggttgcagacatacccagctgttaacccctcttggcacatgggccatcaggctgtggctggcctgagctgatccctggaaggttatttctggatcacatagcttcatcagtttacctccatatatggtgcagattgcatcaatttctctgtcatgatgtgctaaagttaggaaactgcctttgacaatctaggcccagaatattgatcaaaccagtcaaaataccccaacactgtattaacttgggcctgggggctcatgcaatcatgagagtgttaaggccctctacatgttatccagtttgtcctctttattttataaagaatttaatgatgtgttctataatgtgtgtatgtgtgtgtgctattctattcttagaagtttcctgaacaactgatggcaaagtgcttcatggaatcctttctaacatttggttattgcttatacttccctttctcaaactgctatcagggtttgtttggctgggattctcccaccactaatatggcttagtccaggggcgatggacataaaagaacctggctttaaaggttatttgttaaattcaaatccttttcttgggcactgtaccaaatttgtacacagcatttctatcactggtgaactttctctggcttcctctgcctaccatttgacatcgattatctttcaaaaacattttttgcattattaattcctgttacattcattcagcaaatatttattgagtgccttttgaagtcctatgctaagtactctggaggaaaaatgggtatataagagacagatgaatttaaaccaagtcttcatgcaatggatagcatttctgcaaagagaaatctcattacctgaatggtgcaagatgtgaaacatgatttgctgcaaacttacttgatcactcactcttttgctaatcgttctctaaatcagagcttcccaactggtggccacaaaacactggtgggcaatgaacaagtaactgatacgtcaagatattcatgctttcactgaccagatgatctccatgtcagataatgccaggtagatgccaataaacttggtgtgcttatagaggaaggaccacttgattctccctgcagagcatctataaataactgagagttggatgatgccagtttatattttgttaatgtaattttcaaaaccactctctttggggttgtcaagtattcctggggtgccacatggagaagagctatttccatagtactaggtaacttgagagcttttataatggcttgtaatcactggaaattattagcgtacaagtttcggtaacaattcttataaagtaggcaagagcagctgccattacttctaaggtcatacctgtaaggcttagaattggggactatgaattaataatgagtttgcaccagtaggattttccaagtacctagggcattagtaaaaccaatttaaaatatatttatatttgaggaaaggttagctggtgaggtgatagtcaggactatgacttctagttaaatgtaaaagtacatttccgtttttaaattaattgcttgcaatcacatataagggaatcttctgtgaatgaacctttcaaagacattgagttactataaatattaatgtcaatggttcatttaatgttatttttattttaaaagaaaataaaaatggattgctgtgctttggggaatatagcattttcagaaatgcatggtacataatagctgaagctgcataaagaatggttctaactgtgtgtgagttgagtatactcacactctcttgtgagttgctcttcacttgtctaaacttgagacaaaaatgaaattaagcagagcctcctcaaattgacagtttgagttttaacacgtgacagaattggaattttggtcaaagagcctgagccagaaaaggctgaattatttatagctattgttctgcaacagaggccttgattattttaaccaaaattatttctccccctgagtatctaattgtgcagttatttatatctgtactgacacactcatcatgtattgccttgggggaacaaaacagcatataaactaccagagaacagataacaagtttactcgaactgatatccttggctcaatgttaagaaacaaaagaatggtagtgtttcccaagtttcttccagagcaatgaatggtgggtttggccaagacattttaaacttctcagggattcaatttcctcatctatcgatggagacataaatacacacttcattggacggttatgagtattgaaaatggtcatgtctgtgaacgtacctggcacaatgctgggcatgaggccaatcagtaaatattggctggatctgaaatgggtggggataagttaggcacatcgtcaagtaaacaattcaggggttgaagaagtagaagcagatgcacactggtggcccttatgtaattttgcccactcaatgatttaaaatttgtgtttcagtgaagcatgatataccttctaatgtcttacaccatgtcctctgtttattggtgttacctgtttgtcccttgtaggtttttgtgtttgacacccttgctctaaagacttctttcttctctagcaatctacgtcttctcaatgtagatttcccccttttaaggtgttttctcaaaagtaccgtattttataaagcaaaaaaatactcacttcatacttattaatttaacagcttgaaatctttttcaccagcaatggcgggaggagctgggctagcaaattcattggtaaaagccacttgcccccctagattaccctcagaccccagtctctttctctaattccccatccaccaacaccctaccccagcagaatgtaacatttaatctgatgtggcgtccaagatgtggagagaatgtatcccatgcgctaacatatcttggcaagagttcactctttgctaaggcaagtgggggccatatggtgtttgtgtaatgaggaagcagggcagctttatcaaagcgtagatcaaatggctccctacttctgacttatttttattgaatctcatatatgatcgattataagattcaacgctaagaaagaaaaaattcttccaattaatctataacacaatgttttcttagcatttaaatattttatgctaaatttattgaaataactctctaacagagagttattctcttttagatagaaataactctctaacagagagttattggctgactattatttagactgattatttaaaaatcatatgtctccccctgtgcataaataaaatggaagatataggtgagataaacttttaagaagccttaacttttcaactgagtcgttgtatctgtgcttttctgcaccgtgccgacatactttgggccaaaatgcagcatttttaaataaagagcttctttctctgcatttctactagaaggtgatgatcaagactatattctttccacaaatgggcctacaagagaatgcagttgtccattcataacccaaggaatgcccatcaagtcactacacatctcagtgagctaattatttaacactttaaacatatgcctacaaatgcattaagaaccagcgcgcttggtggggtccatagtctcctgggtatctgtccggacaactttctgccccagtaccacctgagccttgagaggatctctctctcaatctctctctctctctctctctctctggctggtgggcggggtgggggggacggggggagcaggaatctttcctccttcctttttctttgagtggttttaccaggtgtgcaacttctcttctcctaacaggcaaggcttgttttaaaataatgcctgtagctcaaatgaactgacaacagtaagaactactatgatcaagagagttcatgggcaggcattgacaattatatcacaactgcagcctgagcagcaacaaatgtaagatacctcccaatatcggctgggttaaactgggaaagaatttccccagagaactcatgaaatagggtgtatcttccccatctcatgagaatgactaaaacatcagcattagagaatgattttgttgtcttttaaggcatcaagagtctcctagttgaaatcaaatgactttagggagaacaacatttgtagttgccatatttactgctttgtcatggatttctttccaattaagactaagtaagagagcaaagtcccatgaagatgggacaaggaaagggataaggatgagagtagaggaatggagagagggcaggaaaaagagaaaaagaagaaagagaagctttacatttgttcaataatatttgtcaaatgctttctctgaaccaggcatcatcctgtgtgctaaggctaaagtggaacctgcattcaagtaaataacagtcaagtgtaggagacaaacattgatgaaatatcacacagacatgagtaaaggttcacctggaataaaagctataaaatggaggtatatgttgccatgtgattgtactaagaggatgtagctgatctgctacagagaaaggcagagaaaatttccctgagaaaggattgcttgagctgagagctggacagaaaggacttgaggcagtgtgttttcaggggtaggaaatggccagactctatgagggagttttcagcaagggatgacattggtcttttgaaaagttcacattggcagcaacctggaaaatattaggttgttgcaaaagtaatcgcggtttttgcagttaaaagtaattacaaaaaccatgattacttttgcatcaaaatagtagagcagattggagggccatcagagtcaacgtaggtgaaccaaacaggagccttggaaagcaaaaataatatctgcttgtactaatatcgtggtggtagagatgaagagaagtggatggatttcatttctattttagagaggtgaaatcgaaaggagtggatgatgcatggggcaagggagatcatgagggactaggtgtaaaaacagactctcaggaatttgattcacatatctagaaggatagtggtgtaggggacaatgaaagttggcctggtttggtggaagggagtaacctgattgagtggaaaaatgcatgagctttgaggtggaaagtcatggtgtgggttcaagtcttagctcatccatttagtagctgtgtgatgctaagtttctctgaatctcatcttccccatctttaaaaattaggtcataaacactcacctcaagaatttttggaacaatcaaatgaggtctacgtgaatgaaaatcacttcatacatggtcaaatgccctacatgtgagttaccattataacccacaaattcatcagcagtaaagcctggagggagaagagctattttcaataacttcctggggtgggatatgagggtcttgacagccaagatctctgtaagtttacctaagtgaagttttctccttgttgataatgtacaggacagctattaacttcagttgtctggcgaattctttctatttcattccaacccccttaccccctcccctcaacctggattaagggatcccaaataggaataagctacattgcttttctcagctgagatcccttatcatttctaagaggactataggatttagaaaattgtaacccgagagtttgcactaacagatgagcacactccattaacttcacgttcccagtagggtttgggtgaaggttttgccattccgtttttctagcatcaatttagcaagagcattttatatgacatgtgtaattccactacccttgagtgacctcagcgaattcctttctggcttccaaatattctcccattaaggggagtcattaggcagtgaaagctgcagccatagggttaggaaaaccttggaatgggcaggtgagggggaggaggaggttaaaccttgtggaatcaaggtattagcttccctttgtgcaggtgttgcattataggatctaagtcattaccaaaatttatatcttcttgccttgttccttgtctttccctttgttcttggcacacattatgtaagtctctttattttagaactgaactgtatgtctacggtttgggcgtatgtatgtattaataaaaccacatttatctttcactgaattcttaagaagcttaaatttcccatcaagatcctattcagttatctaaacacttatgttcctatagaaaaacgtgtgggagagagtgggaggcaacccattttgtcatttcacttgtgtaatgtttgggtggaagattgagaagcgtttgtatgaactttcagataactagattgcacttgcttctcagtgtgcatatttaagattttactgtatgcacccagattgggatttgggtgtatgggagggatgaggatggaagtggagtggaagctgttatctgaaaaaaaaaagtcctagccatgtaaagacctttctctttccactactttccctgccttcgtaatttttcctctacatgacccatgttagcacaaatggatttcaagacagaagtgcaattttttaaaagtccattttaaatcggaatagtatgtcccaaagggactgccattttcatttcataaggacccacttggctgtggctttgctgagttcaaagcaggagcacttcatagaaacttctgattagtatgtgcagtagtaattgctgcaagcctgggtgtttttggagtcacagtgcaatagaaggaagggagggctacagtgtcaagccagaaaatgagttcaccttgtccatgaatatagttactgccaataaatcatttgccaatagtttgaagataatgaaggaacctggcagaatgatccagagtgaaggtcccagcaaagagaaaacatatcaaacattacaatcaatgaaaaatggtgagaatttctgtttccagacccccaaataaagctcttgcagagataaagatgtgagctttgcacaccatcaagccttctggtctgtttttcctgttcagaaagactgaaattagggagaaggaaggcttctgccaacagactgtaagtcataaattagttaataaaatctgtcctgtgttatctctaaaacagcctattttatatatatttgtctatttggtttatttgtttctctgcttacccaggctgtattttggtagcataaatcaatatatgagttttagactatgcaaaagtttatttataaatgacctgccttctgtgaataaaataatatgttgtgtatatgtgtgtgtgttgtatataatttattgctattgatcaatgttaaatttaaatttaaatacataatactaatgagtccaatgaaatgtgcatattgctatattccaaaataaaagaattaatctgtattgtcgcttccaagaccatttcatggcttgtgtagttctagtagattatttccatgtattggtgttagtacaaccagttcttgttttatttactggggtcactatcaatgataaagcaacactgttcatatttatatacatttctatgtacattttatttatatatattatatatgtattatacacacgcacacatacacacacacatgcaactgtatgtgtccatttgaacgtttttctattttaaggagggtaagctttaattattttttactttttttgaagttagatgaaagatataagaaaataaaatgtcatacttctttttaatctttaacttttatttgaagttcaggggtacatgtgcaggatgtgcagatttgttacataggtaaacatgtgccgtgatggtttgctacacagatcaacccatcacctaggtattaagcccagcatgcattagctattcttcttgatgctctccatccccccacctccccaacaggccccagtgtgtgtcgttcccccataatgtgtccatgtgttctcatcattcagttagcatgtataagcgagaacatgcagtgtttggttttctgttcctgaattagtttgctgaggataatggcttccagctccatccatgtccctgcaaaggacatgatctcattcctttttatggctgcatagtattccatggtgtatatgcaccacattttctttatccagtctatcattgatgggcatttgggttgattccatgtctttgctattgtgaatagtgctgcaatgaacataagtgtgcatgtatctttataacagaattatttatattcctttggttatatacccagtaatggaattgctgactcaaatggtatttctgcctctagatctttgaggaattgccacactgtcttccacgatggttgaactaatttacactcctaccaacagtgtaaaagtcttcctttttctctacaacctcgccagcatctgttgttctttgactgtttaatagttgccattctgactggcatgagatgatatctcattatggttttaatatgcatttctctcttgatcagtgatgttgagctttttttcatatgtttgttggctgcatgtatgtcttcttttgagaagtgtccattcatgtcctttgcttactttgtttttttcttgtaaatttgtttaagttccttgtagactctagatattagacctttgtaggatggacagagtgaaaaaattttatcttattctgtaggctgtctattcactctgatgatagtttctttttctgtgcagaagctctttaattagatgtcatttgtcaatttttgcttttgttgcaattgcttttgtcatcttcatcatgaaatctttgcctgtgcctatttcctgaatggtattgcctagattttcttctagagtttttatagttttgggatttacatttaagtctttaatccatcttgagttgatttttgtataaggtataaggaaggggtccagtttcagttctctgcatatggctagccagttctcccagcaccatttattaaatagaaaatcctttccgcattgtttgtttttgtcaggtttgtcaaagatcagatgattgcaggtgtgtggccttacttctgagttctctattctgttccattgctctatgtgtctgtttttgtacaagtaccatgctgttttggttactgcgaaaatgccataattttttaagatcaagtataataatttacaagataagtggaagaccagagaggtcaggggagaaaagaaaagaaaaaaaaatgagaaaaaaaagatcagcaagagatgttagaggaagggaggtcccaaagcaacaaaaacctactgctttctccagccaagcccatctcccatatataaacaaaagcccagcaaacaaacaggtgcaggactaagggatcaagaagaggcaagccacaaattgctagaaaatattggagactgaaagagaaagagagagaaaggaagaaaacaaaagaaagggtgagaaatatgtttatggggaaatgcttgcaagttaaagaaatcagcaaaaaggataaataaagaagaaagtaagaaatgaaaagtaaacattaacaaatcaaaaaataagaaatgagacaaacacgggcattgtgtttgagctggtggatgctaaaaatatattgttctttaggtatctttacgaaaggaggagcaaacagcacaaaagtgaaagtgggcaattagaagaaagcaagaataagacaaagggagtgttgttagtccacatgccaaaacagccagccaacgggtgagtgacttagtactagtgtcctagtagggtttttcccagtgaaactaacccctgaagatgacaaggctgttttaatctttgtaattagtcctattccacaatagtagtgcaagtgcaattttctttttaaatgtccccacttgaaaaggcttgagtggcaagaatctgggccttctaagctgtgaggtgttccagaaaaggttggctctccctaccttaaaaaagattattcttaggcagtgaatgatagcttggtggcctaaagagttaatccccacaaatgtcttctatacttccaggagtcatttattgaatgagcagtatctggcttaatatttataaaaatgctttaaatttctccagaagaaaggtaaaaggccatagtatctggatccattcctactgtcaagctttacagagtacccaacgcttgagttggtaactgccaggcttacagcttgcatgtgaaatttcaaatccagtctcttgtgagtttggtcttgctcatttatttttactgtgattttgctcataataacttatgtttacaattcagcaacccaaggaattgtttttatgacaaattttcatgttatagtcaatcacacatttcaggcctgtttcagaaaatgagtttgacacggtgtgttagtgatgaattattaattcttacctgcagcaaagaatgatgctcagagtggtcggggaatgcttacaagttgttgactcaaagttatacagctgtatttaaaactccagtgggcaattctgaagatggcaaactttactttgatacaatgccacagcacctccattagtgccctggttagaatgcaaacatctgcttgcttttatgtccatgtgttacttaagatggtctgtttctttatgacgtaaatcactggaatctactgactatttttaaagtctcttttagtgtttccctgaaatgatcactctatatgattgtttaatagataattggccctgtaggtacacaaacattataaagatcatattttctgctttcctgatcttttccatagatgacattataacaaaagttcctcggcctgctgcaaaatgtgttgtctttcgggactgtgtgaatcatagattcacattaacacattaggtcaaaagaaacttcacatttccagtgactgaatataagactgctgttgtttgctcactggctgtagctttatggatttgcccagttcggtttgccctgccagggtctgctctttccttcactgcttatttatctctccctggcaagctgctgaacaatccatttgccctccaggctgtgcatgtgtccagcacagataagctttaggacagcaaagactatcactttaatgtcaatggactgcattttaggactccttgatgggtgatattatctaactgttagggtaagtgagggcttgaggccaatggggctgctcaagaacatgagagccatgaaacaaaagcttggcctatggaaaaaagaaaacccatcaattatgatcccagatttgagaagggattggcatatggtataatgaatagaacaatgtctctccttagcccactgattagaaaggcttggggagacatgcctatacgtactgagtcctatagcttgcggaatgttacaaaataagccatctggaagattactctcatagtcaataaaatatggctcttactcaggtcctaggattgcatattggcaggaagtttccagggaattcccaagagaagaatattggaagatgatagtttgaagattgtgagggttcctgaaatttgccagaaaattaagacaagaactaattgggagactccaagagaccagaaagaacaaatatggaggtgtcaggaagtaatggttttattccacatagcatctatttgtttcttgctctctctgggtcctgactattgaatttatgaaaattgaaggaaggaaagagtgtgtaccaaagggaaacaattagggggaggtgaggataaaggacatccactgtctcatgactggggagataaaaatatgcaatagagaaatgtgatgtcttcggttgcaataaatttaacaattgcaatgcaacaattaagaatatagtctttctcaagttacaaatagatgggtatgcataagggagataagttacaatacaaattaatttcatttaattagttgaagagactagatgagaggtcttcaaactttcaatacttctaagtattatttctctctctctctctctctctctctcactgtctctgtctttctcacgcatgtgcacagagagaaagagagacacacacagaaagagggagggagggagagagagagaatgtgtacacatgtacacacaatacaaattatcccctcataaataaaccaaaataaaatcaatgtatatatgtgttgcttcccatcccagctaaggaaaggtgtagaaaataactctggttttcacacccctcaatttgccatggccaccatcactagctattgaatgccctgtgatgacctgcagaatggcacagaggttaggaggataaacttttgagctacacagacctaacttagaatctctactgtgtcacttgttagctggacttcctactcctaacacttaacttcctaaccttggtttctttcaccacctgcctctcagagtcatttgataagactaaattagaagaagtatgtgtagtattctgaacagaggaagcactcaataaatgctggctaatatcatcccctcccagctctttgagggttatggcttagtatttgataaacctgtgaaccatggaactgtcactctgaaggacaaatctggcaaaacacaccacctctaggggagagggtgcccaccaaaaggcttttgaatttgttgcttagtactgcttccactccaaatcactcaaagttgtttagacttccttcagaggcctgtggacttaggcaggacttaagatgtctttgttaatacagctaatgaaaaacactgatagcatgtagaaacaatgacctgccagagttgaaggtagacatttactttctatcaccttgtccatttaattcataattgacagctttatgccttcaaagaatcattctgagactggatgagtctgaagctttgcatgtgaaatactgctcaaatgaatttgaattaacagtactaaaatagttagtgatttcaggcaaccattgtaacgtgttgactcaaaactaacttttaagagttttgtctggagacaaattctgtgaaaaatgcttaaacaaattaaacacaaagttaaaatttatttggaagataatgttatactcagtccagttttgtatgtactcttggatcagaaacatgttagtcatttaagaaatatatatgtcctgaagatgttatttcgatagagcaaaaaccctaatcaacaacaaaatcttattcttataaatatacaaaaatggcagcaatatagaatgaaagaaattaatatttgtagccattttctcttcttgtcattctcaaggaaatgtcattttgatggaaaagaaaatcatgttggccaggtgcggtgactcatgcctgttaccccagcactttgggaggccaaggcaggcggatcacctgaggtcaggagttcgagaccagcctggccaacatggcaaaaccccgtctctactaaaagtacaaaaattgccaggcgtggtggcgcacgcctgtattcccagctactcaggcggctgaagcacgagaatcacgttaacccaggaggcagaggtagcagtgagccaagatcacaccactgcactccaacctggatgacaaagcaagactctgtcaaaaaaaaaaaaaaaagaagaaagaaagaaaaaagaaaagaaagagagagagaaagaaagaaagagagaaagaaagaaagaaagaaagaaagaaagaaagaaagaaagaaagaaagaaagaaagagaaaaaaagaaaagaaagaaaatcatgttgaagtcatccattgaagtcatcctagggttgactgtaggagttttccaaactcctacttcattgctgaagtctacctatcataaacatatctaattttgctttatgttcctcttagattccaaagcacagacaaatgatttgtttgttttgctgaaaggtggattataaaacttgaatccctctgtaatgttttataactaagaccactgaggaaaacacttagcatttcccatccttcatatgggatatgtaaaaattaaagagcacagatcatccttgctaagttatcttagattcttgagcacagatactgtgtttttccttcacacatatctgatccttcaaaggtgcttatttgtcatttccacctttctgtggaagtgccagatactctcattcatagagaataactaacaaggcagatacacctaaaagttcaacatcaaagggcttgaaatatcctacctgaatgtcggaatttggatcatctaatgagcctgtgtaatttggtttcttaactagaaaatttcagtaaaaatgctggggcccactggctcacctggctgagtatcattgcctctttttgccttcattgttccatgacaaacccttttgaaaggaggtacatctgtcacaggtacctttgttcacccacgaacctccccaaacatgctctcaagttccattttataggtaatgatgtttcttaaacaatattcaaaatggcaatactaaattactttttcccacatgtacatggaaataatgtccatggtaaaattatttggactctatgcagtaacactaaaggtgcaatttagttggttgttgttgtgcatccaacaacttttgtgaacctattgtattcagagaagtcagctgcatacttagggatagtgagaaaatcttcgggaacccagcacaaacaaaaccctcatcttctccaacctgtaagtgcactgtttagtggagggcaaagcaactgtaatataaaacacaatccattcatttgttaaacaaccatttattagacacctatttattaggctatggagacacacgtttcctgcctccgaggaaattacagtttgataaagaattttaaataggtgctaagtagaagcacaaactgagcattttcattagaaacaaacagtgaatgcgtgaagaaagttacaatctgctgaatgtcagaaataacaactctggtttatgtttatatcaatattggcctcataaagactgtgtaattgacagaaaggggctggaactattttgttggttgagcttttattattattattattaatttatttaaaaactatgacttacttttctgttatatacttgaaattaattctaaagtggcttagtgagcttcagaatctccgagtgagagctaggaaagaagcagattggtgggcctcagtcacagaaattcattcaaccattctgagaatgaagcctgagagtctgcacatctaacaagttagcaggtgatgctgatgctgttggtccacagacctccctctgcagcactggttaaaggtagggacggattgttgtaatggctcctagattctgaggagggagtgaaagatggtaggattcctgcacttcttggtcatggccagtagactgaagaaaccaattgctaagtctaatgtagaaatgaaacaaactcttctttggaccatttagaaaacgtgtcaggaaaggctttagatttgaggaattgtaatttatcaatactagttcaaccctctctgatcagtatagtcaacttgttaaccacacagctgcataacccccaggggactgatgaaaagtgtcacagagctttagggtttccagttcccatagtcacactggagaaatattaaacattgtttgcatgtttgcactttgctattccttgtcacttgcccatgctgtgaggcagtctcaagttttgagtgaagaagccacgtaagactccattgaggaaggctgtagctaggacatgtgagctcatgacatccctaagagccaagtaaaccattttctttcttccataatgagaaacaccatgtcgttggctgcttctgtctgtaatttcactggtgcagcatgtttagatgtgagcactaatggaagacaaggaagaagtgatttcttgttctggctcagcttgcactgaccattctgtgacttatgactgaccctttggggtcagttaagttctctagtgtagagttgctatgtctataaaatgagaatgcaagatggcagggaatttttaaagagctgttaccacggtgtcatttgttatagggtgtgtttttgtggtaatgttaaaaaggcatattttaaaatatgtgcaaagggaatatttaaaaagtaataaatatgaaatgaaattaccatatagaccagaaattgcacttttgggcatttatcccagggacatgaaatgttcacaaaaaacctgcacacaaacattcagagatgctttattcatgttagcctgaaactagaaacaatccaaatgtccttcagcaaatgaaggattaaaccaacaatggtaatctttaccatggaatgctatgcaggaataaaaaggaattaactactgatacatgcaacaacctggatgaatctccaggggaatattctgaatgaaaagtcagtgtcaaaaaattacatactatatgattccatttgtgtagcattcttgaaatgaccaaattttagaaataaagaacagattagtagttgccaggagctaaggataggggggcaggagggaggtggacatagttatgaaaggacaacacagggatctttgcagtgatataactaaatatgtgcatgcatgcgcacacacacacttatgcacacacgcacacacacacacacacacacacaccagtacaagcaaaactgaagaaatctggacaaaattggtagattattttgcaaaatgttaccatagggggaacctgggtgaagggtgcaaggggtctctatatattatttctcacaagtgtgtatgaatctacaattatttcaattgaaatttcaattaaaagaaagtttttttaaaaaaagtaataaggaattttgtttactgtgagtcattctggtggccaaaaattgttgttaataggatttaaaatgtcaagctatattcagtagtttttcactaattaattatcaacagatcttcttgtctacttttgtaaaccttctgagagtaaaccatctaacatatggggaaaaataaaataaaatatgatcctctggagcagggattggcaaactatggcctgcgggctaaatccacactgcccacctcttttgtatggcctgtgagctaagaatggtttttacatgtttaaatttgaaaaaaattttagaaggaaataacattttgtgacaagtgaaaattatacaaaattcaagcttgagtgaccttaaaggtttattggaacacagccacactcattcatttatgaattattgtctgcagcagcttttgagctacaacagcagagttgagtagttgcgacagagatttttctgactcatgaagcggaaaacattgactacctgacactttagagaaaaagtttgccaacctctgcatgagagggataatttcccagaattttctaggttaagagggtcccccattgccacttgggtttcctaaagtagttctgatgagcaattatcttggtttccaggcattccctgagaaaaatgaggaaaatgatgctagtaggtccagcataaactccacaggaaaatgccctgagtacaactgcctgaatcaatagcatgtgtcttgggttgttctgcttgtatactctgcacttctagcagaggcatccatcacactttacaaactcagcctttggagcacaggaaaggatgtggtctaagagtaaggcagacttgggttcaggttcaaattatcacttgggtatttgccagctatgtgacctgggccaagttacccatctttctggactttgttacccatctttctggactttgtttactcttctttagaaaaatagagataattacacccatttgcagtggcattgagaggatgtaatgaactcctatgtcaagtgcctggcatgtagtaggcaggacccagcaaatgcaagttccaggatgggaggccaatcattacactgtttttgtgtctgggctctccatgcttcacatccctcaatctaactcgggaatctacaaagaggcattggaattctttcataaacatcactcaggctccatttttgcactttctccataagtgtctatggagcattttttttttcaaaactagaccatcttcctgctgcctagacctctcctccaagagacctgagtgaaggctctgacacaatggaatataaatcaaattattttccaattataggatgaactatgtcttcagtgctgggaaaaacctgcagattgatgttatcccagtagactcagcactagtctccgagaataggccaattcaggtttgaaaatgtttctgggttttcaggttctaagacaacctttgcactgaaatcatacagtctgaagggaaaacacacagggagagtggcttgccagttcatcatagatgaacgttcaatccaaagtgccctaacttgtgattaactctccacattggttcagtggagacttgggcatgcttctcgcccaatttctctcaggccaagtcagactggcagccggaaggacagtatttcatgctgtacactctctggaacggacataaagtccagtctcagatgtcttcctcaatctgggccaggcagagcaagaatggaatgactcgcatgctggtgaagacatgtgtccctgaacatgactttgatccctcatagagatgcttagatttttaggatgctgatgttcatctagtttctgatctaggaagatattggcatcactgaaagagagagagggaccaagggagagagaaagagagagaggaaaagtgatgaatacttttttcatcaggttgagtgggtaattttagagtctgtcaatctttttgcttaacaaccttcgcttaaattagtttctttgtcatttctctttcctttccacctgtcttaaatatgtggcagcctatcaaccagaagaacataagcacatacatgtaatgagccaatacatattttttctgtgtgaccacccaagttttgtcgcctagagataaatgagacttatgcattcccaccatagcctgcctcccaccgcatcaccctgtcaaaactgcccccaaataatgtggctgatgacttcctcatggccaaatctattcagcactttagcttttactgtacttgacctctcactgatattttgtattgctttgttccgatatttcttatggcattgattcccagattttcaaatttcagggactaatgttattttttaatggcagaagttaatatgggttgccaactttaaattaaccattaatgacataacaaaaaaaccttcttacctccaaaatatcaaaagaatggacattttgccatcaaaaaatataagaaagatgtaatcttgggaaaaaggacggccttttatagtaaattaatttagctttatgaaaaaatgtattaaattgcctacattttcttcatttcactacaccttgttggaaatttcatcacagatcagtcctagtctgatcttacatgattctaaagtccaatcctggcaaggctctccttctccatctagctcttgtctaccttctcagccatatttctcaccactcaccttcatgaatcctgggcatcagaatcactatcaatgaacatttctctcttcctctggacctgactccttaataagcacaagaactgtatctttgtctagtacccagcatatggtcaatcttcaaaaaacatttgttgacctttcaactcagtgcttgagagccagacaacctgagtttgaatcccagcttctccacttacacactgtgttagcagacagaagtgtctcaacttctctggtttcaattcctcatccgtaaaacaggaattaaatggagtcaatgtgttagtatttatgcaatgcttacaacagtctttggctcatagcaactactatacaaagtgatggttaaaaaagcagaaatgagtgtaaaaccaaattacgcagtcaaaggcagcaacccgaactgcactcagtaattttttcatggactatgccactggccatggagaaggacagatacagaaggtgtctgaatgagtcagtacaaatacatctcagatgctggaagaacagctcaaagccacactgaaaagatgatgacattgttgtcataagctagagtcataagtgacctcagaaatctctttaacagcaaccctgactgctggccatcttgcctttgtttgaatgcccccaggaaaaggagatcatccccagaaggatagctcattctactgatagggggaccatacaggaggaaaaaatgcaaagggcacaaggggaattgtagagaggggcatcatacagaggagcaccacagacagggacactatagagagggtcggtattataaaaaataataatagagagggatatcaaagaggggtgtcagagaggagtacatcatagacaggaacgtcatagaaaaaagcattttaaagggtggcttccaaacaagcccacaatgagctaccacttcacacccaatggcatggctactatcaaacacacacacacacacacacacacacacagagaaaacaacaagcgttggtgaggacatggagaaattggaactctatgcattgatggtgggaatataaaattgtacagccactgtggaaaacagttttgtggttcttcaaaatttaaatataaaattaccagataatccagcaattccactcctaggtatacacccaaaagaatagaaagcagggagcagggactcaaacatacacttgtacaccagtgttcacagcagcattattcacaatagccaaaaagtgaaagcaacccaagtgtccattgacatataaatggataaataaaatgtgatatacccatacaatggaattttattcaggacctttaaaagaaatgaaagtctgacacatgctacaacatgctataaaacttgaagacattatgctaagtgaaagaagccaggcagaaaaggacaaatactgtacgattccacttacaaaaggtctctagaataggcaaattcatagagataaaaagtagaacagagattaccaggagctgggggaaggaagagtgggaagttcttgtctaatgaacacagtttctgtttgggatgacgagaaacttccagaagtacctaatgatggttatacaacattgtgaatgtacttaatgtcattgaattgtacactttaaaagggctaaatggtaaattttacgttatgaatattttaccacaactttaaaaatacttaaaaaaaagagtggcttctcagagaggagcttcttttttattttattttattttatttttattatttttttattattatactttaagttctagggtacatgtgcacaacgtgcaggtttgttccatatgtatacatgtgccatgttggtgtgctgcacccattaacattatattaggtatatctcctaatgctatccctcccccctccccctaccccacaacaggccccagtgtgtgatgttccccttcctgtgtccaagtgttctcattgttcagttcccacctatgagtgaatggtgtttggttttctgtccttgcgacagtttgctcagaaggatggtctccagcttcatccatgtccctacaaaggacatgaactcatccttttttatggctgcatagtattccatggtgtgtatgtgccacattttcttaatccagtctatcgttgatggacatttgggttggttccaagtctttgctattgtgaatagtgccgcaataaacatatgtgtgcatgtgtctttatagcagcatgatttataatcctttgggtatatacccagtaatgggatggctgggtcaaatggtatttctagccctaggtccttgaggaatcgccacactgtcttccacaatggttgaactagtttacagtcccaccaacagtgtaaaagtgttcctatttctccacatcctctctagcacctgttgtttcctgacttttgaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatccatcgcccactttttgatggggttgtttgtttttttcttgtaagtttgtttgagttcgttgtagattctggatattagccctttgtcagatgagtagattgcaaaatttttcccccattctgtaggttgcctgttcactctgatgatagtttcttttgctgtgcggaagctctttagtttaattagatcccatttgtcaattttggcttttgttgccattgcttttggtgttttagacatgaagtccttgcccatgcctatgtcctgaatagtattgcctaggttttcttctagggtttttatggttttaggtcttacatttaagtctttaatccatcttgaattaatttttgtataaggtgtaaggaagggatccagtttcagctttctacatatggctagccagttttcccagcaccgtttattaaatagggaatcctttccccattgcttgtttttgtcagtcagagtggagcttcttaaagccagcctcttagaggatggtttcctagaaatagatataatgaaaaggagcaccatagggaggtgtaccatagggaggtgtaccatagagaggggtccatagagaggagcaccatagagagaggcaccagagagagaagctccatagagaggggttgccatagaaaggagtgccataatgaagagcaccacagagaggggtgctagagagacaagtgtcatagagagggacagcatagatagagtcatcacagattaaatgcatcatcggctcatcacagataagggcatcgtacaaagggacatcatagaggaccattacagagagggacatcataggaggagattcaatggttatcagatatcatttaatcacagagaaggacagcataggatcattctagagaagtctatcagacaaggacatcttagaggctttcacctcagcctctcctgtctggacatgagattgtgagctccctgagaacagaaatgggtcttattcatctttgtatttccaacatctgacacatgtgttggcacctgacaggaacccaatcttgtttgtggagtgaatgcgtgtataagcatttcttctacatgcagtctttgaagaatgtagaacctgttacccctttcttctgttctgcagactgaagtagcctagttcttgttaaagtgtccaatgtgctgaatgtttctggcctcccctatcctaggagacctggatacccactggtagtaggcagaagttctaggatgtgcctccaaaaatgttccacctgaatccctggaacctttgaatgttatgaggtagtactcccatgattatgttaaggtatacagcacagttgaccttaaaatagggagattatctgggtagacaccatctggtctcatgagcccataaaagcagagaacattttctggctgatggcagaaggggaagtcatagagattcaaagtgtgagaaagatttgatgtaccatttctggctttgaaaatggaagaggtcatgtgcaaggatggaaaagcagcctgtaggagctgagcaaccctccacaaacagaagcaaggaaatgaagacctcagtcctacaactcaaggagctaaattcagtcaacaacctgagtgatcttggaagtggattctttcccagagcctccaggtaagagcccaggatggccaatattttaatttcagccttatgaaaccctcggcatagaacccagttgagcctatccagacttcaagcctacagaactgtgagctaatagaaagtgttttattttgctaaatttgttgtaatttgttgtgcagcaacagaaaaccaatatgctatttgtcattgtctttatttaagagttcccagaactaattttttttttttgaaacagagccttgctctgtcacccaggctggagtgcaatggcatgatctccactcactgcaacctccgcctcccaagttcaagcaattctcctgcctcagcctcccgagtagctgggattacaggtgcctgccaccacgcccagctaattttttgtatttttaatagagacggggtttcaccatgttggccaggttagtcttgaactcctgacctcaggtgatccactcaccttggcctccaaaagtgctgggattacaggcgtgagctactgcacccagccttcagaactaatgttttaaatgagtattctaattaaatgttttttttaattctgaataggaaaataattccctccccatcttccctttaatttgaggaaattttactttcttattttagctcattagttgccattcaattagttgaaaggaatatttgcaaatgaactgtagtaatgttcgtagttaccagaaaggagcagttgtttatatgtttctaaattgtttcatacaataatatctgactgataatgtgaaaaacttaagtgccctgatagaaacacatttggacaactggagctgtataactctagatttatagatctttctagttgagaagagtgtaacttattcataaatttaaaatatagtaacatcagaaacatctggttttcattccaaaatgtaaagagcatgtcagtcatcaatcccgccctcttaacaagaaaaaggcagaacaaactgaaaaccaatgacttgtcttagatccttcagagaattgaggtcatagtacaaactgccaccccagaaactgcacaggcaagcaaatccagagaatatagatcagtttacctgaagcagaagccattgggcctaatagcagtaggaacacttaaatagtaacttcgatgaatttctggtcactaagtatggactagctttagtaagtagttaaaaactactgctgaaactggatcgcttccttacaccttatacaaaaattaattcaagatggattaaagacttaaacgatagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaaacaaatttacaagaaaaaaacaaacaaccccatcaaaaagtgggtgaaggacatgaacagacacttgtcaaaagaagacatttatgcagccaaaaaacacatgaaaaaatgctcaccatcactggccatcagagaaatgcaaatcaaaaccacaatgagataccatctcacaccagttacaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccctcccattactgggtatatacccaaaggactataaatcatgctgctataaagacacatgcacacatatgtttattgcggcactattcccaatagcaaagacttggaaccaacccagatgtccaacaatgatagactggattaagaaaatgtggcacatatacaccatggaatactatgcagccataaaaaaggatgagttcatgtcctttatagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggagcgatagcattaggagatatacctaatgctaaatgacaagttagtgggtgcagcgcaccagcatggcacatgtatacatatgtaactaaccagcacattgtgcacatgtaccctaaaacttaaagtataataataataataaaattaacaacaacaacaacaaaaaaaaactactgggagcctaatttcagtgggatcccaacattttcatgggttttacctctaggattccccccacaaggttctcatggtgaagattagaaaaaatttacttagtgcttggccagagcaagaaggaaaagtaacactttggacatatgaaagtaaccattttgaaataagcccagagcattgtttacaaaagaaagaatcagtaacaagggaaaagaatttaccagagccttatctgacttggtagaagaaaaattaccttattccagccctctgtagctttcctgtctcacctaagaggaaaaataaaagctgagagtcacttgtgaaggtcacagcccaggggcacaagcataataaaagattaagacccaatcataggattatagaatgcttcccctccccctacatcctataaccacatcaacagtgctcctgtataatgacagtgaattacaagcaaaataacggaaatactcaaactcgatttaagaaggagtttctagggaaacgtaaagatacaatgggtgagggaggacaaagataattgaggaaatctaagcctatgacacctacagctacagcaaacagtaaacatgcataacccctagccagatcaacataaaacttcacactaaaggtttatttatgtacctcagtttctattacccaatacatcatgcccagctttcaacaaaaaaattacaaggcattctaaaaggcaagaaaaactacaatctgaagagataaagcaagcattagaaccagattcagatatggtagacatttttgaaattatcagactgagaatttaaactaactatgattaatatgctaaaggttctgttagaaaaaaatagacaatgtgcaagaacagatggataatgtaaacagagaaatggatattctaagaaagaatcaaaaggaaatgctattatagaagccacaaacactgtaacagaaatgaagaatgtctttgatgggttcatccacagactgtacatggccaagaaaagaatctgtgaggtgaaagacatgccaatagaaacttcccaaatggaaatgcaaaccaaaaaaagagaattaaaaaaaggaacagaatattgaagaacagtgagaccattacaaacacaaaaggtataacatacacataatgggaatactagaagaagaataaagaagggagtagaaaaaaatacttgaatatttgaatatttgaaataataatgactgagaattttccaaaactaataacaggaaccaaaccacaaatccaggaagttccgagaacatgaagcagaataaatacccagagtctacacctagccatatcatattcaaactacagaaaactaaagacaataccaaaatcttgaaaatatagtaacagctggccgggcatggtggctcacgcctgtaatcccagcactttgggaggccgaagcgggcagatcacaaggtcaggagttcaacaccagcctgaccaacatgatgaaaccccgtctctactaaaaatacaaaaattagccgggcgtggtggtgcatgccggaaatcccagctacttgggaggctgaggcaggagaatcgcttgaacctgggaggtggaggttgcagtgagctgagatcaggcctctgcactccagcctgggcgacagatcaagactctgtctcaaaaaaaaaaaaaaaaaagaaaatatagtaacagctatttattatgtatgaagcataatataagcatcttacttatgtcacttaatttatgtataaatctctctctcaagaactttatatttatttatatttttgctttctaaaatatctctatggttgttttatttttattttttatttttataatttcaacttttagattcagggagtatgtgtgcaggttcgttgcatgggtttattgtgtgacactgagatttggggtacaaatgatcccatcattcagatagtgagcatagtatccagcagggatattttcagcccttgcccccatccctctctctcccctataatagtacccggtgtctattgttcccatatttatgtatatgtgaacccaatgtttagctcccatttataagtgagaacatgtggtatttggttttctgttcctatgttaattgacttagggtgatggcctccagctgcatccatgttgctgcaaaggacataattccattctttttatggctgcatagtatttcatggtgtaaatgtaccacattttctttatccagtccaccattgataggcacctaggtttatactatgtctttgctattgtgaataatgttgtaatgaacatacatatccacgtgtcttttttgtaggatggtttcctttccctgggatatataaccagtaatgggattgctgggtcaaatggtagttctctgttaaatactttgaaaaatctctaaactgctttccacagtggctgaactaatttacactcccaacaacaatcaacagtttataaacatccccttttctctgcagccttgccagtatctgttgttttttgactttttaataatagccattctgactggtgtgagatgatatcttattgtggttttgatttgcatttctctgatggagcatttttttcacgtttgttggccgcttgtatgtctcttttcagaagtgtctgttcatgtcctttgtccattttttgatgggttatttgtttttttacatgttcagttgtttaagttccttatggattctggatattaggcctttgtcagatgcatagtttgtgaatattttctccaattttgtaagtttgtttactcggttgatagtttttgtttgtttgtttttgttttgtttttagttttttattttttgagatggagtcttgctctttcgccaggctggagtgcaatggcgtgatctcggctcactgtcacctccatctcccaggttcaagcaatttccctgcctcagcctcccaagtagctgggactacaggcgtgcaccaccatgcctggctaattttttgtgttttagtagagatggggtttcaccatgttggccaggatggtctcaatctcctgaccttgtgatctgaaacacctcagcctcccaaagtgctgggattacaagcatgagccaccgtgctggcctcggttgatagtttcttttgctgtacagaagctctttagtttaattaagtcccacttgtcaatttttgtttttgttgcaattgcttttgaagacttagccataaattatttgccaaagctgatgtcagaaagggtatttcctacgttttcttatataatttgtagagtttgaggtcttacatttaaatctttattccatcttgagttaatttttgtgtatgatgaaaggtgggggtccagtttcattcttttgcatatggctagccagctatcccagcaccatttattgactatggagtccttttcccatttttttcatttttgaaggacattatatttatccccatttatagattataaaacagagagtcaggaaggttaaggctacctggtgagtaagtgaattgaccagaattcccaaactcagggctacttaaccccaaaggctgcattgtgattactgagaaatagtgctgatgagacctcacttagtatagtgaataagttatggaccttggaacagaaagttataaatctctgtattttgtttatgaagtttaaagctgtgatttctattagtatggaaattgtcaaacagtgtcatttctatctaatatttatataatgaaattgatattgaacacaaaggtcaatccgtaaatgaagaaagaaataaaatcaaacaaatagaagtatttttttttacttccacataagctttgactactttttaaagccaagggaaataacataatttcttgtactactaatgtaattgggccagaattttttttttttgaatctgagtcctgactatccattcatcaaaaaataaaagctctgtaaaaatagaaactttctaactcaaagaactattcctgatgatgtagctgagtcaaatagagctcccctaaccagccagaataccaaaatggttcctgagggaataactcagtcatcttctagttttacatctctatttaggctggaattctctctaaccccagcctggctaaatcaaattatttctaaaactcctgtcactcagtatgtacttgctctttgttcatttatattaatttattatatctacatattagctcactgtttctctgcctggtggttgcactctctctgttttatgcatctaacacagaaattagcaaaggaattaggcccagggaacagtgtgttcacgtgtattgtttttagccaattttctacgtataatgtagtaggagagttgaggtatctgtcacctcaaaaactagcatcattatcttccatgggtctcacactggtggctacatgtggcaagccaattgcctttttgtggggtccttttattagttgtctactgctgcaaaatgaattgtcccagaacttagaggcttaaaatatcacacatttattatctctcaggttttgtgggtaaggaatctggtcacagcttaactgcatcttctgatcagggtctcactaggctgtgatccggatatccactaaacctgggatctcatctggagacctgactggggaataacgtgcttacgagcttactcatgtaattgttggcagactcagttcattgggggctgttgggctgagggctctatttcctcactgactgttgcccagagaccaccctcaattccttgccatgtgggcctctccaacatgccagcttgctttatcacagccagctagggtgagagtctgctagtaagatgaatgtcacaatgtcttttgatgaattatggaaataaattcccctcaatgttgccatgtcctataagttagaagcaagttacttaaggggagggaaataccaagttgtgaatactagggaggcagggaccatttggtgccatcttggagatatctaccacagcatttatagtggtctgaagggtagtagaattagggaattttgcgtcttgttaataaaaaaaaaaaagactaggaaatcaaaaatatttctagagccagaaatgagtttaaatccctgcttggctacttctaataagtctagttttgggtaagtttcttgacttctttaggtctcctttgggaaatttcttctttgggaaatatgggaataaaaatattggctttgcctagcagttgtaagtatataggaaaagtacctgttggtctcccacatagtgggtgtgagtgtctactgcatgttaatatcccttcacctcccttaaggctacattgagatcagcctgttaggtatctcaaccttgccataaatctcctggaagttctagaaatatgttaagttgtcatgatttttgtaatatcacaccagaaccacacattgattagcccagcattcattacatgattcatggtttccaatcatgatattttcataaaataaaccaaaggactcggatctggccttatagtgtcataagatttttctgctatcctcatgccatggcctatgtgcacaaatagaaatctaagttgccttccaactctaaagtatttgttgtccctcattacattctgtgtactacacagtaattgattactttgtctaaactcagtactacttcctttaaaacaatttttgaggaccattatgtgattaaaagacattctagcctgcttgtcaattatttgcttgaggtgaaaaaaacggaaaaaggacaagtgaaattcatatttgagctgtctgcagaaaccaaagtagcatcagccacgtaccagtaatattagcactggtggcctgccaggtgaggggggatgaaaaaggttgtgcctgaaatgagtgttgatctgatgccctcaactccatgctgctttctaatattagacattttagaaggttgattataacaccaataagaactagacataataagaatttactctatacataaaaattccaatgacagtcaacatgaagaagaaaaaaaattcacccacaaataccatcatggtgacaaagaatcaaagatccatcttctcttaccccaatatgtggtgtgtcttctatttggccccaggatagactgagaaacacaaaaatggatagctgtcatctaataaatgcctgttaaatgatggtgcttacaaaagacagtctctaaaattcctacaacaaccatacaatacagacgctcttgctttctttttctccttccttcccttcttttctttcctactttctcttcccttctcttctcctcccactccctctccttagaaatataaataaggggactgatgagctcagagtgggtaaagatgtccattgccacacagctggctagtgacttcacagcccagaatttttcttcttcatctttccgacttgaagtagaaattcatggaaaaataaatttaataacagaagcaaaatggggtgagagatcaaagtgctaaattgctgtcacaaaactgggtagagacttgaatcaataacagttaaaggattctgatgagacatttcataggatataaagcaaactaggagagaggaggggagcatcaatacatgccagacgcagttgccagacccttaggcaatccaaaataatgagcaacatatctgcttttgataggctcccagtcacgtggacaaggcagagtagtcaaaagatgttttaatgcaatgtgacaagtactatagcaaagatatgaacctagtgaggaacagagcagagagaggaatcctgcagggacacattttggggagtggagctttggagaataattgctctgaaaagagaacatgagaaaccctacaggtcacagacacagtttgcaaggccccatcagcaatgccccactgcaaatgcagcaacctgccatgcccgctttggtctaagcattgataacaaaatggaataactgtttcagaacagcagcagctgagtttgcagctctgtgactgtacttgaagtcactttcaaagccagccccctactcaatgcctgctctctgttcatttaaataacagagataataaagaacagctgatgggcaaagtctggagaagaaaacaggattgactggactgcactggggagatttttaaggagtaacaatgcatcgaacgtgggtttttgcatgtttgcttgtctcatggagacagcttgttaccaactatatttggtaacaagcactactgttgactcatgatttccttaatgccttagtatctatcatgtatatgtttactttgacatcagggcatggaaagttctattcaacaattcctgggtctaatttcagtagttccattctctgtgacctcacaatgggagccagcagccttccatcttgtgatggtgacttgctcttctaggtggagtgggaggagcaccgactatgtgctgggacagggctggcttcaaggtctgcttcagccccttgctggctgcatgactccggcaaatcacttactggcatttgttgtaatgcacatactggcattcattgtagaatttctattctggtggtgatagtcaattggttctttatgcaaacggaggtgatatcaacactgaaaattctgagtgaattgttaaactctggtgaattgctctgtgagtggttaggcaaaattgaagaggactgctctgctggacaggcccaatttattaggccccgctctaaatatgacttttatccccatactttttaaataattagcttttgaactattttacatctgaaaataaaagacagaatatggtaaatatctggctttcccagatattcaatatgtagtactttgaatggattaatttatattaggtcactttaaaatcagcacccaaatttttgcaaaaaaaatatgttgatagatgtatctttgtttaaatgggggcccagggtcagggggtagagacaacaccacactttattcaagaagttttcaaatcattaatcttcctgacttataactataagatactcattatttatgatcaattattttagaaatcacatgaaagttatttggaagcatttagacaccttctcctaaactaagttcgtaatgtcaacctgccccccaagcaattgttgaattcattgatgggagatatatagaaaagaagtgtgttcaaattgtcattaataaaacctcaaaaggccccttcaagcatagaaaggggaacccagactttccacacactccaccctccacacttgtggtgaaccatattgttcttagagaagaatgctaggtacgcacctaccatctcggatgaagcatattctttctggccaatcaccctgaacaaggcctagtttgggttttattaataagaaaggcaagatattaaatagatcacaaggtgcaagctactagtagagggtataaagcaaaatcacaaatcagattgatggactgtggtgactgtttttctctttggcccaaacaaaaatgcggggcctacacaaagcactttattaacctatcaaaaaaaaaatcattaaaaaaaaaactgaaaaaaaaaaactgaattttcttctttctgtaaacagcccttaaaaaaattatgccattcatgtcaaatacgtatctggtgtaaaatcaataaccgtaaaataccatacaagaaaattttgaaagcaaacaaaatcacattatactgtgactatgccatacaagtgtgtcacattggccagcttcctgtacaatgtcaaaaatccatgcacaattgttgacagcttttaaaatgcactttttcaattagaataaaattattcctgggcaaataataaagtttatgaagaacaaactttttctaaatccatgtcagctttacacaagaaggctgatgaagatttatggcagatttcttgcttattctttcttcccaccaagtgcctcttggtgagcaaacttacagcctcattcttccatgggaaaaacagtgtatagagatttggttgctggcctgtaccaagtaaaggcagataagaagttttatgggtcacgagatttagacttggaggatttgctcttggattataaccaaggcaagggaatgaggcagttggaacacatttttttaggttgtctttatagattgtttgctgattaatggccttttcagagttgtaaaatcttctaaggccaatgccagggctagttctgctcttgcttttgctattctaaatacattgtcattaaagttagttattttagcaaaaggcagagacaaacgacttgttttttcattggtttccaactaaaaccagctctcttctttctctttaaagaactcttcatacaaatattatgatctttaaatgtctggtttgaaaccagttttaagattgctccaccaactgaaaataatgccgagtctcagaggcaattatttgtaggccctggttgttttttaaagaagtgtaatcttggcatgcaatgctggatgaaagcataaaattctatgatgaatgtcagggagtcgtcctataagagcaatcctggccttgtggcattttagcaagacactgagcaacatccaccactcaaacacagcaacaaatgctaaaaggacaataagtgtccattctgggttgacaagtttatagtgtccaagaaataaaacgtggcagaatatgttgaaatacaaaaataattagagtataacctgatcttttttcttagcttttcatatcacaatgttttgaacagtggttttcaaccttgaggtggtttttctttccaagggacattttgcaatgtctgcaggcatttttgaatgtcacattttggggggagaaggtgcgatgctcctggcatccagtgtgggtggaggccagggataatactgctcaacatcctacaatgcacaggacagcccagacacagagaattatctgatccaatatgagaatagtgcctaggctgagaaatcctgctctggagtcatcactgagtccacagaaagtactaattatggggagatggggtgtggatatgttttcattggctcagtatatgtgtaaattaagaaaaggtcagaagcttgacatttttcaccttccagtctcttaatggatcaactgttattttagagattaaaaaggaaaaaaaacaccctaggtaagtaatgaatttataatgcagtcatgtcctttcttgttccttgatctgcttccaaagagaaaagaaaggaaatcgtccacaaactgaagttaacacttaattttgtgcttcggttaattaaacagaaaaagaatggcagtcaccatttagggaaggtagtatccatgtcttaattatagatttcctcaaaatgcatagtgctctgggcagtattggttgctctgaggtgctggtgcaaactgtcatcacactttgtgatttatagggtgtgtcaccttcagtcactcagttcaagttccttagctctgtgcttgctgactggtttctatgtgatggttgatcttgtgttgtgagcagctggtttctcttaaatgcctgtgtctatgtttgctacatttctatgacaatttgttcacaccaatataattatgactgcattagcacttgccctgtaaaccacatgattcaggggtttatgagtaggtaataaaaactcacttcaggctgaaacttgtctcagacatggaaccttgggggtggggacagttgtaaatggtcggtatgggttagggccttctgaagtttgtggtcattagtctcatttattgttacccttctacagagccaagactatgtgctgtgggatttatatctttcatcatttagcaaaacacaggacctttgccaagtttcatcagcattcattaattctttcaacaaatatttgactgcctataatgggccaggggcaggtgaacagcccagagttcatgttctcatacagcttctattctagtggacagagaagtggcagggaaggagggagcaagagaaggagaaagggagcaaggcaagaaggggaggaggaaagaagagaagaggaagggaggatgagatggaaggaagaatatcagatggtcagagctttacaaaggattaaaatagagtgaattgtggctactttagaacagtagacaaggacagtctctgtggaggtgacctgaatgacaagtcagccatgtgaagggcatgccaggcagaggcatgagctaggatgctcctccaaggcttgatggacaggaaggcccataggctggtgcagaaagggcaagggcaagatatggcccatgtgatagccaatggagctggggcctctaagcccttctaaacaggggttaggagcttggttttttaaggaggggaagggcatgggctgatttcagttttaaatagatctctctggcaaatgtgggcaggagagggagcagggagaccagttgggaggctatggctgaaatcgggatggcgacattgtgaacttgcttgcagggcctcatttgcaatgtcctttcagggaacagaaaacagctgaggaatgtccaaggagtgaggtgcaggctgatatcctcctcctgctagaagcaccatccacgtgagatcgctgagatcagaagggatgcatggcctttgccaatcagtttgctcatctgtaaaatgggctttataatgcataatctgcagaactgtggcaaggatcagcaatgtatgaaaagctcctagtccacacccagcaataatcatttgatgtccaagcaaatctgttgttaactcatataagcagatcaggtgtccatgactactttccacagatgtgggaaggcaaaatattaccttttaattgctctcaagacataatagaacccattttgtatttgaattgatgtatatggagctattgcagttactgaaataatttatttttcagctgctcttcagtttccaaatcttcttagctcctatttctctcttgcttcccacatttgtaggacttttaatatgcactgcttcaaactgccttccagaaagatagtgccaaatcgtatgagaatgtcctactcctttttttaattgagatataactcacataccataaattcatcctttcaaagtgtacaattcagtggttgtctagtatattcacagagttctgcaactatcaccactaattaattcagaacattttcatcaccctataaagaaattctgtgcccatcagcaatcactccccacttccccgtccctagcccctggcaaccactaagctgctttttgtctctatggatttgcctcttctggacatttcatatagatggaatcatacaatatgtggctttttccatctggcttcttccatttagcatgttttcaaggttcattcatgttgtaattaactcctatttttgaactatatatttatttatatatttcaaaataggaatttgtttgcatagtagttatagtaagtagaacattctaccaatatgtgttattttatcacaagggagaatatgtgttcggtcagtcagagtttattgatttattctcattaccttattggatcttacaactataatattctcttttaggtaccactgcagtattaccatcgacggttttctttttcccatttgttttggagctgtctcccttgttcttagttcattttttcctttccttctttctagtctggtgcagggctggcatactgcagcccacagtccaaatgtgacttgccacctatttttgtaaccaaagttttattggaacatggccatccccattcatttacatattgtctatgtctggttttacattaaaacaataatgttgacttattgcaacagagatcatacggctcacaaagcttaaaatatttataacaagtttgctgatccctggtctaatgtctgactgaggataggacctcagtgtttatttggttttaatcagaatgatttgtgtctcatcctggcttctctgggctggggccgctcacagacagaaccatgaagatgatgaaagcatttgttaaaatagcacttttcctctatatgagagggtaaaaatattatttcaatgaaaaaaagttagaatatttttaatattccaagactattggtaaatgtaactgttacctgaagtattgcaaatatcatattgtaagcacacacacacatgcacacacacacacatgcataccacccaatgacacatgcatgtgtatcaaacttgatggtgggtaaattacttaaaccttcctaaactcagaaatttctgggttccaggagctccagctacaggcttcggtgattgtcccgtttggactcccgttatgatcaggacccacatgtctggagtcttgtagtaaacaccagtcaatttttgttattgtctcttctgcttttctgccagtgccaactgcccccttttatctgggctgagacgttacctcaaagcaacctatttggcttggatgcttctttcttcctttcctcttcaaatttgaggggcaacaaagactttatggtcatattagccatcgtgttttctaaacaaacttgaaacatggtcttgtttaattttttctatttccagatgcctcccttgtaaaccttccccctttgatagcaacctctgtattgacctccttgtagccctggctcatgtttcccatgtgccccattctctttacattctcatcttccccaccagtctttgagcctttgaggaaagagactgttttcttttcccatctgtgctcccaatgcctaatgaagagtgtggtactcacaaggtgctgaacaaatgtcagttgaatgcctgcatgcgtgcacttaaaacttcaagaattttccttcatatatgctgttgtattcacccataacttccttatattaacattgcttttaagcaataatttatgaaagatccagatgtctatcttcagcaaggatattgcctaccctttcatccgtccattcaactgtcattagcaaaacaactatgttccctgtaaaatacacaaaattgtgccaggtcaggtgacagatactacacaaagaatcaaaatacaaacacacgtatatatacatttataaaatatgataagagctcagagggaaaatgatttggtgttgtggaagaatctatatgaagaaaaactgatttaaaattgaggaatgtgaatgttagggtgttgactggaaaagaaaattcagtttagatggttcaaatgaaaatttgttgatgaaggggctactttcagaggtgggtcagtgttaagggaacacaggagagatgctgacttgcccagagacttgcatcagctgtaggaataagggaacagaatgtggcaccagggcttactgagagctggagtcctggtactagtgggaggaactcactcccagaatggcacccaagtaggaaagcggatgaaaatacctggatgtccattacctgcagccttcagattttttaccaatgctgcctaatggccaaacccaacctagagccaagcagcaagggtgctggagtcacactgacacatggggatggggcacacagcaggggagagaggggtggaaaatggataaggaagcagagcacggcctgggcaacatagtgagaccccatctctacaaaaaattaaaaataaaaaaaattacctgggcgtggtgggacccatagtcccagctacttgggaggctaagtctgggaggttgagatatgattgagctgctgcactactgcctgggtgacagagtgagaccccatctcaaaagaaaagaaaaaaaaagaaagcagagcaggaaaggaaatgggaagttaagaaaagcctttttagggtgtgatatttaggtcatgatacgaaacataagagtttagtggtagggggaggatatttccagttagagggaacagactgtgtggaatctctgtgcagggaaaatgatttggggatcactgtggctaaggcaaggtgaacaaggtgagaggatgaggtaggcagggtccaggtcatcgatgccatgtagttgttgaagcaagtttgattgttatccccagagcagtggggatctgttaaagagggctgaacaggaggcaatctgatcctggtgtgcagcagtctggagagaaacagtgagggctcagtcaagggtggggcagaagaatgatgaactcgttcccctataatgtggaatcccccaccctacctacttaggtattattaggccacttccagaaagattgcacagtcatgtgtcacttaacgacgagactgcgttctgagaaatgcatcattaggcaattctatgattgtgcgaacatagagtgaacttacacaaacctagatggtgcagcctgctacacacctaggctgtatggtagagcctattgctcctaggatacaaacctgcacagcatgtgactgtactgaatactgcaggcaactgtaacacaatggtatttgtgtatctaaacatagaacagatacagtacgaatatggtatataagattaaaaatggtacacctgtaaagggcagctctattgtaatcttatgggaacatgtcatatatgcagtccctcactgatcaaaacattgttatgtggtgcatgattgcactttgtcttaatttcactgacagatgtaaaataagataagagcatttattcaagagtagattacttacatttttaatctattcattgtcatataattgtaaattcctctgtagtttagccagcatagactttatttatttatttatttatttatacagggtcttggtctgtcacccgggctggggtgcagtagcgcaattacggctcactgcagctctgatctctaaggctgaggcaatcctcccacctcagcctcccgaatagctggaaccacaggcacgcaccaccacacctggctgattttttttgtttatttgttttgtgtttgctttgtttttgttttttggtttttgtttttgtttttgtttttgttttggtagagacaaggtttcaccatgttgcccaggttggtctcaaactcctggactcaagtgatcctcccgcctcggcctcccaaaatactgggattacaggcgtaagccgccacatccgactgaacttctttatttaaaatctggaaaggatgatatccttagcaaacgatttctaaaccttggcactactggcatttggggcctgataattctctgttgtgggctgtcctttgccctctaggtgtttagcagcattcctagcctctacccattacatgccagtaacatccacccccaaactatgacaaccaaaatgtctccaggtattgctgaaaatccctgggtggcacagtaccccacccccaccccagttgggaaccactgcagtttggcacatacaatggtgttgattttctttttgccacgtgggtttattattttgcacctattttcccagggatttggaattccctgaaaacagagatggtgcttcattcttctccctgactgcatttgctatgaacacaataagcaacatattaggagatcaatacatatttgcaggaaaagtgaatgaacaatgaatagatcttaaaggtgacacaaccatgaacatgggattaggattcaaggaaacttaagtcattctctcactggtgattactctaattaaggataagatcactagaaagagtatggaaggaagttattagagactttccaagctgcataaaatattactattttatacataatttaaataaatccattacactttacaaagtcactaattgtctggattaacttctctagtcagattctgctaatcagtttctctgatctgtatctccttcaactgaggaaatgtgacagctgacatctgagcttttgaaccaaaatttggatcaaattctggcaacctgggtgatatcagccaaaaggtataacatgcctgaatttcagtttcctcatctgtaaaatgatgatggtgatacctatttcaccattaaattaagaactgtgataatgaatgtaaagggcaaattctaaactgtaaagcattatatcaacatttattatcattaataagagtcaatcagaggtcattagggagtcctgtttgatttttatgtcttccttaaaaagttgtttatttttttaagttgtttaacttgcatttatactacattttagggggggaaattcctgttaggaagaaaagtggttttttgcctttctttagatagaagtggtttttgggccgggtgcagtggctcagacctgtaatcccagcactttgggaggcttagccgagaggattgtttgagcccgggagaccagcctgggcaatatagtgagatcttgtctctattttaaaaagaaaagaaggaaaagaagagaagagaagagaggaggggaggggaggggaggggaggggaggggaggggaggggaggggaggggaaagagaaaagaaaagaaaaaaagaaaaaacaaaagaaaagagagtggttttaattttcttaaaataattcttttggttatgcaagtagtacgtggaaacattcttattatacaatattcaaatttaaaaaaatatataaagtagattcatttaaaaaaaatagatccctcattacccccactattactacgcactcaagggaaaccagttttaacagtttggtgtttcagttaattttatatgctttaacatacatttgtttttaacatagctaggattatgtattttctactgtggtatcttttttcagtcttaaaaaattttgccatcattttctaataaatggtaggttattgagataaatatagtgtcccttttttagacttaccagcctattccttgtctaagttaactgtccacaataaacctgtatcttttcctactgtcttagaacagtttgagaacatcatatgtgttgtgtggactctgggagcttgttgaattacacttgtatttttctatttttttttttttactttaagttttagggtacatgtgcacaacgtgcaggttagttacatatgtatacatgtgccacatgtgccatgttggtgtgctgcacccattaactcgtcatttaacattaggtatatctcctaatgctatccctcccccctccccccaccccacaacaggccccggtgtgtgatgttccccttcctgtgtccatgtgttctcattgttcaattcccacctatgagtgagaacatgtggtgtttggttttttgtccttgtgatagtttgctcagaatgatggtttccagcttcatccatgtccctacaaatgacatgaactcatcctttttatggctgcatagtattccatggtgtatatgggccacatttttttcatccagtctatcattgttgcacatttgggttggttccaagtctttgctattgtgaatagtgccacaataaacatacatgtgcatgtgtctttataccagcatgatttataatcctttgggtatatacccagtaatgggatggctgggtcaaatggtatttctagttgtagatccctgaggaatcgccacactgacttccacaatggttgaactagtttacagtcctaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgaataaatgtcttcttttgagaagtgtctgttcatatccttcacccactttttgatggggttgtttgtttttttcttgtaaatttgtttgagttcattgtagattctggatattagccctttgtcaggtgagtagattgcaaaaattttctcccattctgtaggttgcctgttcactctgatggtagtttcttttgctgtgcagaagctcttgagtttaattagatgccatttgtcaattttggcttttgttgccattgcttttggtgttttagacatgaagtccttgcccatgcctatgtcctgaatggtaatacctaggttttcttctagggtttttatggttttaggtctaacatttaaatctttaatccatcttgaattaatttttgtataaggcgtaaggaagggatccagtttcagctttctacatatggctagccagttttcccagcaccatttattaaatagggaatcctttccccatttcttgtttttgtcaggtttgtcaaagatcagatggttgtagatatgcggcattatttctgagggctctgttctgttccattggtctatatctctgttttggtaccagtaccatgctgttttggttgctgtagccttgtagtatagtttgaagtcaggtagcgtgatgcctccagctttgttcttttggcttaggattgacttggtgatgcgggctcttttttggttccatatgaactttaaagtaattttttccaattctttgaagaaagtcattggtagcttgatggggatggcattgaatctataaattaccttgggcagtatgaccattttcatgatattgattcttcctacccatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgggttttgcacattgattttgtatcctgagactttgctgaagttgcctaatagcttaaggagattttgggctgagacgatggggttttctagatatacaatcatgtcatctgcaaacagggacaatttgacttcctcttttcctaattgaataccctcttctgcctgactgccctggccagaacttccaacactatgttgaataggagtggtgagagagggcatccctgtcttgtgccagttttcaaagggaatgcttccagtttttgctcattcagtatgatattggctgtgggtttgtcatagatagctcctattattttgagatgcgtcccatcaatacacttgtgtttttcacaatggcactatcagacaatctaaaaattttgaaaatacaactcgtaggccaggtgcggtggcttacacctgtaatcccagcaatttgggaggccgaggcaggcggattaccagaggtcaggagttcaagaccagcctggtcaatatggtgaaaccccgtctctactaaaaatacaaaaattagccgggcgtggtggcatgcgcctgtaatcccaggtactcgggaggctgaggcaggagaattgcttgagcccaggaggcggaggttgcagtgagccgagattgtcccactgcactccagtctgactgacagagtgagactctgtctcaaaaaaaaaaaaaaaaaaaagaaaatacaacttgtaagaggagttggcattgatgttagttggtgagttcccataatgaaaggcacatagaaaaccgtcaattgtatttgacattcaggttttcaaatctcatatgaatgctgccattgcccattgttggaaagtaacatacgtttcccattcacttttgtgtgaaggcattgtgaagtgtaagttctttggagttctgtatttgtgagtcagtgtgggtatgtaatccctataaaaatctaatgaggtttattacactgatggcagaatatacttaattattaaccaccttaatgtttggtttggtgtggttactttcatgtattttaattttatagctatgtaaaaacgggataaagtagagaactctgaaataaagcagaatgaattgtattttattctttttataaaaaataaatattttttatttgtagcaaaatattgatctattttgaagtcaaaaatttttcatccagttgatgggaaagctgcttttatatcagcaagaatatctttctgccaataggagtgccatttttttttttaaaaaaaagagctacaagtctgtttttaatctcacatttagttaaggaacaattttgatggaggtagaggattgccaaaggaaaatgctttcctgctgctaaagaaatgatgaagcaggcactgtgtttatttttataacaatgtattttgatcctgtgacaaatgtttcaccatagctttaacatttttcctattctaaactaaattgtgtatgttaacattctgatctgtctcaacttctaagaacactaggatgtattgttggtgttgaggacttttctttctggtttcctgtacatttaattcaattacatggttgttgggtgtctcgcatttgcaaagtaccagctagatgctgttgcgtgatagaaggacaattaagccaacagctctccatctgggggaggcaaactcatccccaagtaacttaggtacaaagaagagcataataagttctataagagaattagaaaaaaaggtgatgaggaaaacaaggagggaagtaaatttaaataaggatggtcctgcaggtcttcttggaagaggtgaaaatagagatttacattaaaaaatggataaatttaatagactggtatgaaagtgcgggggttggagaacaaatattcctagataaactgaaaatcttgaaatacggcaccaagatgacactgtggctgtctatttaagaatgtagtaatgggaacagaactcccattactgtactgtccagtatggccagccactagctgtccaatatggctattcagatttgaattaaattaaatacagctaaaaattcagtttctcagtcacgctagcaacatttcaagtgcttaatagccatcaggggctagggagtgtccaagaagtggtggaaagattgttgatcagtgtatctcaaactttagcatgcacctggagagcttgttaaaacaccaagtgctggcacctacccccagaaattctgtgtatgtagttctggggtaggacttgcaattctgcttgtctaacaagctcccaagtgatgttgatgctgccgggcagggccacagtttgaacagtgcttcccaaatgattactgttttaaatttttgattgatcatatactgatacatatatttttcagcagtaaaagtaaattactagaaaaagtataaaaaattattttaaaagctacaaaattttaaaactatattactagattcaacagctgcataattacatctcaataatataatcagaacaaatgtgggaaaaaataaaagaatgcctaggaaagtttcttaatgactactccctatttctctatgtatctccatcatgaaccataccaaggggttcactgaccacactggcccatgggctacactgttgtaatctgaatatcggcctgaggatcctgcacttcatgctgttggtaatagcaattcctcgcatcttttgaggaagaaaatgatgtaatctaaatcataggaagagaaacaaggtggcaatggagagaagtaacgaagaaaggatgctgcccaagccagggagaccaattccaaggccatgacaaaatccaggcaggaggaactaagggcggcagacaggaagggtcagatgccaaacacattgaggtcatagaattaacaggattgggcagctaattggatgtggggtgtgaggaagaaaagagatttcatgatgacttggtggtttcgatcctgagcaattgacagggtggcaatgtcattaaccaaaatatgaaattcaagaagcacctgaatcactttacgctgagatgcagatgcaaattcttttgttatccctgaggccgaatttatgcttcattcatctgtgtggactcgtgtttcagaggtgtactttataagtcattgttccacacacaaaaaagcatcctgatgggtgagtgactcatacacagattatttgcatgtgagatgggcatttaaaatggcaaagataaatgattttcgagcaatccaatgtactgtattaggaaaagtactgtactacttgcagatatagaagtggtccagagttcttaaaacacctttagagctttatagaacaacttaatcttttgatattttgaaaatgtactattgctttacatatggaaaatcatatctccaagaacaactaataacactaatcaaacatattggaatgtattaccagtgatccaaaagatcatcctaaataccacttctttacatgtagaggtgtagtgatggaagtcattagaaagctgctattttaaacccacaaaagcaaatgtgggtttgaaattacctttgaacttgacaagagttatagaatatttggggacttcagcaacaatgaattaatgtcatatgatgcactagaaagactctgagaaatattctcaggtcactaaaatgaatttgctgtttttctttcgtgttcaatatccataacacatttatcaaatttaaacctacaaacagcaatgtgagccctctttctttgaggtcaccatcttaagaatattattttcaaggagcctgcacatcacaaggtatactctggggatatcacttccctaggtgtttgaggcaaattcccatgaagctaggaaaggagattttatttcatatataactcttactccttacacttttttaaaagtggaaagtgcattcattgttcatttccatcactgaaaacccacatattcacaaactaaaggagatttgatattttagaacgtcattttgattaactcaggcaaaagcttgattctctttttccccttcacttatttaagccacttcaattcttaattctcagcttaaactgtaaaccaggggtccccaacctccggtactggtccatggcctgttaggaactgggccacacagcaggatgtgagtggcaggccagcaagcattaccgcctgagccctgcctcctgtcagatcagctgcagcattggattctcatagaagtgtgaaccctattgtgaactgcgcacaagagagatctagggtgcgcactccttatgagaatctaactaatgcctgatgatctgaggtggaacagtttcatcttgaaaccatccccctaccaccacatctatggaaaaattgtcttccacaaaactggtccctggtgccaagaagtttggggaccgcagctgtaaacacacaatctggtgtaaaggaactcagaaatgcattgtcacttctttcatctgtgtttctttgagtctggttggagtcattgcttctcttcttcccaactctatttaaaaatatactcctggctgaaattaatgtttcaacaattagtttagcttaactcccaaaacaatttaaaagatttatctctctatttaggactaagtgcctagatcaagctttttacttctttctgatgctgcctgcagtgtatacaaatacaatccctactttcaattctccacacctccacacccctcccaccatcagagccctggtgatggatagaaattaatgagataaattctgaaagccacaggatggagaggatatctaattttctcagctaatggacacttgaaagactattaggagctgggctcatgttatgagtacatgaataaagaagggctctctggcctggcatggtgtctcatgcctataatcctggcactttgggaggctgacacaagcagatcacctgaggtcaggagatcgagaccagcctggccaacatggtgaaaccccgtatctactaaaaatacaaaagttagctgggcgtggtggcctgcacctgtagtctcagctactcaggaggctgaggcaggagaatcgcttgaacctgggaacctgggaggcggaggatgcagtgagccaagatcacaccactgccctccagcctgggcaacagagcaagactccatctcaaaaaaaaaacaaagaaaagaaaaataggactctctagaaattgttgctcttaaaattgaggcttcccgagagcccagtcttgatcctcacattttactatctttacccctcagcctgcaacatgctccaataacctccaacttccaaaataagcaaacaagcaagtactcatatacctcttcctcaatccttccagctttagccctgttgctcacccagctttcaagagaaatctggttgcattctagaaattatggactatcattgtctccacttcccctaccttccattcactcttctaccttatctggctttcatcccacagctttactggagctacttttgcccacattattgaaaacctgccatattgtccaatccaatgtcctcttctctgagcttttcccaactgacctcgaaatagacttaacttttctgacaattcctttctatctacctcacccaggtttttattatatggccttctcaaagtttcctacctcgccaggcgtggtggttcatgcctgtaatcccagcactttgggaggccaaggcaggagaattacttgagcccaggagttcaaaaccaacctggacaacacggggagacctcgtctctacaaaaagttatccaggtgtggtagtgcatgcctgtagtcccagctactcgggaagctgaggtgagagaatccaccaagcctgggaggttgaggctgcagacagccatgatcacactactctagcctgggtgacagagtgagaccttgtctaaaaaaaattaaaaattccttccacttcttggactgctctttctcatttcttttgcttaccattttcctttgtgaaattatttaaagttgctgttttccagggtgtgaccccagctgctttctagttcttgctagaactagatggaaggtgataaccccttccatccccttggcatctgccatgacctatgtgctgcacactctgaattcaatatgttttactctcgtttggtttgaattccaagtgggtacaccacaggcactcaaactcaacatgtaaaacttaattctttatttctctgtttgctcttgtattagtttcctattgacactgttacagattaatacaaatttagtggcttaaaacataacaagagatccaaaatagcttggcattactgccttccttctggatgctctaggggagaatctgtttcctggccttttccagcttctagtggtcacctgtattccttggttcttggtgccttcctccattttcaagaccaacactaaggtgtctttaaatctctctaactactgcttctgtcatcatatctctttctctaccccgaccttcctgcctcacccttaaaatacctttgtgatgacattgggcccgcctgaataatccaggatcatctttctatctcaagagccttaacttaattacatctgcaaagacctttttgccatgtaaggtaatgtagggaagagaaagaaatcccttttccttctactcttttcaattccaggctgggaccctgttacaagagacacattaacaagagataaacaaacagatatttattaatatatatatatctcatatatacggtcatgcaccatataatgactttttggtcaacaatggaccacatatacgatggtggtcccataagattataatggagctgaaaaattcctatcacctactgacctcatggctgccataatgtcatagctcaacacattcctcacgtgtctggggtgatgctgggttaaacaaacctgctgtactgccagtcgtatagaagtctagcacatacaattatgtacagtacataatacttcataatgataagaaattatgttaccagtttatgtatttattatactatgctttttattttaaagtatacaccttctacttattaaagaaaaaaaagttaactgtaaaacagccttaggcaggtccttcaggaggtatttcggaagaaggcattatcataggagatgacagcaccacgcatgttattgcctctgaagaccttccagcagaacaagatgtaaaggtgtaagacggtgatattgacgttcctaaccctgtgtaggcctaggctaatgtgcatgtttgtcttcatttttaagcaaaaaaagtttaaaaagttaaaaagaatagatttgggaagctgaggcgggtagatcacgaggtcaggagttcaacaccagcctgaccaacatggtgaaaccccgtctctactaaaaatacaaaaattagccaggcgtggtggcacatgcctgtaatcccagctactcaggaggctgaggcaggagaatcacttgaacctgggaggtggaggttgcaatgagccaagatcgcgccaccgcactccggcctgggcaacaagagtgaaactccgttaaaaaaaaaaagaaaagaaaagaaaagaaaagagcttatataataagaatataaagaaaaaaaggcctggtgtggtggctcaagcctgtaatcccagcactttgggaggccgaggcgggcgaatcacgaggtcaggagatcgagaccatcctggctaacacggtgaaacccgtctctactaaaaatacaaaaaaattagccgggcatggtggcgggcgcctgtagtcccagctactcaggaggctgaggcaggagaatggcgtgaacctgggaggcggacttgcagtgagccacaatagtgccactgcactccagcctgggcgacagagagactcgtctcaaaaaaaataaataaataaacaaacaaataaaataagtacgtaacttctccaggcagatttttcctcagtgaaaccttgcctcactccccaggtagacttgacagctcctttctctgtgatcctgttgctccttgtgtgtacatttctttgccctagaaataacctcgttgcaaagcctttggctatttccatatgtatttatttcccagagattttagagagaaggaatcacgtacctttccatctatgcattcccagcacagaggagtacagtacatggcagatagtagctgcttaatatatatagaaagagagtaaatcattggaagtaagcaaataagctggtataccagttgccacattctccacctggaaaacttaactcatttaactgtttattttcctgttttcttttttttatttttaaaacttttttagaaactgggtcatgcattgtcgcccagcctgggactacaggagtgcaccaccatgcccagctagtttttaaattttttgtagacacaggggtctcaccatgttgcccaggctggtcttgaactcatggactcgagtgatcttcccacctgagcctcccaaagtgccaggattacagacatgagccaccacacctgacctctttttctgttttcttatctctcattctggacaataaacttaaagttaaggactgtgtctagtttattgtaatgtaaccccaaagtagcatttagaacactttaggtgagcaataattgtgtgtggttgaattggatgccttttttcatcaccgttgcaagaacttaattcaaataaaatgaaataaaaattgaattctgatgagaagcctgacattggatattctgactgtcctgaatactggaataggcatcaagccttctacactctgtctggattctgtaactaacttgctcagaatgaccttagattaaccacttaatgttttaaaatttcatgactttattttagaaacttgcctgcccctaccttggcatattatcaagatcaaacagaatagtggtattatcaagatcaaacagacaaaaaggcacaaactgctacgtaagagcaatttatggttatgattttgctttgaacaaaatggtgaattgctttttttgtgagttaagactcttagaaacctctcttcatgctgatggagcaggaatagagggcaagccttaatacctttttatgatctggatagtacctataggaattcaatctcttctgtccaactgatgcttgtaattcatggctaagtattcaaaagagaacaggctccctctgttatctacctggcaggagctgtttgtgtaggaacctgaggtttaaaagcctttgaaactattactgattaaattagcaaaagaaatgcctttgtccctgaggtcacctggttttcaatcaatcttaatatatatgctgacattcttgggtctcattacccacaacaaagaatccataagattgctgatcttcaggaaggccaaggctagcttgtagggtcccatttattacaatcccttgacaggtggaaagaatcttacaatacctctgtctgatgcaggggcttcattaatgtctgtgttattctattttataatgcttaatgctatgcttccattatgaggtttctcaatgtgatatctgaaaacaaataatgcattcatgactcaattaatgaacattggatttgaccagtacataaaaatacatggatacccactgtttcctttcccctcctctctccaatgccaagaagcagctaaaactcatctgatttgtttggtctttggtgtctaatgtggagcagtgtctaatgtgaggtttcttggcccatcttcctccttctttccaatccaccttgcctttcccttcccacccaattaactcttcttgcagcccagttaactatagacatttgcttctcatatgcatcctttccaatcacattctcttcttcattctttttcatttccaactcccttctggtgacctttaataaaaaacctttatttgtgcacattcttgctccctctccccctccatctcccctccccctcctccctcgcccctcctttatccctcctccctctttttcattctcctcactcccatattcatcccctgctttactgcccaatgccattcaggatctccaaaaaacccactgattatataatttgcttcttattacaaaacaaagcattctagaactggagaaaaactttaagattatccacatcaaacagaagaggagttagaatcactttatcaaagaaaataaatgctattgagatttgaagtggacttagatataataaaaagccaagaacgccaatcttgaaaactcttgaaagtgcttagaagcccccttcagaatttgacgaaagactttgactacctccatattttcttctgatgaaagctgcttttcctggagtaccagaattcaaggtacattaattttagaaagtattcctgatatattttattttgctgtttttcacaattttgctttttattttctcacagcaaaggctaattttattgttacttgtaagctggctgtgaaggaactttttaaaataatgatttataaaatatatattaggatatactgcagcacctctgtgtagtggcatgggaatacaagtgccatatcagtttggttagcataatcaatacttattagatatgagttatctgtcaagcatagggttagggtcctaggtttctctgtaagaagttaggttagagtcccagacaagcagaagctgggttagaggtctgggcttctttgttagaaaggtacctgcaggactggaagatttttcatggctgtttcttttgagtaggaatttacttcctgactacctgggctgaaaatttttttctggcactttgtgaggtctctctgttttctttatctgatccttcatctcccataggagcttctcaattgactgagccccctttcttgaacccctgctcactatatgctccaccaactctgtccacctccttcttgttggtacaattttgctgagggtaatttggaacttcaatagcctctttgggaaacttaagatctcctcaaattggcacctctaagacctcttctttcttgttacttctgttcctccttctgaaggaacttttaagagtgactctgaaactcttgagcaagtttagcttaattagaacttacatttaagcttccaagatggatcttcccaaagacgaatgctcatttagatatggaggttccagagtgtacattaataatcactcttggagttctgtatcttctttattatttgcatttcatgcaacatgtgttccctgttccgaccaacaaacttaaacctctactcttggcctgtatgtgagctggacctgcttatggcctatatcaacttgactcttcttttttacttatttttgcagtggactaaggtagaagccgcatccttgatttgacaagaggtttccagtaaagcagagcagacttaactaatacataacaaacaatacaacataatttacaaaacaagataaaatgtaaccaggggaaaaatctagtacttaggttcaaaaaaagatcagctgcacaacagcagaatcagagaaagtttgattaacatcagttctagtgaaaaatatgtggcagtatcagtggaacgaaagctaagataagacacatgtcacttgggaaccaaacaggcgctgcattaacagaattatagcactaaaatggaaaatactaaatctgctcttctcttcattggtcagaacgcaatggttaagggaagagaggtaagaaatagccagatttgaaacacacaaactcacacatgcacacacacataatggctctgttaattcatcaaaggcaatacataaattttctgatttattttttaaatggcatttagagtgttccaaggactatttaaacagctttaacagaactattccaccttagtatctgataataggttacatgtgcatttcctatacaatctatttaataattaataaagcacattaaatacatttagaactacatatttcattatcaataatcatatcagaattacttttcagtttaaactaaatttttaaaatattttaatgtactttcatttacagttatctttcagcatttttagaagttttaaccaatttatttttttaatccttcaagtccaatttcatacttatagttaatatattttaaagatgagctaccactcatttaacccttcatatgtcccttctggccttccaaactcccttttcactactttatatgattttacctctcatgtcaaatcattcaacatatctcacctacatatgtattatacatatatattttttatttatacatatatgtacagatatataatcaaatcatatgatggaattgttttagcaatttgttgctttttgcttttgaatttaaatttaaatatttaatataaattttaactcaattgttatttaaattcttatttatttgatctatttttgaatttgtatttaaaattttacttgtacttatttaagtttaatttagtttaatttaatttctatttaattttttttcattttttaaaaattttttatttccatgggttattcagggaacaggtggtatttagttacatgagtaagttctcaagtggtggtttgtgaggtttcagtgcacccatcacccaagcagtataccctgcacccaatttgtagtcttttatccctcacccccttcccaccctttccccctgagtccccaaagtccattgtgtcattcttatgctttttgatcctcatagcttagctcccatttatgagtgagagcatacaatgtttggttttccattcctgagttacttcacttacaataatggtcttcaatatcatcgaggttgctgcaaatgccattaattcactcctttttatggctgagtagtattccatcatatatatgatgaaatagatatatatacacacacacatatatacatatatatacacacacacatatacacacacaccccacactttatttatccactacttgattgatggccatttgggttggttccacatttttgcaattgcgaattgtgctgctataaacatgcgtgtgcaagcatctttttcgtataatgacttcttttcctctgggtagatacccagcagtgggattgctggatcaaatggtagttctacttttagttctttaaggaatctccatagtggttgtattatacattcccaccagcaatttttattccatttaaacatttaagttttaaaatttttggattgcttaatatactaggaaatgactaataatcaattaaaaatagataaatgtggccgggcgcggtggctcatgcctgtaatcccagcactttgggaggcccaggcaggcggatcacctgaggtcaggagttcaagaccagcctggccaacatgctgaaacccgatctctactaaaaatacaaaaaaaaaaaaaaaaaaaaaattagccaggcatggtgtcaggcgcctgtaatctcagctactagagaggctgaggcaggagaattgcttgaacctgggaggtggaggttgcagtaagctgagattgcaccactgcactccagcctgggcgacaagaatgaaactccatcaaaaaaaaaaaacatagataaatgtgaaaaaatagaaagcgtcgtttaaaaccatccagacagcaacagaagaaattgaaaaaatcctgttacatataaataccaatttgaggggatgcaaaaatagttttccatatgagaagtttatacttctcttttgccagacttttagcatttttaggattcttctgcctactcttaatttaccttattttgagaaactatatattagtcactaaaatacaacattccacttaaaacaattaaacctacaataggtagactcagtgaatttggcttcttgcaacatttgcttttgtccaattggcttccttgcctgaaagctaggtagaaatcctactctaaggctttcaagtataaaaagaatcttttttttttttttttcttgagacagagtctctctctcacccagctggagtgcagtggctcgatctcggctcactgcaagctccgcctcccgggttcacgccattctcctgcctcagcctcccgagtagctgggattacaggcgcccgccaccacgcccggctaatttttttgtatttttagtagagacagggtttcaccgtgttagccaggatggtctcgacctcctgacctcgtgatccacccgcctcagcctcccaaagtgctgggatttacaggcgtgagccaccgcacccagccaagtataaaaagaatcttaaggaagatagttctgagccactttccacaattttaagaacagataaaaataaatagctaattataataaaatgaagaatttagaggagctgtgcagattaatttccctcataaggaacacgaatatgaggcacatgattgatgaaagggacatttctcctgggtcttaaaactaattgactacctacgtaaacactagccttgatgagtttagtcagaaaactataacatatttttcaataggtgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactaatggactacctacgtaaacactagcctgtgatgagtttagtcagaaaactataacatatttttcaataggtgatcttccaatgaatagataaacttttgcatgccttcttaagatggtaaaattagttccctggtatatacactggactcaccttctgcattgcatcacctctctgagatttgcccaatttggggtccaaagtgcaaatgacctcagtcccctcccagaacaaaggactcaacaacttggcatccctctgaaacacagagtgaggagccagtgagtgaagccattgtgtgaagcaggtcctcaaagactaattcaatttgaagaaagaaaattaaaaacaggatagagtgttacatgaatgggatcaaccttaagatccttcttcataagccaaatctcactgtttttagtgtgttctccacattaattcatgtagcagtggcaacgtgcagtttgcagtctgagggaagagatgagggcggaccctggctgacatgttgccatagagatgacatttgagcttctttggagtggcgaatctgattagtcagttcagcgtttcccctcatttcacttcattacacaggaaaagaaactcctaaaaagactgtttcatgtgtatttgtatttgattaaaatataaatatttttcctgccaattcatggagggaaatggcaggacagtcaaaagctcagcagtatcatctcagctaagagcttacacaaaaatccgtttgccctgatgccacaatgaattgaaacatgaaaccaacaagtagaaacaaacagcatacttcatgctagagtagtcgtcactcaattatccttgcctccttctgtccaggcggtatgaagcctcggtgcaggattcaaagtctccagatatttgccttgatttgttggccagctttagttaatctttttattgaaaagaacaggagtgggaaaagaaaatgagggagttaaacgtaatctttgtttgcttagaaatgtgtttgttgatggccaagccaaattgaaggtatttttcagttcttgtgtgcttctttgaagaaaagaaagaaaaaaatgggtcccagtggaaatgggaaatgctttctcatagaaggagctttgccatctctgtgtttccgagggcatacaacagtctcaaggcacagaggaaagagtgaggacagagcttgcttctcccatgtctcccatctaatgcctttgtttggtggccctgattgaataacacgtattagtaaacagccagtagatggcactatatggtttactgccacatagagagcctactgggcttttttttttgtttggggtttttttgttttgttttttgttttgttttaaggcggtaggataaagagggtttagctcttattttcagcttactagcctaagagctatctgactatcaattctggctgttataaagtgccatcatgggttatttggatacattttctaaataggcagagcaggaaagaaaaaagtaaagtaatatgcctcttttaacaattgcatgtcatgatattgtgtagcatagtcttggtatcattttcaagtttttgtaaacgatagaaaattagacaaaaaaagtagattccacactttcatgtcccctcctacatgtgtgcacacccattcacacatcactgttggacagttctcagaagtttgttgtctccatatactttgttttgtggcaccccattactcatttgctcaaacagaaaaggaattcatggaggtttggagccgttgttatataaaaactggcaaatatggtggaatataccctaagaaactaacagaaggggaagaatatataaataaccctgccggaaatgtcctccaaagtttatgccctggatggagagttaacactgcccccaaggaccagtcctggccatttcaccactggggaaagtgttctttctctaaaagtgaggaggagagtgagggtcctttcagaactaatattcttgtattctgttgaatggtaactgagcccccattgttttatctgcccagagccataaagtcctttgtcctagaggtaaatgaggcatgcagagttggctccagaaatcatgtgactttggaaccagtgacacaagatgataagatagggactgattctatatcctcagcatcctactgcacattgaaagtgacacgcccttctgacacatcacctttgtttaatgagaacattatttcttgattgccaaaagacaaatttagctgttattcataattttttaaatgtctaagactggcattcttattttcttgttctttttttttatttagaaagggctatttacagttatatagcctttaaatctacattaatttattatgattataaaatcaagattttcctcaagcttttaagttcaacttaaaaaaaagtttcatttttctgcttatattaataataccagtatcttttatatataataaaaacaactcgtttcacagagggttttgattagagttaaatttgaactgaacaatttaaattcaaacaattgctctcatttataaacttaattagcaaaaattctttatacatgttagtgtacatttataaagtcaatatattcagttttctgtttaaccattcaagtatctgtctagctgggcaaacgtacaacccacacaagcaaattctttctagaaacgtaaacaacttttataaatctaataaatacattgatttattcaataaatatgtatacttaatttcattactatttaaacattaaatatttcaatttattaccattaaaactcttaaatatttagattttgccatttaaacttttaagtcttctagcttattaaatgttttaaatattcatacttattgagagaattgaaaggtcacttaaagagtccagtattatttaccaaacagtaaaatcctgttatatttttcaacttacaatcacaagcctaaaatcaatttcacatttaaaattgaaatcaaggccaggcgcagtggctcatgcctgtaatcccagcactttgggaggccgaggcgggtggatcacgaggtcacgagattgagaccgtcctggctaacatagtgaaaccccgtctctactaaaaatacaaaaaattagctgggcgtggtggcgggcacctttagtcccagctacttgagaggtgaggcaggagaatggcatgaacctgggaggcggagcttgcagtgagccaagaccacaccactgcactccagcctggtggagcaagactccatctcaaaaaagaaagaaagaaagaaagaaagaaatcaaaaggctaatacatttaatcatttgacaaatatttattgactgaatgaatatgcccattttctaatgagccaaaatctcttaaacattaaaaatgttttcaatcacatacccagtttgtccctatgattactaaatgtctttctaaatttaaaacaaaagagttagccctatgaaattcatttattgcctgcattgaatttccattacaggctgactgaggatgctaacatggagccttatgggttagatgcttagcctaaaatgtgggacatagaggctgctctcacccaggttgtgtgccctgagccccagaagacatcttcgttttagcgtcactgtgtcaacatgtgagtccaaatccaattatttacccaactatttttcttttttttttttttttgaggcagggtcttgctctgtcacccaggctggagtgcagtggcatgatcatggctcactgtagccttgacctgctgggctcaagcagtcctcccgcctcagcctcctgactcaggcacatgctaccacacccggctaagttttatactttttatggagacgaggtttcaccttgttgcccaggctggtctcaagttcctggcctcaaatgatcctccaacttctgcctcccaaaatgctgggattacaggttaaagccaccatgtccagccctacccagttctttaatctgatttgggttgaaataagtcagctttcttcttattgtgtttttggcaaaatattttaagaaattttgattcttctcatctgcctctaaatataatttgaagtcatcccattgtattctgaagaaatctcaagtccttgtttggtttggttctgtgtctgcatggaacattcccacatgaccacatcagccggatccttggatatgttgctcctatagggaggcttgtgctctccagttcaccatagaccaccacccccagccccaccctccaggccaggcttggcgattatcctgtgcattgtaggttgcaggatctgtagtagtcccctacatatcctctacccactaaatgatggtagcacaccctctccagttgtgacaaaaattttgctcctggtgagcttgagatgaccaactgtctgcccaagacagaggcagagccgatggggcctttgtggcacgattgttggtctttttcttatgtcccatcagtaccctcagggctgcaccctgcctgtctccccttgggtgtttgagtgtattctccctgctcagaccctaaggcaagaggttctgtttctgagatttgagcttcattttggttttggttctttctttctttctttctttctttctttctttctttctttctttctttctttctttctttctttcctttcctttcctttcctttctttctttctttctttttctttctttcttttctttctttctttctttttgtcttttagcatccatgatattagacagcatacttcctagatgaaagagttttgtgtcagcttttagctttttattaacaattgttacacaaattctgcttttaaaaacatccgtttattttcatatggtattgggaagtgagcttttaaaaacagtgatgtttctgcacatgcttattgttcaaaccaggactccagtttcacatgaattttttgactcactctttacattaacagtgataaactagaatttttaaaaagcccacattggcaacatttttggctataatggtttaaaaccaaaaataataaaaatatgagcagtaaaagaaaagagccttaaaaactgtgaatacagacaagctaaaagatgaaaggaaaccccatggcttgatcaatcgcatgctacatgataaatcatttcttctggaagacagaaggaacctgcattgtgcctcacaagaggaatatactgcaaagtctagctttatctctgaataccagcctttgaaattaagtacagattaaattacaccataaaatcaatgtcacactgtgagattgctgaaacccatcttggtaaatgaaacctttttaatgatgaaaacctggaaaaaattcatcttgagctagttcactctgcagaaggcttaatgctatcatggaggtcttcacaagccattctccaacatctgcacaccaaactgggctcacacatgaatacttctttagcatgtctgggcagctgggtgagtgtgaacctggagagtgtgcgttcctttccctaatatttttcttatgggctgagcatgttagttagccagtctccacaagagtgaaccacagtaattattgggtttgtgtgagagcctgttaacatgatgagggctaaataaaaatggtgtatgagtatgccttcattataagctttcagaagccaaggagaggttctacagaaaagtccgtgggaaaaatatatattaccattgatattcctgttgattactatttagaaagcaaaaagtgtattgtccaatatggtcaccaacaaaataggatggcatagcatgcaaataggtggaaataccattacatgggtgccacatagacccaatgttgacatatgtagaaataacagaatgaaagtcctacagagaacaattagacagaaattaaattaaaccagcctgccaggcagaatttgtgctaagaaattctgttctgtaaatgttgagaaacttcagaccatgaggatagatacaataaataaaatctaacctttgattatcatacacagagctttaaaaaaaattctaaggtttaaaagataaacccaagagatatttacatgaaatgtaaatattatattaggaacatatttgaactttagtgtggctaattttattttaatatcatcattatttttgtcttagagtttattgtttataccagctgtcggtgaattatagaaaacagccatgtaactagtcgtatgtagaaacctgaaactggatcccttccttacaccttatataaaaattagttcaagatggattaaagacttaaatgtaagacgtaaaaccataaaaaccctagaagaaaacctaggcattaccattcaggacataggcatgggcaaggacttcatgtctacaacaccaaaagcaatggcaacaaaagccaaaattgacaaatgggatcttattaaactaaagagcttctgcacagcaaaagaaactaccatcagagtgaacaggcaacctacagaatgggagaaaatgtttacaatctacccatctgacgaagggctaatatccagaatctacaatgaactcaaacaagtttacaagaaaaaaacaaacaaccccatcaacaagtgggtgaaggatatgaacagacacttctcaaaagaagacatttatgcagccaaaagacacatgaaaaaatgctcatcatcactggctatcagagaaacgcaaatcaaaaccacaatgagataccatctcacaccagttagaatggcgatcattcaaaagtcaggaaacaacaggtgctggagaggatgtggagaaataggaacacttttacactgttggtgggactgtcaactagttcaaccattgtggaagacagtgtggcgattcctcaaggacctaggactagagataccatttgacccagccatcccatcactgggtatatacccaaaggattataaatcatgctgctataaagacacatgcacacatatgtttattgcggcactattcacaatagcaaagacttggaaccaacccaaatgttcatcaatgatagactggattaagaaaatgtggcacatatacaccgtggaatactacgcagccataagaaaggatgagttcatgtcctttgtagggacatggatgaagctggagaccatcattctgagcaaactatcacaaggacagaaaaccaaacactgcatgttctcactcataggtgggaatcgaacaatgagaacacttggacacagggtggggaacatcacacaccggggcctgttgtggggtggggggaaggggggagggatagcattgggagatatacctaatgttagatgacgggttgatgggtgcagcacactaacatggcacatgtatacatatgtaacaaacctgcacgttgtgcacatgtaccctagaacttaaagtataataaaaataaataaataaataaaaagggcaaaaaaaaaaaaaccagccatgtaaatttctatacatattgtctatggttgcttgcatgttacaatggaagagttgcatatttgggatagagaccatgtggcccacaaagcggaaaatacgtactatctgaccgttttcagaaaaagtttgcccactcttggcaaaatcatttgacaagcctatctaaactaagatcacttctgtggctacaacataaaggaaagtaaacgtcttgctgttgtcattgcttcctacacagtggatcatgggtttaaattaggaagcatctcacttatatctgatacttatttgtgggattttatggaggataggggagggaagagaacatatttaaggaatacgtttagtgatctgctctgcttgattttccttcaaaagaactttgtgtttagaggccaggcacagtggctcacacctgtaatcctagcactttgggaggccaaggcgggcggatcgcttgagctcaggagtttgagaccagcctgggcaacatggcaaaaccttgtctctacaaaaaatacaaaaaattagccaggtgtagtggcatgtgcctgtggtcccaactacttggggggctgaggtgggaggatcacttgagcccaggaggttgaggctgcagtgagccgatattggaaaaaaaaaaaacacacaacaacaacaacaaactttgtgtttgtgtttggaaatgtgtccataagatggaaatgtgtccataagatgaaacttgtgtccagagcagtataaatagctcagtgggtctttccatttttggtaaatcatccttttggaccctgggcaaaaagaatggtagactttatacttgaatttttcagaaggcaaggaaaagcgaagagttatataagtaaaaccggaagaaaatgagcaaaacattaaaagaaataaaagaaaaaggaatacaaataatgacccaagtattaatagactttctctcacagattgtactgaataaaaataatagctaacatttatttgttgttctgccatatgctgggtagatcacatactttatccatggattcctacccttcaaggtaaatattgtaattattgttttacagatgtgcaaacatcgaagttctgaaagataagggaattttccctctctataaatatagagtcatctggctctgtagttaaagccaatctatttctattatgattctcctaagattatactgagtaatattaacgtatcattatatcaaatttaaaactaagctaatgaaatgaaccactaccaatcaatgctgtaaaccaaacccacctgatggcgacttaatgctgtatcagttacctaattccccataacaaactaccttcatacatagtggcttagaaaaactatcacttatgtctcccaagtctaccaatcaactgggtgttggctaacctgggcttggcatggggagagctttactctaagtccttgtcatcctcctctttgtatggacaggctagcccaggcatgtccttcttatggcaatagcaaatttgaaagagaacaagtgaaaacacataagacctcttgaagccttggtttaggataggtacactgtcacttctgcttcattccatgggccaaaacaagtcatgtgaccaagacaaggagcaaagaagtacaccctgcccacagtgtactgtggcaaagggctgagatacagggagaggtgaaggattggggccaatcttccagcactccagtgtacttggtcagagaacaaaactttattggtacccagttgaatactgcatcattgattaaatttaaaaaggcataaacatttgaggaaagcagcatattcttcacctatagaaaattcgttagtgcacagatgtgtgtgtatgtgtgtgtgtgtgtgtgtgtaaaatgaaggagctgaacatgggatctacatagttagactctcttaacaatttacttaaatgtattattagccttacattttggtaaaaggaatcatctccttgctgtctgttgttctgagtgagagataatggttgatatcagctgtgtgataagataataacttcctgctgttctaaggcactcatacagtcattaatagaaaataaagtaatagcatagaaaataacatgatagcaaagcttagacaattcatttcaaggcgggaggtatggattggtttaaatattctatagattctacccagctggaagagcaagcaagataattacggacttgtcacagtgattaacagacactatggcaatgatggggtttttccgttttgtttttgtctttgttttgttttgtttttagaggcagggttttgctgtgtcgttcaggctagagtgcagtgacatggtgtaatcatagctcactgcagcatggaactcctaggctcaagcaatcctcctgcctcagcctcctgagtaactggaactacaggcaggcaccataacatccagctaattttttatttttggtagagatggggtttccttatgttgcccaggctggtctcaaactcctggcctccaacttctgcctcccaaagtgctaggattacaggcaagagccactgcaccccgaccttgttttgttttttgaagacaaagacaactccatattaatacttcccctcgcaagttatacctatgcaaaagcatgtttatgagatgtttgtggggacagtataaaaaggaaatgtaaaattttcattttctttgctatctgagacatatccaagaaaataaaaggcattttacagttttggcataaagaatgtaagtgatattacattcttatatctttagagagagggggattcaattaagcaaaccagcagaagaatgaaaagagaaacgtgagcagtatatgcagtaaccattgcagaattggcacaattgtagatttataaaaggcagtgtgctctcttacttccccccgagtgcaagccttcacctgcccttgactgactatccaggacattgtcaggcactgagcattgatctatcacaggtgtaatttgtgatcgacttgatgcaatgtgtttaactccaaaatcagattggttggaaaaaatgcttctcagaacggtatgaggatttcatcaacaaagtttatgtgtacctggaagagaggcttgtgcaaagctagcagcgactatgcgagagagtccgctaggagaagatcagtgtcctcaggagtcagcggacaactccaacccagattcccatttggcctcttcttgcctaatgtatcaagcaactgaattcactcgcttagaaaattttttgtatctgtttgtaaattgtgctttacaaaccacacaggcatttcttatgctagagaacttgagtgctgaattgtccctgaaaagaggagttgagaatgggaacttgtgcaaatgaaatgggtgcagattcctgtatggggcaggcaacacagtgatgtaaatgacagaggtggctaagaaacaaatggggttgggggagtggcggagggtggggtcagaggaagaccagggaggcagtgaagaaacatcagggcactccctccccgtcccctagggagagagaagtcacaggcgctccaggtgagcagaggaagaagcatcctgctgaaagtggcatcacaaaggggaaggaaggaagattatctcacccgtcactggcatagatcaccagaagcgtttctcatctcacttcactttgggaaccagatttgtgcgcctatgtgatcctctttccaactccttcccactgcaagagaaagttctgaaaataattagaaccacttggcccactaccaagaggccccacatcaaagttgtgcctcagccctgcgtcgccagcatttcctcggtctccttcaaatgtgaaactgttatgcaaaattgagtaacagcactcgcttaggactaaatgtcttcaaagtctcattctatggcaatatcttatcacaaatctccaaagtgaaattactagcaagattgcatgagttcagctataccttcagtgcgtaataatagcatacatgcgtgttgtcaatgtccattgaaaaaggagtattttctatttgggacctcctgataaaggaattagtgttttacaggataaaagactcaaaataggaaagtttacactgtgggaacataatcatttgcctgccggtgaaaaagcaataaactgtgttcagattttaaattgtttgcttcatttgcttgttaaattgatataatttctaatttgtattctttaaatttttgcagcttttcttgaagcttacaaacaagacataaaatcccttttagttaaatttggaggagagcaacacagaaaaagtactatttaaaggccgggcgcggtggctcaagcctgtaatcccagcactttgggaggctgaggtgggcggatcatgaggtcaggagatcgagaccatctctctactggtgaaaccccgtctctactaaaaatacaaaaaaattagctgggcgtggtggcgggcaactgtagtcccagctactggggaggctgaggcaggagaatggcatgaacctgggaggcggagcttgcagtgagccaagatcacgccactgcactccagcctgggcgacagagcgagactccgtctcaaaaaaaaaaaaaaaaaaaaaaaaaggaaagaaaagaaagaaaaagtactgtttaaagactggtttcaagaaaacatggagtcatttggagacctgaaaaaactctttgtcagtggcctacagattcagatgagggtaataaggagaacaaataaacctatttagaacaaggacactttctatctgtcttgatagacaaactagttttaatgcaaaatataaagtgaattatgaggccaggtgcagtagctcacacctgaaatcccagtactttgggaggctgagacgggcagattgcttgagctcaggagttccagacgagcctgggcaacatggcaaaaccccatctctacaaaaaatacaaaacaaaaaaaaaaaaaagcagggcatgctggcatatgcctgtagtcccagctgcttgggaggctgaggtggaaggataacttgagcctgggaagtggaggctgcaaagcggagatcatgccactgcactccagcctgggtgacagagtaagaccctgtctcaaaaataaataaataaataaataaataaagtgacttatgagaccaattgatgtacattaatatggtttaaaaccattattaggattaataaaattttgagttgtcttcaaatctgtatttaaattattaattttttctggtacatattgagttagtaaaaatagaaacccccctttataaataactacgttgttcagaatagcacatgtaagcagaacatttatttctttatttcgatagagttccatttcctgttgaaaagtaaaacccaagaaaaagaacatccagcttaaactatgtaatactttaaaaagtaagagttcagatgtaaagtttcaataatgaaaaagttcttttctaatgagatagtttcagaaatacttaatttaatccaaaaaaaatgacttttaaaaattctccacacttcttggaactgcatgcataaacctcagcaattgcagcaagtattcattttagttttcattgatgaaacaacttttcaaaagatgttccatcccattgatcttgcacatggagatcatttaaaccccgctttggaaaattttcctaatgatgcttgtcaatattttcctgatggcaatgctagaaatttcacattttgccaccactttcatctgcaggtgacagatgcacacatccattatgtggtccaataaaagagaatcattttcatctgtcaactcggtaatccaatttcagcaaacctaagctgtgctagtgcagtgtgttggatccaagtgtgatccttgcactagcagcagcacaacctggacacttgttagaaatgcagattctcaggccccacccagatttactgagtcaggaattctgacggggtcaaacccaacaatctgttttggcaagccctccagctgaggctgatgcccaagttcaaggaccaccatgctaagatgtctgggtgcatgcagggagcaatgaaaatgctatggagactgagacctggtgctcctggtattcatgtcatagaggtgattttaatttgggaggttttcaaacatggtgagagcaccttcaatttcttaggacaacagagaggtaacatggcaatgcaacttgggtccaatgcccgggaaagtgctggcagcctttgcaagtgaattctgcacacttgtcatttttagcttatctggaaatctatatatgccacctgagctttcagcccacaacataaaggcctgactttatatctgatgaatccctcttctctgcaaaacctgtatgttttcttccaggagagtacattgccacaagtgtatgctgcattgtttttcatgttctttctctgtgtgtttgagtgtgtgtctatctcccccttctgatgcatacataagtgactggacacgtagccttgacccgagcttgtgtgtgtgacttcacatggtaggaatgtctgtgaagtgagggagttggactggagactcccaaaggtcctccctgcttggaaatgctacaagtccacatgccctacacgattgtacttgtctttctttgttcactgtaatttagcatattaattagataaaatcaattcaaatactccattcgaaatgctctcagaattaaaagctccttatgaaattgcctactttgctcctaacatgcaatgtctttatttctaatttcattgctcgcttgtgtatgattacattacacttatcaaatagagaaacttatttgaaaacacttgcataaataagtagcatgggatttttttctccttccaaaggagcttaatttatatggactatagaaatgccctgtcataagtggccgtatgctatatgctcttaattttgcatgtccatatgaagctgtatgtgtgcatatacagagaaatgtgattatgtcctggatatcttgttcatttcatttcttaaggtggtgtcatgtcaccaagaaaattagtgatagattcacatcacagagtagaattctattcattagatattttttgcaaagtgcagcttcttttcttgcttcctcataagttgtgagcatgtgggcgggcaagcacaggaaagcatttagcaacagaaaacagaagcaaactgtctcctttccaccagtttccccacctcaattttgttctcatatttctttacttcagtgggccatctctgacattctaaactttctggaactctttctcagttccccgggctgttcttcatatgcctctgtttctctgaaggctataaagagatgtgctcacaacaggctcccaggagtccatggggaaattgttgacattctttcccgctgaactaggttggctcgctccacatttcttagttcatttggaattccacagctgccacctgagcttttatgctgtcgataacgacccctggcttggggggtggtgagattctgttttagtcatgctgtagtctgccttttaccaaatgtctttgccatgaagtagggggtaaatctgttctttttcttatgcttctcgaggaatgacagataactccctttgctacatgaaagcatcatctgacatttaatttgtttggtttttacaattcatttttccattctcattgccaggttagttactatctcccatcagcaactcttgaacaacaacaaaaaaaaaatctatatacgggaaaatgaaaatgtttcaatattcttcagtttttctacttttgttactgttctagagagggaggtagatttttgttttctgcaatcttctccgtgaatcacttttacttctctatgtcttaacaggggacatatttgaatttggactttgcttatttttccaaagcatctctgtttaaatcatcaatctacaaacaaacttcaaccacagtccaacttataactagctaaataggatttacactaacgttttcttgcttatccccttatatcaatgtcactgtaggattactttttcaaacttttcctgcaagttctctggagttggactgttggtatgagcaacagcctggtaaaaatcacatatcttagaatcaaacttatacgaaaacatattttaagggtaatataaaacccaacattttcatatgtttagtgacaactttgaatttagctacctagcaaaacaataaaaataagaattatgtttaatatattttgcaactaaataattactgtttttcaataacgagacttttcacttgaggtaatgtgaactttccaagggaaatgttccctagaccctagactgatcatggagattgcagggccatagaaaatggccctctggtcccacacacccggctaatcgcatcaccatcatacagtgcacctcgctcactcgggaaatgaaaacaagataaagcaggagggaaggcttaattgatctcagtctctctctgtttgggaagtgtttattttaaaagataaaatttcatttcagggggtcttacgagataaaattcaaatagaaaaattgtcttcattgcttcaacagttatgttaaggttatttacaacagcatttttttcccataaaatatagcagagtacatttttcagtgagaaaagctaacatttgaacccacaacgtctgaaggtattctgtacgttttatctctggtggcagctgatgtaccagcaggctgacagatgacaaaaaaaacaaaaaacaaaaaacaaaaaaaaactctcttgtctattcttttctaataagacaattcagtggaaataagagaactcacctgatccaaaaatgtcttcagttcaacaatatctctcttcaggaattcagcactcaggcaaatattttatttgccctcataacaaaacaaaaacaaaaaccaaaccaaccactctgttcttctgaacttttgccaacttaaatatctctttcaaaccttctctatctgcttattcacattaagctagaactacaccatttgtacagcttttcaggagatttgtgacaggtctgaaaaggatttgaattttttacttggacttttgacaactcccactacagaagttattgtccaggttatgtggcttagtagcctaaaacttcaaagggcttcgcttagtcaaaattacttaaataccctattttattatttttataattgtagcttttaaaaaagattaataccaattttcaacatgcttttagcatccagtttgccacctaccaatacatgcatcactattttctagatgtggatattttggggacacgatataaaaatattttacaacttttttgaattttccccaaagttcattttcaaactccaggcagagagaaatgtttccgaattagtcatttttaaaatttttttgagcaagcctatcttttcccaacattgcattgctttttatcctgtgagattttaaacacctttcatttaaatgtttttttttttgaagtgtgcactggatgtgtctaatgaacagtccttgaaaacagaatcaccttatttataaattcaattctctttccattcatatgaggaactttatccttcctcagggcatatatttaataactattaatgaaatctgaaattatatatgagcactgagacctgaatttgctactcattttttttttccagtggaaatttcataagggttttggcatgggaacacagcaggcatttaaggcagatggaataatatggttggccacaatggctccgaaggaatcataacagtttataatcaataatttgcttactagggaagacagtcttttcagccaaatcagcacatagcatactgttcatcctcccagttagacagccgactactgccaccgttctgcaagcctttgattcccatggatttacatgtgcaagctgggggctcagtgctcatttgttttgtcttttaagatttcagtttccaccctccccttttcacatgtcttattccaacttccccttaaaactgcagaagccatttgagcaaacagggccacagggaccagattcagcaggcaccctgccttcagaaagaggcaggacttcccgaggaggagggtccatctcaactggttttaggccagagactagacggaaggggatttgcacgacaggtaggggaagggcctttagaatttcagatgtgttgtaactgggcaagttaatttcagatgtgttataacttgaaattagaaaagtcatttcaagaatttttttaagagaaaaccatagtagggtcaagactctgagagatgaggtaagcaagagaggtagaaaaacctgtcctcacctaataggctacactacagagcaacgtcacccttgagtaccagtttccatgcaggggatggagaaatctggaaaataaggaggccaagaaagaaggtatctaggcagttggcttccatgggctcttgcaggattctaggcaaataggctatttggggctatctaccagattgacaatgctttatctaccagaaagatggccctgtattttctcatttaatcctctcaacagttctgtgacacaggtattatgattatcccattttttaggtaccaatgtgaggcacaggaactctgggtaacctgcctaaggtgtcatagcttttaagaattgagtaggattcgaagtaggtagactgacacaagaattcgcatgcttgccccctgcactatacttcttaccttggcttctttggagtaaagaaaactatttccaaactctgctggtatgtgaagcaagtttccttacaagagaagctccctggcttcctatgacttgaggagaggagtggacactgtggagaggtgagcatgttagtctgtttgcattgctctaaaggaatacctgagactaggtaatttatagggaaaataaatgtatttaggctcacagttctgcaggctgtacaggaagcatggtgccagcatctgcttccagtgagggcctgaggaagcttacagtcatggtggaagaggaagggagagcagccatgtcacatggcaagagagggagcaagagagagaagggggaggtcccagactgttttaaacaaccagatctcatgtgaactaactgagcaaggagtcacttatcaccaaggggatagtgctaagccattcttgagtgatccacccgcatgatccacctcctactgggttcctccaatattgggggtcacatttcggcatgagatttggaggggacaatatctaaaccatatcagtgggtgtttcttctgaaaccttaagaggggccaaagagggcaaatgctgacagttgaccaaaaatggggcttgaaatttcctttttatttcagacaatgaagacccttttgtggtttggttgattggtgttgttattgttgttgacaaggtctcctcctctgtcacccaggctgtagtgcagtggcatgatcttagctcactgaaggctcaacctcttgggctcaagcgatcctcccatgtcagcctcctgagtagctgggaccacaggcatgcccagctaatttttgtattttttcatacagacagggttttgtcatgttgcccaggctggtcttgaactcctgtgtgcaagtgacctgcccacctcgacctcccaaagtgttaggattacaggcatgagccaccatgcctggccaagacccttgttttaagaaatgtctaagtgaaacagtgtacactacattgatattttttataattttcttttttctttctttcttttttttttgagatggagtcttgttctgtcacccaggctggagtgcagtggtgcaatctcggctcactgcaatctccgcctcctgggttcaattgattctcccacctcagcctcccgagtagctggaattactggggtgcgccaacacgcccagctagtttttgtatttttggtagagacggggttttgccatgttggccaagctggtttcgaactcctgaccccaagtgatccgcctgtctcagcctcccaaagtgctgggattataggaatgagccaccagaaccggccagatatttttataattttctgataagatcacaacaacagaatcaagcactattgtgatactgaggacacaaccctctgcccaccccacattctaaatcgttttattttcccctcaacgtgttcacaaatatgcttctaaataaagactcacacctcatcagctgtcttggattactctagtcagggcaacaccaaatgtaggtctataacttcagattttcgtgggtagcaagtctgaaaatggccgtagacttgagaatgttactagattactcagcaaccacatcctgatattgatggccgggaatttattttattttattttatttttattttttattttttatttttcgagacagagtctcactccatcacccaggctggagtgcagtggcgtgatctcagctcactgcaacctcctcctcccaggttccagcaattctcgtgcctcagcctcccaagtagctgggattacaggcacgtcccaccatgcccagctaatttttgtatttttagtagagacgggtttcaccatgttggccaggctggtctcaaactcctgacctcaagtgatctgcctgcctcagcctccgagagggctggggttacaggcatgagccaccatgcctgggatggccaggaattcataatggtggcttagaacaagcagcagttccttccacgactcatctccttctgatttttatatatcaaggtcttttttttctaagctcacattagagattagagtatgaaaacttctgtgaccactcaggaggctgaagagtagctagttgaatctgtagaagattcaaataccagccagttacaggaaaatcacccaggtgcttgctaaaaaatggaggttcttgggcccctcctcagatcagtgaaatatgaatctccggggtgtgatcttgaaatgtatagttgtaagcaatgaatcagatggtcaaactgctttgggaaccagtgggtagaatattgctccagaagagtctttggcaaaatagcttgtttatctttgatatagtttggatatgtgtccccgcccaaatctcatgttggattgtaatccccagtattggaggtggggactggttggaggcaactggatcatgagggtggacttctcatgaatggtttagcaccatctctttggtgctgtccttgtgatagtgacttctctcaagagctgactgtttaaaagtgtgtggcatctccctgcctctccctctttctcactttctcactctcactcctgctttagccaagtgacgtgcttcttcccctttgctttccgtatgactgtaagcttcctgaagccactcaagaggctgaacagacatcggcaccatgctttctgtacagcctgtaggaccatgagccaatcaaacctcttgtctttataggttacccagcctcaggtatttctttatagcaatgcaaaagcagcctaatacaatcttcaatcatctcttgtgtcatcttggcctggccatctgtgttcctaacagtgctgcccctctttcttcaaggtgagtactaaatttcgtgtgcacataaaccatcctggtaaaaggcatgctctgactcagcagggtggggtttgaggttctgtgtttctaccaagctcccaggagatgctgacgctgttggtccatgggctatattttgagcagcaacgtgctggtcttctcctcaggctcattcctttctagtgatgacatctctgcttggcccatttgtgccttactcttccatgtagtgtctgcagtttatgagtgtcttggaaacaaaactcttttaggtcttgtcaaatatcagggaagaacctccttgatggaaatttcagacaatgttggaagagaggatagggagatagtgggctattaacaaaggcatttctggcaattaagatatacaaagcactccacactatgcagtgcagctatgcacaaggatgaccttagaaccttccagaaataatataccctgaagaaatgagaaatatacatcattccagagctggctgcagagaagcagtagaaagaagggatccttaaaatagcagtaccaaagactatcttgccttatgacagcatttgtgtgtgtccccccatccatgatactaacatgctttcctaggtttccctggcacagatttaattaatggggtttaaagtactagaggtcagacccctgtttagcttacaacccattatctactgcacacagtagattaagttattcttctttgggatgacatcgcatacatgctacacaatcaccaatgcgtatattgataaccttgaaattagttttacatctccctgaaccctattttgtcttccattcaatcactttatcataatgattatagttcctcctagcttttggggtcggattaattcataacaataaatttctcaggtgatgactacccaacattacagttaattcatataacttaagagaaaagtttacctcaatgcaaagacatcaacaacctataaatatgcagttatctatagctcagaccttttcctgagttggttggaattgtatataaatctttaatgtgagcaatgtagacttgaactatctcgacttgtttcatttcagactccacaaagtatacctaataaatcaaaggtgagttttcacatttaattgttctctatcctgtggaagagtgctgggaattgaacctagccctgctgctgctgactctgtgtctgagcatcatgacagcctgctagatgggctggggcctgagaacagtagggttgcttcgagggaggccccagggacaataaacaggagaaaggccagctgggtgggagaagctggagccagttgtcaacaaaaatatattagtcccaggacagaaagactatataagctcctaatgatttgggctgctagcatctcatgaaccattatcatctccagctcactaaatggatcccagaagattgaaaattgacatgcctagaaaaaaaaaagaaagaaagaaagaaaaagaagtccctcttatttcccctgtatgatcagacctagtgtttgtagcttatggttttgaaggagcatagatataatgtgaggaatttttagaaggcatgtgtaatcttaaatgcataagcatgtcttttcataaaagaattttcacaaatttggggttggaaagaaggaacacgtaatgagtggattctaaatacacacaacagggaagttaatgagataggaagacttccattcagaaatgagttcaaggcataggagaaaatttttaaaaacacacaacacaaattgtcatttattaggtaaatggaaagttatgtctgcagtaaattaataggctacgacaaagatgaatttgagatcacaaaaagacctaagaaagttttcatgactgtctcaaatagtcaaaccaaatagacttctaaaaaattaaaacatgtgaaataatattcaaaattgatttcaaaaatcaccaatcattgattaagtttattactcatatcccttcccctgattaagaaaatgtgtgtatcacttaaatgagcacatgaggctgtaactttggaagggttgctctcccttgaaattcacaaatatttgaattgaaaatgagctgtgaatgtttttgaatcctctgactcatagatttctatagaactcattttccagctgccacggcatgagctctcactgtcatgctaatcctcatcagttctgtcctcaactattatgatggcctcagactgctcttccttcgtctagtctctcccccatcacatccagtcttcaacctgtcttcatgctgaccccactaacacataaattgaacaccaaactcccaagttccaaagccttcaatggctcccctccctctgcgtagctgggtatcaacagcgttggctgtgcaaccacgactctctcccaagccatttcttctttccatcacctctcaccttctccatagcaactcacgctattttcatttagtaaattttgtcttgtctgtggagtgatggaaaacttgtgactacctttgtaggtatcggaattctcattagagaagtatttttaataagctacttattaaagtagcttttaagctactttataatagtaatatacataatatatattataatcgtaatatatataataataataatacttacttattaaagtaaagtggactgtgagatccaaaatgcctgttcaaacaacaaaaatccatttctaaaccactgggcataagacaagtggaggaacaggttttgcccctagatggacagaagataattcttctctgcctcatacagaaaagaagaatttggattcccaaaggagtctataatgggaaaccagagtgtgtggctaggaaaatggtggaaggctgcaatttgacagaccaaaatcttcagaaaagactcctaaactcaggaatgtgagttaaggtatgtgaatgattttattgggatagaaattgaaggtgcagaatttcaggcaaaaatcaaaaaggcaatggtcgaatgtgcatgttccagagagctgaacaaccttggaaatagaaacccactggaatttcccagaaatcttggttttggatttgcacaagcctaaaaattggtagtgggtgtggccataaggtatcaagtcaattgtattgagatctcgaggagtacaacagcccttagctatgtctgttccagaagaaggttaaggctgctacgtcaatacatcttgtgttttagtcacaatccacattgtctctctggctcttcccaagcatactctgcactttcccaccaccttgactccttgagcataattatctctgctcaggaatgccgcctcttctctacccagtgaacagtcaaaacccgtatcaaatattagctctttcgtgtctccttccctggcctcctcccagacttaagtcatcgtttcttcttctgggatttcattgctctcttagttctcgtctctgggtctgtttcggtgaacagactctgaacatcacaagaaccgtggttgtaacacaacccagtgtaacacacagaagatgctcaatatgttaattgatgggctaaatctttgattcaacccccttctttacatgtgtagaaatgaccccagtcacaacaccaattcttctctgcccctctaggaaaataataacaattcttcatacattctcaatgtctctacagttcacacatgtcaaaagatgtgatcttcccaaaagtgctgtaaacacacatggaaaactccatttttaccacttcttaaagggttgctacaaacataacgctctgcctttaacttacaagtggcagaagcagggccagaacctcatctttgtaatgcttctgttgagcgcttctctttttactgtttgcatttaatttggtgaaaacttggaattctttacagctaagaatgaggccatttggaggctggaacatctaggcaattgaagcaacttacttctgtgagtcagatggtaggatagggtgatgtctgcttgtcagcaatgccactcggctgcagatcaccactccgcagtcacactgtgccccctttcctgcatcctgggcatgccactttctgtggggctcagttaacaaatgaggtggggagaagcagctcttccaagaattttttcatccaagcatgagagaggaagaatgattcttccccactcaatagtaataatttaaacatttattaaatcttctgtaccaggcactgtactgcatttacatgcattttctcatctaaacatcctctagatctttgcgaggtgagaaccaggatggtcctggagaactcaggaactggagtcaggtattcaaatgaccttaagagtttcattcttccatttttgcatgtctttacttgtcactgtcattctcttcctctgtagtccagctttatccactgataggaaatgtggttaacagtagctctagcagcttcatcactgggaaaaaagtgtttcccctggtcatacttgaacttttatttcaatctagtttttaaatcccaatggcaggattctgatcagcctggtctgagtcattgtcatccattggaccaattactgtagctgaagtggagtgggttttggtgggagtgtttggattctcactggcagacccctctggaaacatatgttggctagggatttccctaaaattaagagaggggagtctgttgctagtagacagggagaggtggcgtcgggctgaaaataagcatgcatgtaggttacattattctgcccctattaaacacaatgaggactccaaggcttaaggagtgtatgtaactcacccaaggtcaccaactagaaagattaggacttgcacccagaccccagagactgcattatggacttctgggctgtgctgatcatgtcagtggcataatatgtctatattatagctatttgggggctagttagctcacttggtcagagctaagctccctttctccttttgttgaggctcattaagtcaagaacagggtgataaattaattcacaggacccaggtctttcaaagaagagctgtcagctaccaggtgagcaagtagcagcatgtgaatcattcctaatcccagccaccttcattactagtagaaaataacacaaagcatgccttttccctcagggcacctgtagcaccatctcagtgtgcaaagggcctcaggctttcatttccctttccaggtcttcttacattttccctaacaagactgccttccttttcattttacccacagcagtggcccctgctgggccaggaggcagagctatcatggccgatgttatcacagctcacaccccctctggccattattaaggggcagcctgtgttcagttgcatgtttcttagcaaccaccatgagccatgtcctctcctttcatttgcgtcttccttctctaacctagggggcaaatttactaagaaatgaacccctgccttctcagatttctaagccatggaaaccagaaaattgacaatgattgcattttcagtctcaaaatgatgaccaatttcaagggttggtggggtgcagggcgggggtggagcagaatccttttcttacatactggcaatagctttgcaaagcatgtgtgatttatcgcatgtgtaaactcatctgtaaggaaattgatttaaactgagattcttcataagatcaaacatctctactgcgttgtagcttgctgaaaggctagacatgcatttaagcctaaacatttaaaaacatgaagactgctttcttacaaatttctgtaacagcattcccctagcctatttgctttcatatggtatgcactcagtacagctctgttttagaggaagcttcccaagacagatgcttaattcttataagcagccaattgcttgttcccattccatgtacatgtgaataaataactccacactccctgccctaaacacagttgttaagatcctggaacatggaacaaaggctagaattctttatcccatgaagcgtagactcttggctttaatttgtattaatctggtttggtttgtttgcttttgttttgcatttttaatgccgccgtttcgtatttatctttggccaatgtgttttcccccatcgccaccacattgccataattcaatcttgttttgtttatggctatagccattgaggttgttcatacctatacacatttgggaagctgcaaaatagtttatcacatggtgttcccaacgcagatcataaaaacaaccacccagcccaagaatcagccgctgtaacgcatcatgttccttctaagccacagcggtattcttctgtctagacgcagtctgttctctagaacagatgactgtaatcgaatatgtcagtttgcagggaagacttgcttctaatgagcttttaatttcaagtaacaaaatttagcaaaatgcaaagatagcatattgtttaaaggaagacttttgaaatggatgtttttgacttggctctaataagctgttgtgcaaccgttcccctgaatgtagtctgaaagaaccagaaaagtcgagtctatctcattggtttgaatgcccccagtaggcttatctgtagaccaaatattcaaacacacttggttttagttcatttgataggttgaagttaatgcattagtcatggagactgccaaaatcaaccaattgctccaatgactggatatttgaaatgcaacagggccacttatgttaagatgttatgtagtctgtctcatagacttgtgaagaaaataagtctaatttttctactgagaataatttgtaagtatttgaagaaatcaaaaagttgaggataaagtatcttgccctctggatgtttaaaccacaagcaatttctcttttaccatttaaagtgtttttaagatactaacaaagaaaaaccataataagatattgcagagaattgtctttctttgctgtttgagaaaagcagatttaacttggttggttgttagaagggctaaactctaccttctgaagtaagcacatagtacccttggtgcaaatatgtagaaaagggattttttttcaatgtagtttgttttcattaagacccttttattgatcctatcttcctcaaactccctttcctccatattcccactttctggccacaatcctgaatgccatgtgaaatcattactttagcattaatctttgatctttattaaaatgcaattctggaaatggggaggtaaaatatgatcatctcatgtcagtttttataactgtaggtgctggagtttcagactcctatctgagattgggaattaatgaatacagaaggcataaggaatatgagggcattgagccaaagggagaggtggggcgagggaggggctgtggtagcaacatgaacagaaaaggagaaaaaggacctgagttggaaaattgaggtctccatatcaaattactcttatttcaaaatgtttcctaggtttgcttattcctactgatttttattaccaagagctttatagaaacataatatacttttttattactttaagtacagctagttttagccacttatacctccagacatgccactcaactgtgaccttgagtatcatttattcataaagtaattttcttagaatgacgaagcatctacatttcctaaattacatatcactagttatttttcttgagacatcactttatatgactcattttacaagtttacaagttgcttctttactagaatgtttccccgtccccaacagtggaattagtcttctacttggtttaattttatggtgttcctgctgcaagctcagcaaattatgaacagttgtctcctttccccagtggacaggcatgggacaattgcctttctcctctaggttcttaataagtggaaaaaaaaaagattgttttcaaggactgaaatcttctttcttttaacctaagaaggaaagaatgtatttaaaaaaaaaaaaagaggggaatgaaaagaaagcatgccctcgtcctgtgttgttatcacttacttaattcagggttcagccgagagcccaaggctactgtcttgatctgcacttcctgtctgcacacagatccctggtgtataagcctctcacgatcctaaaacatttccagaatttctccttgctctgaccctcttagtgttgaaagtggtagtcttaatttatttccaaagtctatcttttctctccaaattaaataacagtgtcatgaaatgcttcatcttctaatgtcctatcagcaaaatcctagctttaatagtccaaggttatctcctgggctttagaaatgtaaaggcattacacaaaattgatgttgacaaagcacagatactcctttgcacgatcacaatgaaacttttctcttttttgcacatttcctgcaagccaagctacatcagttgctaatatgcttggttccacatgtcacacttgatttctgatccttttacccacttctcaaaaatggttaggaaatatttatatggatttctttggctagactttaagataaattactttttggtgaagttcttaatccttttttttttcaaagtgcctgatctcttagagcaagcttacaaacaaaagcccacaagcaacatcctagactaatgtgcaagttaacactgaagaagagttagaatccacgccttgatacaataataataataagtgcaggtggggaaatgtctataataagaactttatatatatgaatatattcaatcctaacaacagccttgaagaaaatattattattaaacccgttttacagttcaaaaaaactaaggctgagaaaggaaagaaactggtccaaagtcatactgcaagtaaatgatggagcagggatttcatgccacaactcagtaattaatcactgtgttgcaattctttctccttttcattaggctctgtaacttgtctggggacaaattaaggttgtaaagttcagtttactttccgtcagtcatatggcatcaccaagccacctctggtggagtgagaaaagcatggtacttcaacatcggaacccctgatactggtccctggctggatcttcacttcttgagttcctgtttccttatctgaaaaatgttattaatattcctacctcatagcaatgttgggaaaattccacgtggacgtgtagccaaccccaagtcatatgtagagtctgaaataccacataaatgtaaagtaacatctgttcatgtattggattttcttcatttatctttccccagatgctgtattgcatcccagttcgcaaaaaagaaaaagaaaaaaaaatgtgatggtgctatggttctagaatatctttaacttatgtgccaagggaacagaagatttattttcacatatataagcagttgtataaacattttctagatcaatatatcttcttgggttgcagtttggagccctgtctgacaggaggtcaatgcctacgcttggggcattgaaagtattcaaaacagatgcagcccattctccaaggcctagcctctggctaattcttttctgagttctaaaatgttgtggctacatgctcacaaaagagagtctacattttggagaagggggacagcacacattacacttcaccttaaacaatgccccattcaattcgaattggttttctgtttctccatggtgtcaggacactcttttcccagttatttttaaaatcttcatcactttacattttcactcttccattgatacatttccataattttatcctattgtaacctccacattccacccaacccattggcacttcaccaagagatgattgaatcattccaaagcccagatagttccctgatattctatgagaatatttgctggaaagtataaaattttagcttaatcattttctttcattcccaaatttcttgtgctaattccttctgagagcagataggagacattctacaaaatgatgaagctctatgatagaatttttccactggactagagaaaaggctcttaatacacataggcctattttaaaaatcaataccagaaaaaggtttaagttagatgggatcttagagataatttgttctcacttcttacttaccattcctcaaggaaggcagtgatatagctcctttcaaatgctttcagatacaggggatccatgccacccacacacaggacacacacaggaacagcatatctaattgtgccatctcatctccccaactgcccttccccaatcttctttttgctctctggatcttcactcaacaaatttattcaaccaattgacccgcttctcaacacacaccaggttttctgttattcaaagaagcaaatgttttacttttcctcctaacaaaatatcgcttgaatcaaggaaggtgctagtatgaaagcaaaataaaacaaaataaaccttggtacacaggatgagagtttagggttttttctttctttctttctttcttttttttttttttgcctttagtagaaaattgctatgctgtgaggatgaaatcctagtatccaccattaaccaatagatagaaaaagggtggatgaaataatgaaattagtaaaaataagttagaaaaataacttagggggaaaaacagacctgaaactatgtctgccagataaaatataggacaccaacttcaatttgtgtttcaggtaaacaaataactgtagtatcagtatgtcccagagattgcatttgtttgtctctgccactctgtttctcctcccccttcttattttaccccctctttttagagtttctcccttcctctctttgcatgggatatacttatcctaaaacagtatttcttctactaaaactttattcatgatttatctaaaattcaaattgaagtgggcatctgtatgtgtatttgctaaacctgataattctagttgaaatgcccacaggctgcctagagaaaaaagaccccagacgaagagtcctgatctcagagctgttgtcatttgtttttcatgactgggtcttactccttcctgggtgggacctccttctgtttaccaaaaggagatggtgtgactgtgaccttaggaaaggcaatgagaactgctgtgggtggctctgctttaggattacaacctctactttccacccatgccctccctggctttactggagcatttcctgttatgtgtttgttccttcttctggaaacctgagccctaacagaagaaggaaaacataatgttttttacaattcattaacggtgcaagagggcccttgtgcagagatcagaaaggcagccaggtgattagggggatgaccgctaactgtctgagcctggccctctgagatttgcatttctcgagaggaccagcccccgggactgatgacaggggtacccaacctcacagtactggccatgccaatgctgctctgggaggctgctctgggccactggctaagctgctagcagggtccacacagatgtgcacagcctccttctttctcatcttttctatccccccttggtctctgtcattcggcacctctcttcctctttttccatcttcctcttctttaagagtattcttgtctcctcatccctctcttaattttatttctgtctctctggtccctttctacttctgctttcttgcatccctcttctcccatctttttgccaaccctttccctcctttttcttctccagccttcactttcctccctcctctctgacacccttccttccactctatcccccttcttctctcttctctttccttctctcctctgctttctttctttgtcctctccccccaccccctttcactttcttctttctccctctctttcccacctgtctcatgcattcccattttgcatcctatgtagtgaatactacggaggtgccatttctgaaactgtgacatggaccttctgtgatatttgctcttccaggctctggcattggccgcggccggcatgtttcagcatggggttggcccaaatctatgaatcaaacatggcaactggggcagcaagatccatccaaagggaaggagatttgaggatacaaagtactgagtctttgctagcatcccttgagcataatagtgccttgtttttcagggacctggtgtatatatttgatgcataggcttggttctgcagaaatcaattttgcaagaattgagaaaatttgtcaaatcactctcatccttggagcttatgtttgttcctaagcatatttttgaaggggtcaaagtaaggttttcattagctctttctaacttcttgattgagaatgaaaagcaatattctaagactatttcccaaaccttgagagaaaatacagagagtttttataagaatgtgcgtatgtatttgtgtgagaatacacacacacacaatgtaaatacaataactctataaatgtacttccacaaaaatatatcttatatatataaactatacatgtgtgaatctatattgtgcacatacacatacaaatcctcaaaagcctatggttgtatataaatatctaattatataaagagaaggtttaggacattatcatgaaccatggttagggataaaaaatgaggaatttgagcatttctgattttatttaaagatactgtgccacctcttggtttaggttaagttagatttaagcactttcattaaaagtagctctcacaaataggtgaaaaaggcaataagccatagctcaaagaatcctttagttagtataaggaaatgaaggtaggcctagcacaagcaagaaaactcacaatctagaagtttgtaagttcttgtcattaatggactaagtctacatgtcaacatgtctcttccaatgcctgccatgtatccaagggctgaagacagcctagtgaccttgaaaataacactcccctcatcatcagacccagacaagtataaacagccacatgtttgagtctctttgaggcaggggagctgcagtattgaacaacaacaaaaaaatatggcatatgaacatcctggagaaaatgtttatttgctctttgcaaagaaaatctcaataatagagataactgtgaagtgttgcttcaaaaacaacccctcccatccactcccccaaaaccctcagatttcaaactcagtgtgagaatagtagttaaagataacaattttactcactcctgtaatccgagcactttgggaggccgaggcgggcggatcacgaggtcaggagattgagaccatcctggctaacacggtgaaaccccgtctctactaaaaaatacaaaaaattagccgggcgtggtggcaggcgccggtagtcccagctactggggaggctaaggcaggaaaaaaatataacaattttagattaaagatatcataactaactctttgacaactgatttgaattaatatacaatattactccatggtagaggctaggaaaatgtcagaagttaacacactctgacaatgtaccttcaaaattataaataactatataggctggtgcagtggctaatgcctgtaatcccagcactttgggagaccgaggcaggggaaaatattttagaaacttaaccaggatgtggtggcacatgcctgtagtcccagctactcaggaggctgagaggggaggatcacttgagcctaggaggctgaggctgcagtgagtcatgatcataccattgcaccccagcctggatgacagagcaagaccctgtctcaaaataaataaataaataaaaatacatatatagaagtatatgcaaggattctttgtttttaaaggcagaatattttgaagttcgaaggataagaaatttaaacaaaacttcaacttgatactcacttatacataaaattcaacaaaaattccctaaccttgtttagagacaacagataaaagattttcttttagtgtaagaaaaaaggcatatgacacaaacaacaagaacaaattaagaaagagagaaactacgttgggttaaaggctactaccttactgtgtagtgtgtttaaaaatccctataggccaggcacggtggctcacgcctgtaatcccagcactttgggaggctgaggcagacggatcacctgaggttgggagtttgagaccggcctggccaacatggagaaaccccatctttactaaaaatacaaaattagctggacatagtggcgcatgcctataatcccaactactcaggaggctgaggcaggaaaattgcttgaacccgagaggtggaggttgcagtgagccgagattgcgccattgcactccagcctgggcaacaagagtgaaactccatctcaaaaaataaaaaaataaaaatccctattatgtctaatcgactcttggtagaaaataggagggaagagataccgaagggaagtcagttttgttagcaattgactcctgagcttgctctgttgaatttcaaaaagccaggcagtgactgacaattcatcactatgagaaagatgcagccaaagccactcctgagctcagaagaacagtctaggaatcaccaaaacatattgagggaaaattgacataagatgaaatgcacagatcctaagtgcacaattttatgagttttaaagaatgcatatgcccatgtaccgacagccccaaccactaggacattgttataaccccagaaaactttctttgtgtcccttccttctcactttcaccaccatagacatggactcatacctatctactctttgtgtctggcatctttggcttggtgtgatattttcagattcacctatgttgttgcctgaacctgttgtttcctcctttttatggcgcaatagtattctgttatatgaaactaccacaactggtttagccattcacctttttttttttttaacttttattttagattcaggggtatatgtgaaggtttgttacataggtaaacacgtgtcatggggggttgttgtacatattatttcatcacccaggtattaattaagcccaatacccaatagttttcttttctgctcctctccctcttcccacccttccccctcaagtggaccccagtatctgttgtttccttctttatgttcatgagttctcatcatttagctcccacttataagagagaacatgtgatatttggttttctgttcctgcgttagtttgctaagaataatagcctacagctccatccatgttcccgcaaaatacatgatctcattcttttttatacctgcatagtattccatggtgtgtatgtaccacattttctttgtccaatctaccattgatggggatttaaaataattccatgtctttgctattgtgaatagtgctgcaaagaacatttgcgtgcacatgtcttttacattcaccttttgatggacatttgggcactatacagtttgggactgttatgaataaagctactctacacatttgtatacaaatcttcgtgaggacatatacttttacttcatttaggtaaatacttaggagtggaatttctagatcacagcataggtatgcatttgaatacagcagaaactacaaaaccaatttccaatctgcttgtaccattttacactctcaccagcaatgtatgcaacttattttggttgctccacatcctcaccaacatttggtgataacagtctttttaatttttgctattccagtgaatatgaaatggtactttctgtggttttaatttacatttccctgtgcttattggtaattcatatgccttccattaagaagtttctgttcacatgtttgctcgtttttattgagttgtcttttaattattgaattttaagggtactttatatattctatatccaagccctgtgtcagatatatgtgtgtatatgtctgtgtgtgtatgatagtcttcccaatattcttttcaatgtatagcttgccttttcatttttcaagtgtattttgataagcacaacttttgaatttataataaatacaatttttattttttcttttatgtttattacattttgcaccctctctaaaaaaaattttcctgccctatggttgtgagatgtttgcctctgattttttctagaagttttctagcttttgcttttaagtttaggtttatgatctatctcaaattaatgactgtgtgtagtgtgaggtagaggtgagggttcattttttactcaaatgattatctagttattctagcaccatttattgaaatgatgattcttttccccatttagttaccttggcctctttattgaaaatcaacttaccggccgggcgcggtggctcacgcctgtaatcccagcactttgggaggctgaggcgggcagatcatgaggtcaggagatcgagaccatcctggctaacacggtgaaaccccgtctctactaaaaatacaaaaaatagccgggcgcagtggcaggcgcctgtagtcccagctactcgggaggctgagacaggagaatggcatgaacccgggaggtggaggttgcagtgagcggagatcgcgccactgaactccagcctgggcgataagcgagactccctctcaaaaaaaaaaaaaaaaaaagaagaagaagaagaagaaaatcaacttaccatgtatgtgaaaatgtatttctggactctattttgtttccttggtctcaatctgtccttaagccaaaaataaatgatgtcagctactgtcatgttatagttagtttttaaatagagtaggatgggttctttaactttgttattctgttaaggattgtttggctgttctaattcttttgcattttcacataaatgttggaatcaacttgtcagtttctacaaaacaacttgtaaagcttttaattgaagttgtattgactctatagatcaattaggggagaattgacattttagcaatgttgaattttataatccctaatcatggtatatgcctccatttatttctaccttttaaaatatctctcagcaatattttatggttttcaatctacattttgcatatctttagttaaataaattatccagtatttcatgctgctacaataatatagaaatacaaatgatttttatattaatcttgcatgctgatgtgttaaaatgtcattaatagtgtaattatttagtagatgccttagaatttttcatataaacaattacataattgtttttaaaaaggttaagcttatttccttttaagtctttttatttgtcacttatttttcttgctttattgcactgactatggtatataatgttgaacagcagtggttagagcagacattcttgccttgttcctgaccttggaagaaagtattcaatatctcataataaagtatgatgtgagctgtaggttttccatagatgtcctttactaggttgttaaaattgccttcaattcctaatttacagagagttttatatcattgagtgtatgttgaattttttttttttttttttttttttttttgtgatagattcttgctctgtcgcccaggacagagtgcagagtgcagtggcactatctcggctcactgcaacctccacctcccggattcaagcgattctcctgcctcagcctcttgagtagctgggattacaggcatgcgccaccaagcccagctaatttttgtatttttaatagagacggtgttttcgccatgttggccaggctggttgtgaactcctgacctcaggtgatctgcctgcttcgggcctcccaaagtgctaggattacaggcatgagccaccgcccccagccctaatttagtctttttaaattagctacctaaggtgtaaacttagatcattgattttaaactttgcttcttttataatcatttaactctataaatttccctctaagaagtgctttaagctacatctcacaaattttgatatactgagctttctttttcattcagttcaaagtattttctaatttcccttgtgatttgtttctgccgatattcattgactaccttacttgacattaatacagcctgctaattttctcatgctgggtatttgcatgatatacctttttctatcttcgtttatttaacctatttttatctttatactttaagtccatctcttgtacacagtgcaaaattaggctttattttgtttcgctttgctttttatccagtctgacactctctgccttttcactggagtgcttagtttctttatatttaatgtaattgttggcattcttaggattagacctactgcttggcaatttgttttccatgtgtcccctctgttttagatgatttttacccctttattgctttcttgggagaataacagacagtcacaaataattacaaatattcttttcatctcaaatattttcaagatttaaactcaattattttttctgtgctgctgtgagcttgagacattatatacattaaagttattttaatcatatatagataacacaaatttccatattaagggatagtaataattataaattgttattctgattttagtcagatttaaattatctaatttccaataagatgtgatttcttctcaaaagtatctgatcttgccgggcgcagtggctcacgcctgtaatcccagcactttgggaggccgacgtgggcggatcatgaggtcaggagatcgagaccatcctggctaatacggtgaaaccccttctatactaaaaaaaatacaaaaaattagccgggcgtggtggcgggcgcctgtagtcccagctactcgggaggctgaggcaggagaatggcgtgaacacgggaggcggagcttgcagtgagccgagatcgtgccactgcactccagcctgggcaacagagcgagactccgtctcagaaaaaaaaaaaaaaaaaaaaaaagatgtatctgatctgaaaggttagttgcggtacgatttgagtgatgggatactatttgagtgatagttacactgaaagcccagacttcaccactacacaatatatccaaaactaaacttgtacctcttaaatttatacaaattttaaaaatacaatgttagtttgtcagaagcattttcaatcttcttgatctgggcatcacatactttgatttgatgcttttttcttataaaagcaaatagcttttaaaattagatcttgatttttatttcgatacacttacatatcctcatattcttcttgtcatatacagatcaagtaatttaaatattcaaaaattgggcatccagatttgtattcaaatctatactctacataacaaatacatctactaggttaattgtattgtattgtgttaactgtaaaatataagaattttatttatttatttatttattcatttatttatttttttttttttgagatggagtctcgctctgttgcccaggctggagtgcagtggcactatctcggctcactgcaacctccgcctaccaggttcacgccattctctcgcctcagcctccagagtagctgggactacaggtgcccgccaccacgcccggctaattttttgtatttttagtagagacggggtttcaccatgttaaccaggatggtttcgatctcctgaccttgtgatccgcccgcctcagcctcccaaagtgctgggattacaggcgtgagccaccgcccccggccaagaatttttaaatctttagaaacatctagagtctctaaagtaccatttctagaaatgaaagaagtcctactctaaaatctattttgattattttaatgagttcatgtctaagttctataacattaatagagagtactgctttgaaattagcattttaaaatgaccagttgagtggtttagaaaagtccattattttataaataatcacagaagcctttttccaagatggattcgagtaccatctggatgaggcttcattattatagcttcatttataaaattaaaggatgaaacgtttaatttgtaagtgtattttttttccttttcagaaagtcatagaatgatatatttggataggcatgtgattgctttaatttttgagcaaattttcagtgtattttccctttagaatcatgacttaagtaaggattagcattcggtagccaaggtttaagaatgcaccgtggatttaccgtggcagacacggttttggaatttaatttggtcagcctctgctttagcaggacaaagagagaggaaggtgatagcatgccttacattagctgtgttggaaatgtgaccctctcctttagaacggctcccagtttgtctgcaggagcaagcccctgtgacacaggagagcagtcaggaaaggacagtgagtgagcacggatgacagaagtgtctgtgccacccattcattagggactcacaaaggggtatagaaattctgggcttttgtggggattgagaagttcctatcaaatgtctgtcgggtaatttaattacacgggcatggtaggaatgacacagtggttacattaataaactgaagcattaaagaataatagcccagttattgctgaattatgggaaacacgctgcctattcattgctggtgatattagaagggagaaggcgggggcttcctactttatactcgcaatgcataaagaaacagtttcttgcctttccagacctgtggaaaaccgggtagaggggaaggcccaaagtcacacccaatagcataaatcttgctttgtttaagatgcttaaaatatcataagctaactctgtttttatggtgctaaataaaattgacttgggccagacatagtaatgagcatgtgctgcacaaacatctccaaatagcctttccaacggatctcattcctgataatttccatttgttgtcctgctcctcttgttaatggaagccattttataggatcacaggctactagcttagtagttttaaaaaagtagcctattaatataatagaagcaaacattatttttcattctcactcatccctctggcagactggaacaaaatgcctttttccctcctgcaggagcgggggaaaaggagcacacatttgatttcgtattatttaacaataaacgtttattgaactgtgtcaacactgttccaagaagtgtgatgtggaaggagggggaagagatgaagatgagctcctgctttcagattccaacagagaaagtcacagctcagcagctggccacccactcccatggaactcaggaagatctttctgcctaaactcttgtaggtgccatattgcagcctacgttttttcctggggggggaaaagttgatgagttttaaagatccatccacctctaaaattctttaagcctatgaaatatttatttctaggagacaataaacacttcacttacacagaaacacttcacttacacagaaaccagttaccatgtgcagaagatggtccaaagaaccactcaataatacaaattacattttgtgctttggggttttaagaaaatatttcggaattcaagtttgaacaagtcaactaatagaatttgaggtggcagatcacttattttcttcatctaaactagagtgttacgatttcatgggcaaaatacaaagttgaagtgtccctgataacacatagcaagctgcacatttcccaggaaaggccagcactgcttattctcacagaagtcacccctgcaagggttctttagatcagtggttctcaaattgagcattcaagagcatcccatggaaggcttattaaaatgcaggttgctggcctcagagctcagattcagtagaagtcagttagagtctgggaatctgcatttctatgcatccttgctctctctccctcccttcctgctgctactgctggttcagggaccacactttgagaatcactgctttggatattagaatgatgattctctcaagtcttgaaaaaaaattgcgaagttccctctaatttagcagagttaagacaaatgtttcatttaatttgcatctatacatagctctgatggactaatcctttataattcaaagggaagaatttaaaaatcataatgatgaggctgggcacagtggctcacgcctgtcatcccagcactttgggaggctgaggcgggaggatcacctgaggtcaggagtttgacaccagcctggccaacatggtgaaactccatctctactgaaagaaaatacaaaaattagccgggcatggtggcaggcacctgtggtcccagctacttgggaggctgaggcaagagaatcacttgaacccaggaggaggaggttgtagtgagctgagattgtgccattgcactccagcctgggcaacaagagtgaaactccgtctcaaaaaaataaaaataaaaaaataaaaatcatgatgagatagaaacagcatgggtcttcattctgccatataacagagacattacataaatggagatttgactgaagactttgttctttgcttcagctcttcagagcattccatctgaatcaagaaagtagtcttggaatatttgctagctgtagcccttcccagtcccactttgtcatacgccacaggcagaaaagaggaatgcaatctttgcccactgattcctgtgtagccacaagcttcagaaagagtttagtcagcagttcatggctccttggcccacactaaccacagtttggccaccaaaaatgtgggtcagcgagttgccagaatgctgaagtatagtggttacaaggaccaggacgctcaagttggaaacatgtgataccaccacagttcttaagatgggaaatgagggcaaaggtaaaccctgctgttcttggacttggttctgttatgccatccttttctaaagccaattgtcactcatacaattttattttgctctcataaattctgccagacagtagtttcattcaaccaggactggctataatttttagtcagatgtatctcttattctgtttttttttttcctcagagaaagaaacactcaactaaattttatgctacagactgaatacctaaaatccccaaccttttatcttaacctgagtcataaaacctgtaccgtcagaaatgcctctttttttattttgattttctcacaaagcacatgtaaataatttagattaaatgtttactgctttgccctcacagagaattagatgtttagcttctgaaaataataaaagaaattgttgttaattatatcatacagagtgtgccaaatttatcaatttgtaaagaatgacaaatcctgcttagttgatatccagagtgtgtctacttactgggtctgatgtaaatatccagtgagaaatctggcttagataaaataaggctaaaagaaaaatctcagaacgtataatttactatatgtcttatttacacagccttacctaccatcagacgcttaaaatacatagtggcttttaaaagaaaaaaacttctaccttgttccattagaattgaggaggcttaggtcaagaaatatagaacatcttaagagtaactatgagacagtgaaggaaagaaaacttatttgggtactcagccaagtttattgtctgtattatttcttttgtgcaccaagttcttctttttctttctttcttctttttaagacagaatctgactctgttgcctaggctctagtgcagtggcacaatctcagctcactgcaacctctgcctcccggattcaagtgattctcctgcctcagcctcccaagtagctgggattacaggtgcaccccaccacgcccaacaaatttttgtattttcagtagagacggggtttcaccatgttggccaggctggtctcaaactcctaacctcaagtgatccacctgctttggcctcctaaagtgctgggattacaggcgtgagccaccgtaccaggccttttttctaagcatattgaccctaagtatgtattgtggttatgttcagtaatgtacacagattttttttaatttactaatcttttaatatagaatatgtaacatggccaatatcttttaaaagtcaatttaaaaaatggttacatgcagttttttccctcgggaaaaatatatttataatttttaaatcatatcttagagaatactattgtgttctcttttctttcatcaaaaccgaatcttttaaggggagtgtttactgggaaagcccttggggaaattgagagatgcaatcttcacctagcggtacaaagaagtatagcttttgactggcacctgattttattcactgagcttctttagtgctctgaagtgaacacagttggatttctagataggaatttgctactcttagtgtcacagtgacatcattcctgggaggagaaaaaagtgctgttttcttctgtattccaatgacataattgtccctctttgcagggaaatgtgcagtgctacagttttggagttcagacccattgttctgaactaataactataaggctagagcataatggaacaacacctttagaaagctaatacccccacaggtttcatctgacatcttgaacgaggtttgcagagagacacacaaattgaacctgtccccaatttttaaaaattcgccctcattctttagaatctaaagtattgcagaatacattgtacaaatcaatccccaaacaaatggttttctccatgttgagtaaaagagcattggaatcctatgattaaaacctcaaaatcaaccaaggtaactaagataaaacagtaaaaccacaaggtgggccagatggcaaaaaggaaaagctcatctatttattttatttatctttctatttttccaaagagaaataagtacttaaaaatctacttgaaagtcccagctcaagtgacaccccatccaagaggcatttagagttttttccggttgggaaagatcttgccctcatcctctaaactacagagaatccaggtctcttttattgaattactatagtcagctgcatatgctataatcaattctcatcattcccatacatgtcttctctcctttcttagattataagctccttcaagatgaacatcatactttagatagacatcactggcttccctggaaaacccagcatcttactctgacaacactcaaaaacaacatgctgaggcccaatggctcacacccataattccaacactttgggaggctgaggcagatagatcatttgagcccaggagtttgagaccagcctgggcaacaaggtgaaatcccgtctctacaaaatacaaaaaattaccgggtgtggtggtgcgtgcctatagccccagctactcgggaagctgaggtggctgatgcttgaacccggtaggttgaggctgcagtgagccgagataataccactgcactccagcctgggcaacagagagagaccctgtctcaacaaaataaatgaataacaataaacagatgtttccctaatatcttacagagtaagatgccactgaagatggtccagccaacagtatgcttttgactagaagtgcaattagcatgcaatacatggctacagtctccttttactgccctttagttattttttagctactttaagttacagatggtttaaatatttcggctgcggatccagaactggtaaatgaagtaagaaactacatctttagctgggcgcggtggctcacgcctgtaatcccagcactttgggaggtcgaggcaggcggatcacgaggtcaggagatcgagaccacggtgaaaccacgtctctactaaaaatacaaaaaaattagccgggcgcggtggcgggcgcctgtagtcccagctactccggaggctgaggcaggagaatggcgtgaacccgggaggcggagcttgcagtgagcggagatcgcgccactgcactccagcctgggcggcagagcgagactccgtctcaaaaataagaaactacacctttagtgaaatagtgcagttttcctgaacttcctgaaatgacattttaaaaatcgatatttggccttactatgcatttctaaggagccaaggcatgtcagtgtggtgtgtactttttgtgacaaattccttttatgattcttaatagcaaaattacagaatgtcatatgggggctcagcctcatagcatctttcattcttgagtgaggcttgtttatgcaagtctgcaagaggggagctctacaaaaggaaaatgggaaggcaaagtcggccctggaaaaattcagccgctggaaatgtggtcttgtccagatagtgagaaaataattgtctccaggtttgatgaagggtttatagcgctaacattttaggatgaaatacagctggtttcagattccactgtcaactcagaatcaagctaatttcatgtggtttggggttttgtaactacttttttgcagagtacttctcggaactttttgttccagaaacacccttgacatccctccaccagcacctaaaattacttcaggcccagtagaaaactcactgggtagcattactgactcttcccagcagagggcaccattatacctccatcggtactggacgtacccataacttcagcaaagaggttctttaaattctcaaccatgagacacaacctctctgataagaaaaaatagtaataataacaaacctagcaagaaaaagatacttaaactttctagaggcagcagcttctgcagttccgaccggggctcccaatgtcagcaattgcaagagaggattctgcccggaaacttaaatttcaggacatgatttggcttgggtttctgatggcctcgtctccctttgttcttggccatttcctgagctagttcttcagtcatctcagaaatttctgctgatatcataaacacacacatccataaactagtctgtgataaaatacatttcaattttcctcttgaaggccgatattcattaacccagcaatttaaatgacgggatgtttctcaaccagggaaggtattttttgtagctttcatcactggtttggttggggagaaacgattgactaattcctatttgtcttagatttttgctttcccccactggaatggccatttttgcccttggggactatttaaagttgtaatatctctagatgatttataacaagtaagtagccagcattgctaaatatccaggcacatctcatatccttagatgcatttttgagactcaaatttcaataatttgccgtgtctttataatatcaacatgcacaccagtagaataaggtagtgggggagattgttttacacagaaaaagaaaatgttagaactagaagaagctttagagaaatttatgtctcctgtctcccaacctctggataagtagcatcatctattaagtgatttttttttttgcagccatatgcttgcttttaaaattatacttagcataggataacataaaaatgctttttctaatcacacattcattcagagatataaggagatggccaaagaactatgttggtggcagtttggaaatatttctacacataatctcccaaaaagcaagcctgtaccctgcagaagaaggtcgtcttcttctttcttttcttctctttttgtagtgacagtaatcttgctatgttgcccagcctggtcttaaactcctggcctcaagcgatcttcccacctcagcctctcaaatatctgggattataggcacaagccaccatgcttggctgtattctttattgagtgcaaaactaatgatttagctttaattttcagaaagttttttttttttttttagatttaaatcccttttgcccgagaaaacaattattggtttttgctagcatcatttgttaaggaagttttttgcccccacaatcctcacattccagattgtactgtaggtgggagaaatttgattctgtgttttcggcacagaatgaccatagaaaatacttattgatagttgaatgttactgaaacattagcaaagaatgctgtgtctttagatctgataagtgagaaacccacaaaattacactttatatgaatttatctgagtttgcaacatccaaacctcttaaatctgttattcctcagcttctttggtcctttggaatccaaaggacccaaaggatacagtattgtattaattactctttaattcacactagagaaagttgacctctagttctgattacatacagagaaatatatctattcacatacacacatatgtatggaaaatattctgtttaacacaagaaaaccccttaacacccaacttcatttttctttatttatttttcttttttttattatactttaagttttagggtacatatgcaccacgggcaggtttgttacatatgtatacatgtgccatgttggcgtgctgcacccattaactcgtcatttaacattaggtatatctcctaatgctatccctcccgcctccccccaccccacaacaggccctggtgtgtgatgttccccttcctgtgtccatgtgttctcattgttcaattcccacctatgagtgagaacatgcggtgttcggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttataacagcatgatttataatcctttaggtatatacccagtaatgggatggctgggtcaaatggtacttctagttctagctccctgaggaatcgccacactgacttccacaatggttgagctagtttacagtcccaccaacagtgtaaaagtgtttctatttctccacatcctctccagcacctgttgtttcctgacttttgaatgatcgccattctaactagtgtgagatggtatctcattgtggttttgatttgcatttctctgatggccagtgatgatgagcattttttcatgtgtcttttggctgcataaatgtcttctttgagaagtgtctgttcatattctttgcccactttttgatggggttctttgtttttttcttgtaaatttgtttgagttcattgtagattctggatattagccctttgtcagatgagtaggttgcaaaaattttctcccattctgtaggttgcctgttcactctgatggtaatttcttttgctgtgcagaagctctttagtttaattggatcccatttgtcaattttcgcttttgttgccattgcttttggtgttgtagacatgaagtccttgcccatgcctatgtcctgaatggtattgcctaggttttcttctagggtttttatggtgttaggtctaacatttaaatctttaatccatcttgaattaattttagtataaggtgtaaggaagggatgcagtttcagctttctacatatgactagccagttttcccagcaccatttattaaatagggaatcctttccccatttcttgtttttgtcaggtttgtcaaagatgagatagttgtagatatgcagcattatttctgagggccctgttctgttccattggtctgtatctctgttttggtaccagtatcatgctgttttggttactgtagccttgtagtatagtttgaagtcaggtagcatgatgcctccagctttgttcttttggcttaggattgacttggtgatgcgggctcttttttggttccatatgaactttaaagtaattttttccaattctgtgaagaaagtcattggtagcttgatggggatggcattgaatctataaattaccttgggcagtatgaccattttcatgatattgattcttcctacccatgagcatggaatgttcttccatttgtttgtatcctcttttatttcattgagcagtggtttgtagttctccttgaagaggtccttcacatcccttgtaagttggattcctaggttttttattctctttgaagcaattgtgaatgggagttcactcatgatttggctctctgtttgtctgttattggtgtataagaatgcttgtggtttttgcacattgattttgtatcctgagactttgctgaagttgcttatcagcttaaggagattttgggctgagacgatggggttttctagatacacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcagagggaatgcttccagtttttgcccattcagtatgatattggctgtggctttgtcataaatagctcttattattttgagatacgtcccatcaatacctaatttattgagagtttttagcatgaagggttgttgaattttgtcaaaggccttttctgcatctattgagataatcatgtggttttttctttggttctgtttatatgctggattacatttattgatttgcgtatgttgaacctgccttgcatcccagggatgaagcccacttgatcatagtggataagctttttgatgtgctgctggattcggtttgccagtattttattgaggatttttgcatcgatgttcatcaggtatattggtctaaaattctctttttttgttgtgtctctgccatgctttggtatcaggatgatgctggcctcataaaatgagttagggaggattccctctttttctattgattggaatcgtttcaaaaggaatggtactagctcctccttgtacctctggtagaattcggctgtgaatccatctgttcctggactttttttggttggtaagctattaattattgcctcaatttcagatcctgttattggtctattcagagattcaacttcttcctggtttagtcttgggagagtgtatgtgtcaaggaatttatccatttcttccggattttctagtttatttgcatagaggtgtttgtagtattctctgatggtagtttgtatttctgtgggatcagtggtgatatcccctttatcatttttaattgtgtctatttgattcttctctcttttcttctttattagtcgtgctaggagtctatcaattttgttgatcttttcaaaaaaccagctcctggcttcattgattttttgaagggctttttgtgtctccatttctttctgttctgctctgatcttagttatttcttgccttctgctagcttttgaatgtgtttgctcttgcttttctagttcatttaattgtgatgttagggtgtcaattttagatctttcctgctttctcttgtgggcatttagtgctataaatttccctctacacactgctttgaatgtgtcccagagattctggtatgttgtgtctttgttctcattttttccaaagaacatctttatttctgcctttatttcattatgtacccagtagtcattcaggagcaggttgttcagtttccatttagttgagcggttttgagtgagtttcttaatcctgagttctagtttgattgcactgtggtctgagagatagtttgttataatttctgttcttttacatttgctgaggagagctttacttccaagtatgtggtcaattttggaataggtgtggtgtggtgccaaaaaaaatgtatattctgttgatttggggtggagagttctgtagatgtctattaggtccgcttggtgcagagctgagttcagttcctggatatccttgttaactttctgtctcgttggtctgtctaatgttgacagtggggtgttaaagtctcccattattattgtgtgggagtctaagtctctttgtaggtctctaaggacttgctttatgaatctgggtgctcctgtattgggtgcatatatatttaggatagttagctctgcttgttgaattgatccctttaccattatgtaatggccttctttgtctcttttgatctttgttggtttaaagtctgttttatcagagactaggattgcaacccctgcctttttttttttttccatttgcttggtagatcttcctccatccctttattttgagcctatgtgtatctctgcacgtgagatgggtctcctgaatgcagcacactgatgagtcttgactctttatcgaatttgccagtctgtgtcttttaattggggcatttagcccatttacatttaaggttaatattgttatgtgtgaatttgatcctgtcataatgatattagctggttattttgctcgttagttgatgcagtttcttcctagccttgatggtctttacaatttggcatgtttttgcagtggctggtaccggtttttcctttccatgtttagtgcttccttcaggagctcttttagggcaggcctggtggtgacaaaatctctcagcatttgcttgtctgtaaagggttttatttctccttcacttgtgaagcttagtttggctggatatgaaattctgggttgaaaattcttttctttaagaatgttgaatattggcccccacactcttctggcttgtagagtttctgccgagagatcagctgttagtttgatgggcttccctttgtgggtaacccgacctttctctctggctgcccttaacgttttttccttcatttcaactttggtgaatctgacaattatgtgtcttggagttgctcttctcgaggagtatctttgtggcattctctgtatttcctgaatttgaatgttggcctgccttgctagattggggaagttctcctggataatatcctgcagagtgttttccaacttggttccattctccccgtcactttcaggtacaccaatcagatgtagatttggtcttttcacatagtcccatgtttcttggaggctttgttcatttctttttattcttttttctctaaacttctcttctcacttcatttcattcatttgatcttccatcactgataccctttcttccagttgatcaaatcagctgctgaggcttgtgcattcatcacgtagatctcatgccgtggttttcagctccatcaggtcctttaaggacttctctgcattggttattctagtcagccattcgtctaatcttttttcaaggtttttaacttttttgccatgggttcgaacttcctcctttaggtcggagtagtctgatcgtctgaagccttcttctctcaactcgtcaaaatcattctccatgcagctttgttccattgctggtgaggagccgcattcctttgtaggaggagaggtgcttgatttttagatttttcagtttttctgctctgttttttccccatctttgtggttttatctacctttggtctttgatgatggtgacgtacagatggggttttggtgtggatgtcctttctgtttgttagttttccttctaacagacaggaccctcagctgcaggtctgttggagtttgctggaggtccactccagatcctgtttgcctgggtatcagcagcagaggctgcagaacagtggatattggtgaacagcaaatgttgctgcctgatcgctcctctggaagttttgtctcagaggagtacctggctgtgtgaggtgtcagtctgcccctactggggggtgcctcccagttaggctacttgggggtcaaggacccacttgaggaggcagtctgtccgttctcagatctcaagctgtgcgctgggagaaccgctactctcttcaaagctgtcagacagggacatttaagtctgcagaggtttctactgccttttgtttggctatgccctgcccctagaggtggagtctacagaggcaagcaggcctccttgagctgcggtgggctccacccagttcgagtttcttgactgctttgtttacctactcaagcctcagcaatgacaggcgcccctcccccagcctcgctgccaccttgcagtttgatctcagactgctgtgctagcaatgagtgaggctccgtgggcgtaggaccctccgagccaggcatgggatataatctcctggtgtgccgtttgctaagaccattggaaaagcacagtattagggtgggagtaacccgattttccaggtgccatcagtcacccctttccttggctaggaaagggaattccccaaccccttgcgcttcccgggtgaggtgatgcctcgccctgcttcagctcaggctcggtgcactgcacccactgtcctgcacccactgtccaacaatccccagtgagatgcacctggtacctcagttggaaatgcagaaatcattcgtcttctgcgttgctcatgctgggagctgtagactggagctgttcctatttggccatcttggctccaccctcccaacttcatttttaagaagagaataactttctattgcatgccaattaaattatttctttaaaaaactgcaatatgtacagtatacaaaaggaaatattatgtcttgattggagtgaaattagaacaataaacactttttgaaattgttgtatgttagtggtagaattttatttttttaaacaaagctcggcattctacatattgtcactagttgctttagtagttattttttcttttgtctgatgatattgttcccttatgttaacattttggcaggctccttggatataaaatattttcaagccctaccagacgttgcttcattttcattctcttttcgttatgtttggagtattatcaaatgagacaattggcatgctacatgtgacttacttttatccatggctatcagtaagcatgagctacagttaaataagaaatactgctaatacaattgaaatgcaaagcatattaaaatgttccagattcgattaacaaaagtagatctcacacgaattttaaagaggctctgctagtgctacacaagatcagcaactgtcaaagatgaatcttttagaagaggagttcttgattttggcacacaggccacagtgagctatataagtttccaggctcaacagccacaggatttagggctccctttgggattgagggtcctcaatactctctcccactcaactttaacccaggcttcgctctaagctgtgcctccaggaaagcatgcttcttgcaggggcctgggctgctggcatgctaatgaacatttctgattgtttgcattccaaatgaccagcacaaagaaggctttctccccacctttcaattgtatttttgttttcttttaagaatagttttttgaacatgcaaaggaaaagcatcttgctatggagcctgtaagagggaattctgccagagtgtaaaattccaagtgttctgaatacagtcgaagaatggatgattaaagcagaggtgctttaatggtgctgcagtggtaactggaaacaggacatttgctttcctccatgttctcagtcccgctgtcatagggcacgtaaatactgacatacctgatgatatttcttcaaagcttgagattgagataaatttggaggtgataggaagaattagctacagccctctttatcatgaaaagagtaaacatgcccggagtacttcatcaagagagggtgccccatctctccctggcctggcacttactacatgacaacacttaagttctgaacctctttggaccatctcaactagtgggcttgaactctacacatctgtgagactcaaagtgaaactccaacccaaactttatatctttagttaaagttgttgaggttaaagggttgtcttggtttgttgttgagtagtgcaaacctagaacttcctttaaaaattctctttcaggcacagtggctcacgcctgtaatcccagcactttgggatgccaaggcgggaggattgcttgagcccaggagtttgagaccagcctgggcaacatggcaaaaccctgtttctacaaaaatgtttttaaaaaattagctgggcatggtagtgcatgcctgtagttccagctacttgggaggctgaggtgggaggactgcctgagcactggaggtctaggctgcagtgacccatgatggtgccactgcactctaacctggaccagagagcgagatcctgtctcaaaaaaaaaaaaaaaatctccttctctatttctctgtgtccctctctatctctctaccacttttcagctaaagcagtggttttgaatttgggcatgttatcagcaacacctggaagatttaaagcacagtgaactaggccgggcgtggttctcaaacttgagcatgcattagcatcacctagatgacttgttaaatcacagattgctggccgggtgtggtggctcacaactgtaatcccagcactttgggaggccaaggtgggtggatcacaaggtcaggagatcgagaccagcctggctaacatagtgaaaccccgtctctactaaaaatacaaaaattagccgggtgtggtggcacgtgcctttaaccccagctactcaggaggctgaggcaggagaatcgcttgaacctgggaggcagaggttgtggtgagccgagatcacgccactgcactccagcctgggcaacagagcaagactccatctcaaaaaataaaaaagaaagaaagaaaagaaataataaataaagcatagtgaacataccctagagtttctgattctgtatgtctggagtggggctccagaatctgtatttctaacaatttcccaggtgatgctcctgctgagagaaccacattttgagagcagaagtgaaagtttaaagattttagagcaggaatgaaaggaagcaaagtacacttggaagaggaccaagtgggtgacttgagagatccaagtgccccatttggcccttgacttggggttttatacattggcttggttccagggtttgtatttcttctcctctgattcttcccttggagtgggctgtctgcttgcacggtgacctgccagcacttaggaggggccatatacgcagtgagtttgctgaaattgtgcacatgctcacttgaggtgttcttcccttaccagtcccgcattcctaaaagaaggtcatatacccattaaactccaccattttgcctcttattgtacatgcttgaacccacttgcccaactcctgagatcttatcaggaagcgctgatcatcagcctcaggtgttttctatctattgggaggctccctttccccgctgccagttgtgaccaggtatcattttagagagacagttaacaactgcctgaccatcacctgatggtcacctgacattcctgggggtaaaggggaccctctccttccctactcatgtcagactacctacttttaactgtcactgctgataatgcttgaaataattatttaaatatggactttgaatccaacaaactgaattggatgtacataaatcagagtttctcaaccttggcattatcgataattggggccggtaattctttagtgtgggaggctgtcctgcatattgtgtagcagcatttctgtcctctacccagtggatgccagtaacactcttctcccactgagttgtggtaaccaaaaatgttctagacattgccagatgtcctttgcagggaaaaaataaccccttgttgagacccactgcattaaatcattcacaggtcactaaaatatagaaaagcattagaagatacattcgtaagaacatgccactataatgcacttgagcttcactttcaacagctggtcactacaaacctttatacactgcctattgcatcttgattctttaattcatcaacttgatgatcctaatatttgctccttctctttttttctaagaggggaaaatcatgaaaggagatgaaaaccacaattgaaatacagtgtaattttactttgggctacttgaaagaggcacagccagaattcctgaactgttcctattgtatatgggatcaatatggctgggagtgttttaatcatgtttcatgtcatatacacctcaatgtgttttattaacttataattattggagcagtttgcttggctttagtagacactataaaagcccaaatttacagaggcctgaaagaggtccattaataatttgaaacttgtcagagtattctggaacgagggtgagctctgaagttcctctcaccaattgaaaagctatttggaggctttcctacttaaaacaatacagaaaaccttcattaattgactgtcactttccttgacaagaaggctgttgttcatcctggcttcttaaagcaccatgacaatagctcattaatacaatacagagtctgaagtaagggaggaagggtactaaaaggttccactgcataaccatgcactcttgtctcttcactgcctaaacctgaggctggggggtggggatgtgaagaggaggcaccatagtgccatcattgaggaggagaaaagatgaagagccatttaatgagtgcggcagtcaggctaaagaaaagacatggccggtttctgtctcccacagttatggtgacaatatttccagagcaaaattgaggagcatggtctgacacaagaatttgtgtgacttccagatgtgaaaagcatctgggaaagggggattgaaagtcagcatgttggaattttctatgatatttatatggattatgtaagaagacaaaataagagaacatatgatatttttactctcccacacatgctgactaatgtgattgaagactttgtgtccagtgtttgaatgtgatcagtcaatgtttgtcagcaagagggagggataaaggaagaaaggaaagaaggaaagaatttggggaatatgccctggtctcctccaaagtaagagtggcctggctggaatctctcaaaacaagctaataactctcatttggttggtgggattacaaataggtacaagttttttaaaaagtaatttctccatccatatatatatatataatatatgtacttattaatttatgtaacttattgattatgtgattatgtaatatatgtaacttattaattactataacccagtataagccaatttgtctataaagaaaatattgcctgcttgttatttgagtgtaactgctgggcaaaataaagtcaatggatacatgaaataggccatgcatttctatagagaaatgttggattgtggcatccttctaaactacagagcagaaaatactagctccagtagctacctaaacccattactggcagagggctttggctgcctcctgaccaccccatcaatgaaccaacccccatctgaatttcctgccctaggaattctctcattgccagcaacaagttcccacacctgtaataacaattgaccgtgaatgttggaccgccaggtagcttctttccccagacaaccccagacacataatcttcccccaatggctagacccataaattcggggcagttaaaatgagctgtctcatttagaagtgaataattcctttaaaaaagaagaagaatctgctgtctttctctctccccacatcctacacacactccctcttccaaccttctccagacttgctgactttttcacttcctttcctgaagtttgtcttttgaatcaaaatcgtcattgcaattaaagctgggtatactgagttagaacaaaacaagaaagttttaactggcttttataacctgtcacaagaggattacaactaccaaaatatcatgccatccaaaaatgtacagggttcagaaaaaaggacccagtgatagttaataaacagcatgtgaattctgtaccacgtaagtgaatccacttgtataaatttggactcaagtttcaatttcagtgggtgacaactatgatggtggtcagaatttgctaactgcctctggctgcattcactcaagtaatattcatctacttctagaaacttgtcaagtcaccaaattctttcttagacaaatgagccagaaagggcaaaactcgcctaacccgcctgaagcctgctgttctgtctctcccagatattaaaagacccggaactctataataacaaccatgcagttcattgcacacatgatatttctaacagtggaaaaggaaagataccatcagctaacaactagctaacaacttcttgttcttttttgaagccaatgactgatctacctttttggttattgctgttgttgcaaattggcccaatcacttaatgattggacaatgtcaacttttaggttaaaaacttcttgagcactcataccaaagagagttggaagtcagaacattggagatttttgaaccttgaaataataccctttgaattattttacaccattaaaatgtctccccatcagatgtattgtaaagtttctcagcaggacgcatcttactttatacaaaggatatgttcctagaaagctagatcttaaggttaaccttaagaaactgccatttttgctagtcacaaatgatcagatatccacaattccatatggttcaacctaaatatgtgaaaataatttttgtaagccaaaatgttttttgttggctccagggaaaattcactagatattcattttatagtgaatgtctggataaggagtggaatccctttgtaaatttggtaataaccaaataatgtattcctctggttccatgctctagttgtttaaagcaggatataccctttgtttctgagaaccagctaaatagagaaaacgaaagccagtgtggaccctctgtttcaagtgaggcttgcaggctctcactccgcatacaccctcgaggttgctttggaagagtccatccctttagttgcacttttgtcttgtttctcccaggaatttctgtttcctgtaataggagtcaggattccagtgaagcggcctacggagaagctaaccaatgtgtggcttagctcagagaccctagacttccctcatttccccttttctttttgccccctcatttccccttttctttttgccctggtaaccatcctcctctgctctgaacttccatcaagcctggaaggaattgatttgtatcctgaattatgcagaatgcaccctgactgcttaacagtgggagttattttgttaccattcagttaattcttttttacttaactggttaaaaaatcatgaattatgtatacctgtctgaactaccagcccatatttcacttccccaaaataaaataagtttcatagaatatacattttaaataactaataaatgttaatgtgtggtatacagtgcccagacattcatttttatgatttgaacaaataccagaaaaacagaacctaatatagtcatctatatcaggaaaatgaccagataatttttactaaccattttccttttagctgatttatgataacatctctttatacaatagtaaggtcttgacattgaagattcattcacatggctctaccaacacggtacatttatttaaaccacacttgactagtggtatataaataatctcccccaaatcatattgatttcccgaagggaatattaaatgctaaataacttcacagattggaagcagccctgtctctgccttcttttttgatataatcaaaaatgatgacattgtagctagcttatttttaataattcacacattgagagcaaaagaaaatattacaccagtgctgggggacatgaactctgggccgcaaagcacattctcctttctctaatgaatgataacagattgactacatcatgtctgccacagattaaaaatgtgtctattcataacggagctataaattagcatagtgcattattctccaggtatcagatacatacatagcacaaggtctttgggaagaatgtaagttatatatctttcattagtcctcacagaatatttctgattttatcaatcctgattttataaatctgaaaattagataaggtatggctttttggcaatgaaagtgattttgatcatattggcaaagtatagctggatgttcaccaaacagtcctcccttctcttctagacacacacctggattctatttttcagcctcccttgcatttagtggtagtcatgtgactgagttttaaaccaatggaatatcagaattctagtcatggtctgtaaaaattccattgcagtccccatattctttcttccccttccgcggtgaaggcaagaactccaagtacctaaaggaaggcagagccataagattgttgaagttcaggtctatgagttgctgtgtagagggaagcctctcagaagacctgaaaaaccaggatcatccatgtgggactattgcatgaacaagaaataaaatttttgttgtgtaaattttagatcgcaagagttaacctgccagaagtaacaacatcatcaacctgaaaacactgtgataaacctggacatatcaaacctagcaagaccttgattctagccttctcaaattgcatgctttcctcacctacacaattataatgctatagttagacccaattatgagtcactatgtctttataatccttgattttcttttgaaaacatagtaatgcacggtacaccctgttttggataagttgactataaaacatatttctattgagaaaatttgattggcttccttttctaaactagagatagtttcaggaacgttttcaataaaataatgtgaaaactttttgtgaggtggtggttgtatgtcagactctacattatggtatatgactattgtaatagtccattcttatgctgctaataaagacatacccaagatggggtaatttataaaggaaataggtttaattgactcacagttcagcatagctgggggaggcctgaggaaacttacaatcatagtggaaagggaagcaaacacatccttcttcacctggtggcagcaatgagaagtgccaagcaaaagggggaaaaacgctttataaaaccatcagatctcgtgagaattcactatcacgagaacagcagcatgggtgtaactacccccatgattcagtttcctcccaccaggtccctcccatgacatgtggggattatgggagctacaattcaacatgagatttgggtagggacacagccaaaccatatcaactatgattatttttacttttctagaaagacactgtattttacaagagaccctagatttcccttgcttccccaggctaagtagaggttccctaattttttaggcacaaacctcttaatgtttaatattgtattcacaatattaagcagtggttctcatttcacacaccccccaccccttcctcaggaagcatttgacaatgtctggagacattttttattgtcacaacttgggttggggaaggtcttgctcttaacatctagtgggtggaaaccagagatgctgctaaacatcctacaatgcataggacagcagtccccataacaaggaattgtccagccccaaatgtcaatagcaccaaagttgaaaaaccctggactaggttgtgagttccatgaggatgaaagtcatgtttgctttactcatcattgcatcttcagcaattcataaagtacctaaaacatagtatgtacccaataatatttgctcaatgaataagtggactgagcccccccgaattagcagattggccagtggggctatacttagccaatgggtaaggcaggatttggagttaaaaccttagctctacagcttagctcaaatgcattcttaagcaagtgactccatctttctaggcctcagtcttctcatttgtaagttggggatagtaagtgccaacttcatggagctgttgtaaggttaaatgtgatgaagcatgtagaatgctcagtgtagtggctgacggcctcaataaatattcttttattattactaagaagaaaggaaccaatgtttcctgggtttttatcatgtaccaggcacagagttaaagatgcgcatggtctcatttaatcttctcaacaatatttacggagtagaacttttgaaacaaaatgtgaaactgggttttagagatatcaagcaacctgctcaagatgatgtagccttttagaggtagaaactgcagtaggcatactgggagaaatcaagttcactcacctagatacagttttcatagttgtctctatttttaagatgcaaaaagttaatcccagaataccataaaacttacattgacttcatagtaacaaagggatttaataaagtctcaaatttcctattaaagtttatccaatagccacctactgtttaacaaggtttagcaaattaaatgtaacaatgttttgagaatcagaataaaataaaatcataaaagaaaaaaggctaggtgattattatcttcttttttctttatgtgtcattctttgggtttcatatttgttgtctcggctgggtgtggtggctcatgcctgtaatcccagcactttgggaggccaaggcaggtggatcacgaggtcaggagttcaagaccagcctggccaatatggtgaaaccttgtctctactaaaaatacaaaaattagccgggcgtggtggcacgtgcctgtgatcccagctacttgagaggctgaggcagagaaatgcttaaacccaggaggcagaggttggagtgagcctagatcgcgccactgcactccagcctgggtgacagagcgagactccatctctctctctctctctctctgtgtgtgtgtgtgtgtgtgtgtgtgtatatatatatatatatatatatacacacacacacatgcatatatatacacatacatatatttatatatataatatatatttcttgactcatctccttttacaataataccataatatttgttgatgcaatgacatttggattctgttgtaacttttgctgttatttcacatgatataccagctcgatggagttttgctggcttcaaaaaagcaaaccacaacaacattcagaagagtctgggggcccataaaggctgggaggcagagctactggtgacaagaggagtgggaggccactttgaatatggctattccctttgatgtgttactaacaatcaccacacagtagcaacgcagtagtccctgagctctctttaaactgtgtttttcttcaggaaaaaaagtcataagaaaacgttgacctgctaatgacataataagtgaagcttaaagctaaatgtacctttaaaatgtcacaattaagtacaagcagtaaagtataaataggaagactttataaccactttaaaaagtaaggtgactgacaggttattttgcctgttggacaaggcactgggtagggagagggattgggctaagtacttcattattcattggttttaaaacattcacttacatgttcttttcctataaaactaacatcatatggttttggtacaataggcaataactagtctatcaacaaaagttacgttataacaactctccaagagatgttttagcaatagatttgttttagatatttatattaggataaacctcatttcattcatcagacactggagatgaaacggaattggcattagtcagtatgtgttgattttcgaagaaaaaggaactattttgaactttttcatccactatttggtctttcttgtttttaaaatgagaaaattatattggaaaaaaggattcaaagcacctctaaaattcttcaatcacatcttactttatgaattctctattgcctttatttttgtgtacaaaaagaatgtattaaacattgccttcaagggctaaaaatctgtctttagatataataaacttttttttaaacagactctcactctgtcgcccgggctggagtccagtgacatgatctcagctcactgcaacctccacctcccgggttcaagcaattctcctgcctcagcctcccgagtagctgggactatgggtgcgcaccaccgcacccggctaattttttgtatttttagtagtgatggggtttcactatgttggccaggctggtctcgaactcctggcctcaggtggtcctcccgcctcagcctccctaagtgctgggattacaggcataagccactgcacccagcctgatataataaacttaacaactatctgcttatattttgcagttacttcgtgaaatgtataagttggtagctaaataccacatttacttgtgtggattttgcaaactgtaccattttagtaagaaatagtaataatacttaaagattaaaggtgctgatggcatgatttttggttactttttcttcttgaatcttggcacactttttgtttgctcctgaaaccgtaatgtagtgacaagttactaactaaaatatatctctagtaataaattatgttgttcattgtattagtcatcttggactgccataacaaaatactacagactggatggcttaaacagcagacatttttttcacagttctggaggctggaaagtccaagatcaaggtgtccacagattccattttaggtgagaactcacttcctggctcgctgcagcctcacattacctttccacagtgtgtcctcgtggagagagaacaagctctctggtgtctcttcttataaggaaactaatcctgctggatcagagcctcacccttatgacctcatttaacattaattacttcataaaagccccaactccaatacaaccccactgggggttaaggcttcaacatacgaatttggggaagacacaaacatttagtccataatgttaattatttgtagaaaagagtaaactgtccaatagagtttttgataactatcaactaactttcctggtggttaaatgaacatggaaaaataatttgtattggtgcaaatgtgagtttgccttcgaaaaacacagtgatatttattcaacttgctcatagattctgataaggatgtgtaattaaagacaaataagataactaaaatatgtcttggtgtatatgtgatttaaattttttaaggaacttttcacacagatcttcttcagtttgtataataaaactattcatcagactcagtttaaagaagatacatctttctgaacagattctccacgatttttgaagacatactatactaaacgttcttctcacaaaaacaaattcaacctaggactcttgacagcttcattttcaggccagtgagctaggatgaaaattgagctgcccaaagagagttggccaaatagtttactcactgtaattaaaaaaagggaaatttcgaaaccacagtcgtcttcaatgctaatgtgaacaaccaaatgttatttccagtggattttgtatttccttattcttggcaagttggtacagttctgtgcagttgggaattagacactttttccttaagatagaaatattctttgcattaaatgcagagtggcataattatatgttcactgcatgcattcagtgcagaaacatgattgcaataattttgaatttgaacacttagctttacacctttcatttttaaaaatcatagcaactatgtacttctggcagaatatttcttgtggtcaatgttatttacttatgcaattggaaaatgacttgattgcaaccacgttgaaaatctttgccaaggtatgagcttttcttacactggagttttctttatgagaataggtaactttattttgtgattttatttggttctgctcaatgactcaatctggcttaggagacatacttgacaggttttgatccagggaaaaatgaatacaagtatttgcatatgagctgctataataaacaaccaatgtccaattgactacaatattaaaattagtatatcaccttggtattgggcacacaaataagcaagtgttgataacttccagatgttttactcttttaactgctgccgcatctcctctaattccaccttcttctttaaatagaacaaagtttaaattctgagcttcccaaagaaacttttccaagtgctccgtttctcatttaccagccacggaatggcatcattgtgtatttgggaagagacaatgggggtcgcaggggaagctgggaaactgggggaggccaactccctattttgtccttctaagcatgctaaaggggtgtttgagcagactttggccactgtctattgtgtatacgtcaaagttttttgaatggcttcaccacttttgcacatcttcatgggtcctatttaccagccttgagatgcagatggaagtaaaatcctaaatctgttctggttgcgatgtaagaactaaggaagggataacacttcagcactaatgggattcacactttgttagaaaacagccatgttgctctaacctttgcttgcatcaacagcggctgctttagagtgagtatttacttttcctcttgcctgtgaggttatattaatttctttttccagcttgatggtttgcctgttctggattttacatttaaaaaaaacaaaaaagtaagtaagtgtttcatcactacattctcaatggtttgtgtccaggcttgtaagctgctctttagttaccaaaataaatgactttttgtcttcataattcaacattgtttgtagatggcattttttaaagtaatgctaaagtctccaaattcatttttcccacgatgtcacaaaagaacattattattgcacatgtagactccacatcatcatagagtaggagagacctggtcttttttccaaacagtcaaaaatttgattctcctttaattgtatttattgaaggcaaatttagtttttttcctaagatgtcttaaagctgcttcctcttttctctgccccagaattacataagattgtgccccttaatctatcatttgaagtcatgctctcctaaatgtaaagaactttttggaaagttctttttattctatcgtcttcttttttctttttttgagacagggtctcactgtgttgcccaggctggagtgcaatggtgccatgatagctcactgtagcctcaacctcccagagctcaggtgatcctcccacctcagcctcctgagtagctgggactagaggtgcatgccaccatggccggctaatttttgtattctttgtagagatggggactcaccatgttgcctaagctggtcttgaactcctgggctcaagtgattctcccacctctgcctcccaaaatgttgaaattacaggcatgaggcatcatgcctggctaccctatcttctatactcatattttttacagcccataagtataaaatacattaaatataaggaaaattataacaggtttttgctatgttgcaggataactttaccttacaactatattacagtaaaactttattaaaactattgagctagccaggcatggtggctcacgcctgtaatctcagtactttgggaggccaaggcaggcagattacctgaggtcgggagttcgagaccagcctgaccaacatggagaaaccccatctctactaaaaatacaaaattagccgggcgtggtggcacatgtctgtaatcccagctactcgggtggctgaggcaggaaaatcacttgaacccaggaggcggaggttgcagtgagccgagatcgccccattgcactccaacctgggcaacaagagtgaagctccatctcaaaaaaaaaaaaaagtattgagctagccacttttcctaatctacatacaagtgtctatctaaaaactgcacaccgtaaaaagatctagacagtgctttaacatatttgaagactgtatttgtgattatctgacttaatttgtagactctgtgatgtccagaaatttattttgcctcacagagactaagggtgacaccagcaagaagtacaacataattactcaggaaaaaggggcaagctcaagtaactgctccagggaaagatcagccccttctatcaatacagggccagagaaaacaagtgatgagtccaatgtgagcctccaaacaaattttacagggtcaaagctccaaactgcagccttcagtttacaatggaacggtttctcaaaaggacaactccttatagaaaataaggggagagctgcccagagatttagttatttaatgatggttaaaagtgctgaggccagatggtggaataaaagtgtttataaagttttccctagatagaagatatcagtcccatttatttgcacaactgcagcacgttttgtcaatttagtctgttgtgcatccaccttggtggccccttcccagggccaacatcatgttgagaaggaaaaaaatcatttttcctctaacctcttagattcagtgaccagggccttgcaaactaaacttgaaaaaaaagattaaaaggaaaatggagtttatttcatataagcattggggatctcacagaaatgaagtgaaaaccccaaagaagtagtcagagccagggccttatataccattttagcaaagggaaataaatgtatgaaaaaataacaagtgaaaggaaagggtttggggctgctaggggcagtacattgtaggaaggtagatacatggaggaaactaatggaagacaagggttattttagtaaggtttatttgtttatgcagatttaaattcttgtgatctccagtaatagaagttgtctcctctttctggtacaagaaaaaaggagaggggacactttcacaaaggaaaatgtattccctgcattccctgcctttacggggaaggaggaaggaggaaactgcggtgttttttttttttttttctttttcttctttttttttgcatctgctgtttctcaattgccttcagctcaaaataatccttatgacaaagtagcatattttgtggtggcatattctgatatctttcaatggggaaatgattgtacaagtgagaagtgggagcactgaggatattgattccctggctataaaatggtgctccattacccttcctgaatcacctttagtacaacattcagaatagcatgcccatatagattcagcctaccttactatgaaatgtgaactggctgcccagaaccatgtgcataagacataagctgtgcataagatattagctgtgcataagacataactatgtatataagacataagctgtgcatttaaatgagatccgttttttaaaaactaaggcagatcatcatttacatttaattcaagggcgaacacaagttggtgttatgaggctatttcatttctctgttttttctggatggttgcagggatggggggcaggtgtcaccacatcagaatgtcaacatgtgaccagagtaaatggtccctccagaccatggctcaaatctcagcctgcctgatgaggtcatggctcaatggaaaacatgctctctccatcattgttcaacttactagaaatattttagaaacacgcaattaaagatatgcatcatagcactgaggaataagaaataattggggaagcccacatcaatactttgaagtctatgcctctctacatactatatttcaaggggttacatcagtggttctcaacagagtgagagtgggggtgattctttcccccaggggacattagtcaaattctagagacatttttgattgtcacaactgagatgtgggggatgctgctggcatctggtgggtagaggctagggatgctgctaaacgttctataatgcacaggacagtccaaaatgtctgtggtgctgtcatggagaaaccctgttttcaatcaccatacaccacatgtcagcacacagccaccccctgctgcccaaccacggctccaaaaacaaaccaccactggcaggacacccgcagacgccatgccagatatttagaaagagaccaaaaccttcaatcaattcgtaaaaatcttatgtgcttttaagcaaccacactgaatcatgagtaaagatatttgagcttttttttaattagcctcattagagcagatttttcatggaaaaaagtcatcagtgatgaatgcacacaggcaatcatgaataaatcatcttctctccttattctgaagattcctgctaattcggagacaattctcttccctcaattgccctgttccaagcttcttttggtttttctcaatatttcttttggttttgtttggactaatatgaatttggggaacatcctctgaggcattctgagatccagtcctttcaatgttgattcttggacggatcattaaagagctattaagagctggcagtggtgtccttttgtagaatagtcagcattttcacccactgagagtagccctgcgaatcctttgtttctacttcttggagggagtagcagatttttgtaactaaaaagcaaaaccacctggtagatttctgaattaaaggaatctccaatctctcaactttttcataagtgggagaaatggtattggagtcctagaggtgttcctacaccctatgcctattgaagtggaggcaggagggtagccaatgtataagaaagtaaagatttcttactgagattggaattgcactaataatgactttttaaaaacagagattatggacaaggtcagcctcctgtttgttccaaacaaggtgatcattagccagcatatagttgggtgaaaattgttgatcgtgaccacttatagttaatgttatttttggatacatcattgttctacaaacaagtcctaacttagctttccaggtgcttcctggtctagagcagtgctgtccaatagaaatataatgccagccacatatgtattaaaatttttcaggtagcaacattaaaacaattaaaattaattgtcataatatattttatttaacccaatatattcaagttattatcatttcaacatgtaattgtcagcagcagtgaatccgtatgggtctgcagcaacctcaattcttgcttcctcagaagaaagacttagaccaagggggcataactgcagtgtgagagactgaggcgagttgtagagcaggagtgaaagtttatcaagatgttttagagcaggaatgaaaggaagtaaagtacacttggaagagggcaaagcaggtgacttgagagattcaagtacattgtttgacctttgacctggggttttatatattggcatgcttcagtgttgcatctcttctcccctgcttcttcccttggggagggctgtccacatgcacagaggcctgctagcatttgggagttgctgcatgcatagtgtgtttactgaagtgatgcacatgctcacttgaggcatttttcccttttctagtcgagtgatcctagacgaaggtcatataccagttaaattctgccatttttcctcttagtgtgcatgcttgagcccactcgcccaactcctgagatcttatcaggaagctgctgatgaccagttttaggtgttttctatgtattgggaggctgtctttccctggcactgggtataaccaattattattttagagagacagttaacaaccacctgaccatcacctgatggttgcctgacattcctcattgtgtgtgtgtggcggggggctctcctgccctgcttctgtctgactaaccacctactataacataatcaatatttaaaaatttactaaggagatattttgctttttttcatactgtgtatttttatatttacatcccttctcatttcagactcactgcatttcaaatgatcaatagctacatggagctggtggctactgtattagacagcacagtctagcccctgcctattcctccaactctgtaattgcctgatgggttcttcctgcctgctgcgcagacaaaaatcagtccgctgagactatggcattgcagtaaagaaagagtttaattgacaaggccagccacaccatgtgggaaatggagttattactcaaatcaaactccctgaaaatttagaggctagggtttttcaaaaatactttggtgggcagggggctagggtataggtgctgctgatgggctgtgaatgtaatcataaggatgtggaagatgggcattcaatagtcagaaatgcaaaagcctgaaaagatacctcaaaaggccaatcttaggctgggcatggtggctcacacctataatctcagcactttgggaggccaaggcaggtgggtcgcttgagcccaggaatttgagaccagcctgggcaacatggtgaaaacccatctctacaagaaatgcagaaaaattcactgggcatggtggtgtgtgcctatagtcccagctactcgggaggctgaggtagaaggattgcttgagcccaggaggtggcagctgcagtgaaccatgactgcaccactgcactgccgcctgggcaagagaatgagaacctgtctcaaaaaggaaaaggggccaatcttaggttctataatagtaatgttaattacaggagtaattggggaagttgcaaatcttgtggccccccaaataatggctggtaatcatttacctactctatatcttagcagacttcaggcccctctcatcgtcctaacctggtggcctttcattagttttacaagggcagtttcattttggggaggggctattatcatttaaactataaactaagtttctcccaaaggtagcttggcccaagcccaggaatgaccaagggccatttggaggaccaagggcagtttaagggcaagatggagtcaattatgtcagatttctcttagtgtcataattttcacactgttaaaatttttgcaaaggcatttttcaactccatctattttttcaccatgctttgtaaaattcgcaatccagcactagtgaacgtctctcaagtcctttgccccaagtgtttgtctctcttatttcttggtctttgtacaagtgttttcctggaacactttctccaccatccctcccacccaactaggctaattccgacttacccttcgcaaaagttgattcctctggaaaaaaatggttggagaggaaaaacttttcccctacactcttaggtttggtgcctggggacttgcaaatttaaactgacaaaacagattaccaacagaagagacagaatttatttacacacacattgtgcatgcaggagtgctcagtgatgtataactcagaggggtggttagaatttggggcttatatacctagcttgttaggggaaataaagagtggagaaaaggcttctatggaaagaacaaataggcttatttaaaagaaacaaacggctttttaggaaaaccaacaggagagaagaaagtttgtgataatgtttgtttatataagtgagattggtgtttccatcttcttcgtggccatgaaactcccccagagagggaatttatggtaggtttactctttgtctctctcctgggagtagaggctgccccaaagaaagaatctgtggcagtcctcattactcagaagtttctgctttcagtcagaaaaaggaagctccacaaagacttctttctgcatctgttgactctcaaatgacttcaggttaaaataatctttatgccaactcttgggttctgagtgagtccccaaggaaccatagaagaggttaggttttgctacttcattccctaatgctacttttacctcccattccgtaggtctcattcacttcactgtcctcgcaagtttagtgtctgtttttccaaataaactataacttctgggaaggcaggaatagctctgactttctgtttattagtgtgaagtcatcatctagaacagtagactagcacataatagatacttgataaatacttgtggaaggaatcaaccaaatataagcacacacacatacatacatggtaatattcattcagattttaaatatcaacatgtctaatcctaaaaatagatgtactcaagctatgtatatttgatagtcatttagcctctctgaatatatatttctttctccaaagctagaactgttaatatccatcatccctattttaaaggattcctctggatgtcaaaaaataataatgtgaaagttaagggccaggtgcagtggctcacgcttataatcccagcacttcgggaagctgaggcaagagaattacttgagcccacgagttcaagacaagcctgggcaacacagtgagaccctgtctccaaaaaaaaaaaaattaaccaagtgcagtggtgcacacctgtggtcccagctacttggaaggctggggtaggaggatcacttgagcccaagaggtcgaggctgcagtgagccatgatcataccactgcactctagcctgggcaacagagccagccctcatctcaaaaaaaaaaaaaaaaaaagttaaaacaccttaaattagttagagtatatattgtgtttagtcaaacttactgcatctttcttacaaaatttattttttataaacaaatcgatcagagggggcatcatagaaatttaagggcaggaaaataatggaatatgtaaactacttgaaacaggatcgttagagataaggaagtcaggctagaggaagagttggtgggaaggaatagtgaattcagtttctactcatcattggggaagaagtgttgattagttaccttcgaactatccttttgtctcattcaactaaagactgaaggagaaagaaatatgaagctctgggaaaaaccaacatgttgaaggtgagccatgtaaaaaccaccataagatgcctgaagctacactattttctgaattataattctagacttgacctgttcaatatggtagccactagctacacataactatggggtatgtgaaatatagtgaattcaatgtgatatatgctgtaagtgtgaaatacacaccagatttcaaagacttactacaaaaaaagaatgtaaagtacctcatgaataatttttttttttgagatggagtttcattcttgttgcccgggctggagttcaatggcatggtctcagctctctgcagcctctgcctcccgggttcaagcaattctcatgcctcagtctcccaagtagctgggattataggcacccgccaccacacctggctaatttttgttgtatttttagtagagatggggtttcaccatgttggccaggctggtctctatcgggggaaccagcccccagtatttcaacgtatattcttttctattttccctaagtgttggctggtctgagaaataaagagaaagagtacaaagagaagaattttacagctgggcctccaggggtgccatctcacatcagtaggaccgtgatggcaacctcgagccgcaaaaccagcaagtttttattagggattttgaaaggggagggggtgtacgaacaggaagtaagtcacaaagatcacatgcttcaaagggcaataaaagatcacaatgcaagggcaaaattagaattactgatgagggtccatgtcccgctgtgcacacattgtcttgataaacatcttaacaggaaacagggttcgagggcagacaaccagtctgactagaattcaccaagatggaatttcccaatcctagcaagcctgagggtactgcaggagaccagggtgtatttcagtccttatctcaacagcatgagacagacactcccagagcggccattcatagacctcccccaaggaatgcattcctgccccagggtatcaattattaacattccttgctgggaaaagaattcagcgatatttctcctcctcacacatccatctataggctttctgtgagaagaaaaatatgctctattctgcctgaccctgcaggcagccagaccttatggttatctttccttgttccctgaaaatcgctgttattctgttctttttcagggtgcactgatttcatattgtttaaacacacatattttacaatcaatttgtacaataatggtcttgaggtgacgtacattctcagcttatgaagataacaggattaagagattaaagtaaagacaggcttaagaaattataagactattgattggggaagggataaatgtccatgaaatcttcacaatttatgttcagagattgcagtaatgacaggcataagaaattataaaagtattaattttgggaactgataagtgtccatgaaatcttcacaatttatgttcttctgcctcagctctagctggtccctccattcagggtccctgacttcccacaacaggtctcgaactcctgacctcaggtgatctgcccgccttggcctcccaaagtgctgggattacaggtgtgagccactgcacctggcccatgaataatttttatattgactatatgttggaattattgtattatggatatatattgagttaaataaaatgcactattaaaattaatttcatgtttcttcctacttttataatgtggccactagaaaatttgaaatgctgtatatggctcacatttttctattagacagcactgagctaaaatattgtattagaagactgccagaatgtagttcccacactcctgaggatcctgggcctgtgagttaaatcacaaggagacagtggtagggattccagtaaaagccatcacaaatagagatgccatccactatcaccatcatttcaaagcactaaaaagaatgcctaacaacacaaaagtgtaactggtacaatctcagaataaaagagagtcctttccattgaataaattgccttccaagaacaactctgtatatggttcttattttgcccatttcgatttagaccagggaatcctttgacatggagcagtacttgggaaaactgccttacagatctctagtccctccctctgagtatgcaggtgaggaaactgaggcaccaagaggtacagtgattcacccaagatcacacaggacctgaacccaaagaatagacttcacctcaaatgtagtaagtggtttgaaggggaagcctgactgaatgcttggtaaccacatattgtaggactgaagtcggtggtgagcactggtcattaagatttcaattatacaagcagtaggaatatgatgttgctaaagtagccaccattatacctagtttcttgaattcatattttagaaggataacgctaacagccttattgtcacaaagtgcaaatctcttcttacgattctcttcttataatctttcaatggtttctttttgcatacatgatgtattggaatcattttagcccggtttggaaatactgctttttgaagtcaggctgaattgaattgtaatattgactctactacttgctagccaagagatctctagccaggtacttaacacctcaaagcccaagtctcctttgtcaaatggagttgcaaatcgtgttgacctcatagatatttgggaaggattaactgaggtaatgcttgaacaactctcagcatcttgattacagttagctgaaagtctaactgagggttgtcattgttgttggtattgtcataacttgcctcccacccaccctgcccctcatttcctgtcactccttagacatgaatccaagagttaacaagcactccaaatttcctgttttctggacactccaagtttttacacatgttattttctctgtctataaagagtacttgtcttttaggatttagcccaattctctaattaaattcttttgaagcaatttcaatgaaattctttccagatattgacaaaatgatcctaaagttaggccaaaagaattgacatgaaagcacagccaataaaaggggaaaaaatgtgtaaggagaaggaaattggccctaccacatgaagaggcactataaatctacatttggaaggggagaggaagaggtaaaaaaaaaaaaaatctacaacatttgaaacacggtgatatcacaagactagaatacaaagcccagaaaaaaagactagacaggcagatagagatttaggtatagatatggatatataggtgtggacataagttttggtgtaggtatagatataaatgtaggtataaatatacatagatatagatatttatatggtttggctttgtgtccccacccaaatctcatgtcaaattgtaatccccacatgtcaggggagggaactgatgggaggtgaggtggatcatggggcggatttcccctgtgctgttcttgtgatagtaagtgagtttttatgagatctgatgattttaaagtgtggcacttcccccttcaccctctctctttctcctgctccaacatgtgataaaggtgcttgcttcccctttgccttacaccatgatcgttaagtttcctgaggcctctccagccatgcagaactgtgagtcaattaaacctcttttctttgtaaattacccagtctcaggttgttctttatagcagtgtgagaacgaactaatacagatacagataattaacacatgtaaagtctgaacacctcagtggtgtaacataatctaatcagaattcagtgaagtcattagggaactttgtcccattctgtcaaatggggcacacattccctccatctagtagctctgtatcctgctagatcctcaaaatcctctgctggatactcaacatccatccaccaaataagatagagaaataaatacagactaggccagcggttaacaagctttttcagaaaaaagccagaggataggtatttttgtgacacaaagaacagtgtatggcctgataaattttgcagacctcacatagctcagactgttctgaactttttcttttctcaattcatatgtgccaaggtgggaaagagacagggatttgcttaacatatggcattgtctctcctataatacagtatatgaatttaacatataccatcagattactcaacatatgggtatgaagaaaattggctgtttgagaaaaaaaattgaatctcacctcatgccacaaactaattaaagatgaattcaataatcaagtgaaaaaaagcaaaattattttaaaaagacaaaattgatttgtacatttctttgttcactaaatatggaaggatggtctaggtgtgagtaccgtagacaaaataacaaaacagttgatgctatatttgtgaacataattttctgccttctgaaagataaaaagtagtaagaatgaaattaaaaggcaagcaacaaaaaggaggaaaatatttgtcagaaagaggatagaagtaatatccttatataaagagctcaaactaataagaaaagtaccaaaatgctggttacaaaaatgggaaaaaatacttttgaatagataatttagagaaaaggaaataaaaatattttataacctcataaattatcaaagtgtatacatttaagaatgcaatgtgattctatcctctttctcctaataaaagagattttaaaaaaatgtttagccagcacgtgcctcacactttgtaatcccagctacgtaggaggctgaggtaggaagatcacttaaggccaaaagtttgagaccagtctaggcaatatagcaagatctcatctcaaaaagaaaaaaatatattggcattggctgggagcagtggctcatgcctgtaatcctagcactctggggaagcgacgggaggaggatcacttgagtccaggagttcaagaccagcatgggcaacataaggagacccccatctctacaaaaaatagaaaaaaaagtaggtaggcatagtggcaagcacctgtggtctcagctactcagaaagctgaggtgagaggattgcttgagcctgggaggtcaaggctgcagcaagccatgatcacgtcactgcactccagactgggtgacagaacaagaccctgtctttttaaaaaatgtttaatgttggcataattcagtaagaaaatctcatgtcctactgattaaaataaaatatgtaaaaccctcctgtaaagctttcgcaataggcacaaagaactttaaaaatattttgactcaccattctcacttggactcaatctgaaagaaataatcacaaatgcacatctactgtatatgctaacatatctaacatactgttccagacaggactacatttggctgcctgtaacagaaaccctaccatactgaattgaacaaaagaaggtgatgggggtatttttctcgtgcaagaagccaggcatttggcagtcccaagccgatacagttgtttgagaaaatcacccaggtagcttcttgccctgccttctttaggctgacttttgtcttcatagtctcaagttccaggcaggaaaaagggagaaatttaagagacaaaagactcatccttgggaggttttgtctcttttattgataaaattatcgtgtctagataaaattatctagaaatttatggctctatctatttggcccaactatgttacttggtccttcctacctctgaaggaggtcagggcagagaatatgtaaaacaccggagctgcaaatgaaatttgggtgttctgttagtcaaaataaaggtaacagtggatattagacgggcaattccaagggttgggcaaacacaaagatgcactgccaagatccccttccaaggaaggacttgctatctcactcctggaatggggtccacagacacctccacccataaggtcacagctcagaggctgcacaattatagagagtcacttcacccaatgtcccctgcttcccagagcagcctgcatctgatgcctgagaaagacagggacataaagacacaaccatctatatcccacatgagacaattctgatctgcaacgcttgttccagagctctcagccaggttgtccaaggatttgtagggcctggattgcagtttggctgctttgtctgcccaatcttgcttcttcccccttctctttactgatgtggatctctagtaagtatcttcaccccaaattccacctcagcatgtgtttctggagacctcaatctgcaacaacaaagtattttttataatagtgttgggactaagggaaagctttacccttgccctgtggaggtttgctgaaaatttcagacaagaggcagattaataggagaaaaggcatacaattttatttgatcatagttttacatctgtgggggccatgttgtgggcataagaaaggtagtcaatgtatgtgggaagctgctggtctcagtaaacctggaagtgagtcatccatgttgaccaacactagatctatgcagaagatattggtgatgatgaagcctagtctcttgggcatataagagatgaagaaggtggaacctaatccattgaccccgaaccccttagacacagccccctgcccagccagcacacccgagccttaagggttgatggtgacaccaaacccccttccccagaaggatggtcagcaccaccatcagctctcaagatcacagactctgagccatggtgatgatagtgactcacatcccaatgccccagacccacaggatcagagtcttcacattaaccagattcccagatggctcacattctcatgaaactgcaagaggcacagacacatccttgttaaacacaaaccttctcatccactggtccactggatagaaacctaattttggatttgtgtctctgcatcccaccctatttctttccatcttgtactacacaggtaggggtgagtgtgtgtgtgtgtgtgtgtgtgtgtgtgtgtgtgtgtgtgtatgagtatgtggggtgtaggggccgaggggtcccctgaagtttcactgaaaaaatcaactcacaaaagacagattaattggagaaaaggcacacaaatgtatttaatgtatacaaataggagccttcagaaggaaggcccaaagatacaggggaaattatccatttttatgcttaggttcaacaaagcacggacagcgtgtagaaacagggttggacaaaaagggcctgatctaaagctaatggactgagtgtggaaacccagcaaggcctgtctgtctagattcttcttggcctctctgagcagcgttccttccttctgggtgtaaggcaagaccctctctggaatgggggtgttatgacctacagtcaaacaaggtatgtcagggaatttcgttatggccagtttttacacagataaggtggagggaaagttagagtgatatttttagattttatggctggctttggggaaaagcagttttggtttctatgatccaccttggggaagaaggattctagtttctatggctagcctcaagggagaatgtgactgagagacagaagggaaggagaaggtcagagagaaacttttgcttctgaggccttcattttggggtattgttttctgagtcccaacaatagtaaatacacagcaatagaaaaaattaatactttatagtataatgaactattatggccattgaaatgggaatttacatgaaatttttaatgacataaaatattcatgacatgatatttagttttaaaaagatagaagttgtggcatatgtatataatagaatactatgtagcaataaacactaaaggagtaatgatacatgttacaacatgaagttcaaaaacactttatttagtaaaagaaggcaaacacaaaagactatgattccacttatatgaaatgtccagaaaaacagatctatagagacaggaaggagttgcctggggcttggggtgggaacaggaattaaccgtaaataggcataagaggtcttactgggtgttaaaaacctgaattttaatgatggctacataacttgtcaaatttactaaaagtcattttaaatgggtaaattttataatatgcacattttacctaataaagttgttacatattccaaagtaatgacacttagaaaaagacacaattggccgggcgcggtggctcacgcctgtaatcccagcactttgggaggctgaggtgggcagatcacgaggtcaagagatcgagaccatcctggtaaacatggtgaaaccccatctctactaaaaaaaatacaaaaaaaaaaatagccggcatggtggcacacgcctgtagtcccagctgctcaggaggctgaggcaggagaatcacttaaacttgggaggtggaggttgcagtgagcggagatcacgccactgcactccagcctgggtgacagagagagactccatttcaaaaaaaaaaaaagaaaagaaagagaaagaaagaaagaaagaaaagaaaagagagaaagaaagaaagagagaaagcaagcaagcaagcaagcaagcggcacaatttaaaaatatatacacctccactatacacccaactagttgaattttatctctatctgcctgtatgtgtatcaaactgttaatagtgactgtcacttcattttttagttatgggtgatttttattcttagatagatcttttaatatccacattttctacattgagcatttattccttaaagcagttaacttacaaacaaacaaacaaaaagccaaaacgaaacaaaatcttttttaaaggatgaagtgctgccaggcacggtggctcatgcctgtaatcccagcattttgggaggccgaggcaagtggatcacttgaggtcaggagtttgagaccagcctgtccaacatggtgaaaccccgtctctactaaaaatagaaaaagtagccagatgtcgtgcacatgcctgtagtcccagctactcatgaggctgaggcaggagaattgctcaaaccagggaggcagaggttgcagtgagccaacgtcgtgccactgtactccagcctgagagcctgcctcaaaaaaaaaaaaaaaaaaaaaaaaaaaaaagatgacgtgcaattccttctgtgcagatcatctcctgcccttccagaatggctggaacttagtcttcaactcctacaagcacatgttaaatcacagagtacttgcttgtgtgtttatgtctctgtgcgtgtaatatttaattgaataatgagagaaggtccaaatccaaagaggaggaccaaagacagtagcttccagattcattctttttctttttcttttttctttttaatcaagttctcactgtgctgcccgggctagagtgcagcagcatgatcatacctcactgcagccttgacctcctgagctcaagcgatcctcccacctcagtctcccgagtagctgcaactacagatgcatgccacactcagctaatttttaaacttttttgtagagacagggctcactatattgccaggctggtatcaaattcctggcctcaagtgatcctcctgctttagcctcccaaagtgctgggattacaggtgtgagccaccatgccaggccagatgttaatgattctgtcattaagagttgatagaaacatttgaagtgaaactttttatttctagagaatcagggctgagttcatccaagcattctttcagaagagtgacctttcaagggttgaaataacagctctcacgtaaagtatgagagatttcagttgagatcaaggaagagaaaatgactacaattgagcacagtatgccaaagttgactaaaagctgattactgttaaactggtctataagttcagttaaagctatactctccttctagtttcacacaaatgactctcattatttcaggactgtgtgtttaatcaacttccacccaatgccccagatttgaccctttgcctgtggattgctctcttaccagagaggtaatctgacattcaaatttgtccatatataacttctagaagctggtttaaaagcactttcaaagtattgttatacgagaagttagcaatttgacttccaaaaataagttgtattttaatatattttttaaaatattaatgatcagggaaaaggtagtgagagtacagcatagaacattacatgaacaccatgctttttcttttctgatatccttgtctccattgaactatatcctgctaattcactgatttaaatgtgagtttatttattattctcactgaggtatgactaatttggagtcaaattatatttattttaacgagctatcttttttaaaatgcattttatgttgctggtgctcttgtgttacacaaatgaaaaataaaatttttatttttacatccgttaaatactttgcagcaattaaatgcttacagatagctgaacaataaattcttcccacaagcagaaaaaagaaaaagtgctttgccagggagcataataattaggtttcaattatctacaaagaaaaaaaaaagataaaaagaaaggaaaagaaaagaaattaggtcaaactttctgacaatcaactcaggttattgtcctctgaggttcattttgaaatacagtttaattttctatgcacatttattataagaatattataagctcacaatcttagaaaagttaaattgcaatcccatcacagaaatataaccaatattaacatttttttttattgagatggggtctcactatgttgcttaggctggttttgaactcctgggctcaagcgatcctcccatttccacctcccaaagtgctaggattacaggcatgagccaccgtgcccaactcatattaacattttgatgtagcttctcacagaatgttttcactataggcacaaacaaaagatattatttgtttttacacaaaggtttattcaacaaatgtttattgagtgtctattaagtgccagtgttatttctactgaatgacaccatagctacactgccaactcagcattcactatcatttgaatgtcctttcgtgtgaataaatttggatgtgctatatcattttaatgactgtataattacaagtgattgtactctccaaaatgacaacagcaacctttccattcgcccccgcatactttctgaacctcaccatgccccaccaagaggtagaatatatggccccttaccttgaacatgggtgaagttttatgactgcctcagtccagcagaagtaacaccatgtgatttccaagagagattgtaaaaggtgatatgacttctgcctagcctcctcttagaacattcacccttggaacccagacagcatgttgtgagggagcccaagccacatggagaaactgtatatatatgttccagctgacagctcccactgaggtctcaggcaacaaccagcatcaactgtcagccacgcaatgagcgagtctccagatgactgcagcctctagacttcgagccacagcagctggtgccaaatagggcagaggtggctgtacccactgagcccttccaaaaatcacagacttgtgagcaaaatacacatggcttgctttaagccactaagtgtccaggtggtttgttatgcagcagtagataaaaggactagcgataggcctttgaatgaccataccacaatttttgtaaccaattccttaattttagacatttttattgtcacaaagtgttttgatgttgctgttgttgttgcctttaatacaaacatcacatatatatacgtctgtgaacacaatagtgtgtgtagcattattattattattattattattattattattattattattattattattgagacagggtctggctctgtcacctaggctgaagtgcagtggcacaatctcagctcactgcaacctccacctcctggactcaagccatcctcccacctcagcctgctgaatacaggccgcgccaccacacccagtgcatttttttatttttatttttggtagtgacggggtttcaccatgttgcctaggctgatcttgaactcctgagctcaatcggctcaccttagcctctcaaagtgctaggattgtaggcgtgagccaccgtgcccagccaccttatttcctcaatattatttcccagaagtagaagtgcaggccaaaggatatgaatattttaaggaactttgatgtgagcttttggcagttcaatttaacgtagtttagtagttcacaaatatgtatgacctaaaaatagttaaacctaaaatgctatggcaaaatcaatcactacaaattccatgactgaaaaggaaagatcactgagtatagaaaaaacaaaaaacaaaaaaccccacaaaactggtaattctatcataaagaagttctggcttttaacttaaagataatacattcaaacatttaaattttttaaagtgattatgcaaacacgaattttgagggtgaaagtcttactgaagtctgcttccatatttgtcaaatataatccccagatggttcccaaatacccttggtcactaatatacccctcttcatggtaagataactttatctgatgaattttaacttcaagaacgtaaagatacgtatcttcaagcctagaaatttttcttgagctctctgaaggctaaataattctactgcagtctgaagaccttgccctgagtagggttttacactctgaatcagtgttgtcagatgagcagatacaatggcttaactggttgtggagaataggaagagctgagttaccatgtgaccatagctgatacaattgttgctttaaaatgtagatgcaagttttaaggtaatgcttttgcattaagtgctgcaaagtttttaagtgccatggctattctaattctttactaattacgtgtgtgtattacctgtcaccttctcataaagaatagtaataataatatctgaggtttgtatagtagttcacaaggtgctttcacatttgttttcattgtttcatttaatcttcataacaaaaccaaggggtcagcattaccttcatcactttgtaggtgaagaaagcaagtcgaagaaagctaagtaacgaggcagagacagccaggactcaacttaagatcttttaaagtagaaaccacggaagtctatcccatcctcttcagtttgtctcttgacttatgctaaaactcattacacagcaataggggtcaacaaactttttgtggaaagggccagagagtaaacattttcagctctgtggaccaagcagttcaatactgcaactactcaacagtgccattgttgcacaaacacagccatggacaatactcaaatgaacggacatggctgtgtactaatacacctttatttataccaacaggcaaaggatcgatttggccctcagaccatagtttgcccactcctgacataagaggatgagtaaacctacaggaatctcacgtctgtttctgcccttttaaccacaatccttcccttcccctataagaaactatctttattagattcttattgatccttcgagagttcctgtttttgcaaatacaagcctatgcatatatagacttcatcctcccactgcacctctcttatttccctcagccccatgccctcttcagcactttgttttcattgcctgggcatctgtctatattagtacatagagatctgatattccattttgccattgcatagtacttcactatatagatatgccacagattagtcaatctactgctgcccatttgtgtgggttccttgtattgcttgaaaatatgacatttcttgctttctctggtgattgtgtagaataggtgcctagaagtgggattgctgggaggaagggtccatgcatctataaatttgttagattgccaaatctctcccccaaccccagattggtggtggtatattatactcccagcagcaacctataaaagtgcccatttccccagagcctcatcaatggtgtatgagccaaacctttgaatttagtccactctgacaggcaataaattatacttcggtgtagttttaatttacattgattttattgcaagtgagaaagaacacctttccatgcatttaaagactaattatatgtctccttttgtttcataacctttgcccgtttttcttttgggtggtaggtttttttctcttttccaagtttaggcattcattaaacatgaaggagatgggccctctgtcccagttcattatttcttttgacttgacatatgctgttttattttgccatggaaaaggtttttaaaatgtttatgtagatacatttattgatcatagagatatataggtgtagctatagatacagacataaatatcttctagattttttactctctttgtactggacatctgagatgaatgtaggtgaaaaggatagaggtgatggtgagagtcagaaagatattagagcttttactcacaagtaagtttgtatccaaaattcaaatggattatccaggtattattttaaatgttaagaccggtggcaggtactggtacagagaacaactgagaatagagcaaaatggccaaggaaaaggagggaaaggaaactattttatatcaagaaaattatgatgctaaatgagttctagtaaggctgaaacacatgatatagacactttaagtatttttgtagttgcttacatataattttatggcaaaatgtcttaaattgcgtataacaaagatattagtatcattgagctagtgttcagtagtgctccttttgaaggttattattctgctatcatgttacaaactttttagaatattgagttctgtgcttttgtttggttttgtctgaattctctgcctagtatgttcatctcatcctactcccattactccagcaaaggggaatcagaaaactgaggttaagaaagatagctaagttatagcatttgctatgcacctcagactcatttttgctattgagatggcattgtcaccaagcagaggcaatttttttttctggagaggagaggcaggacaggggcctggggtggggggtgcggccagaactgtgatgtcacagattgcattgtctcttgggaaactcatccatcaaaccgtcacctctgattctatgcagggtcactatgaaagaggcagcctgccccagtttgggtattctgaagtgttagtatgtagtggagctggtggtgtgaagctgattcattttgtttcaaagccccaaatggcatgctgccgaacacaggcacaagcacagcagcgtctccttagaaataatgactccaaggcaaacagccctcattgcaaaatgtagaagactgccatctgcttgtctccactgtggtttattcgtttcagggttttaaatgacgtaataaaaaggtaagtcttctttttaaaaactggaggggtaagtgggaattccagattgattatagcatatctggaatatatgtaagatatttgccttaagttagaagaggatttgaatttataaagtgtgaatattattttcaaatgcaagtgcaaatcctgtcctgggaagataaggtaaaatccatatcttaaagaaggtcatgccttacaacttagcaattttatttggtattttagaaacatgatttttaaaaaaatgaattttcataaagacagtaattttccagatgtttgatagtacatatcgatcactttttcatatatgatattccaccttttcttgatgtttgcaatctgttttcagcttttggataagttaaaaacaagcagctgctataaattgtcaagggctcttaaaatgaggtgccagatagatttgggaagcgtctagctgatttctacataactcgtttggaattactctgttatgggagggagtataaagggtcataagactcagatgaagtttgaagctgaggtgtcccctctcccatccctgagggatagtgaccagggtttggagatataggaagaagcaaatgcacacctccgtgcctcgccatgacctatcgtattccagtcgatgaggagtccagagggctgggatccatgactccctgaggattcgcctggcaggaatgaatgccagcaaacaccccccttccacccctcccctcctagctccccaggagaggcgcttctgcagaagtcatttggtgtgtgtgctggttttccttgtgagaggattagagaataggagagtgctttgtgagaaaaatcctgggagaggttgctgggaagaaatcaaacagagggaaggaagacttcagctttcagagtcccctcagtcaagtaagtctgagacccagttgcctggcctagagcagctgaggggttgtttcctttcgtccacactaggagaaactggtaaggctcattttattctctactgctctgggatgctactgtaattgctttactgaagcgcaggggtcagaagggagggaagttggttagtgactctgcggacgtcctgcatcgtctctgtctggtgtatgaggacggcgctgtttctggtacaaagggctggtagccacagaacaattttacttttcccaaacttgattagcatcacttctgagcaactgacttaagcaaaacgcatgcccacgcaaaaactataccccatagaggaatgcacttatctatcagatactcggatctttaaagcatttctatctcaatttgattagtttggggggtacaacttcaggagagtgagagaaaaacccggtccttctggaaatttttcaattgtctgtttcctgtgagaatgtatttttgccattgtatgtatcacctgttttgtaacaagagccgttcagatccaagccactgttaaaaatccaagtagtacctagcgcaagttcaagacactgtgaaaggaggggagagtgttcacactcaagtgaggaaaatggaacttgaagaactttatattctttgtctgtatgcagaggagttctaattggaaagaagaaatgaggaagctgccctagagtcagaaagaataggtacacgtttccttcaacattttcaaagaatcagctcatgcacacagccttcttgggcaaatgttgcttcttactccctaattccattctgttatttctagagctgactttcatatttgtgtgaagatatatatagaatacattatttatattacttatatatttaaaatgtatatgtatacacacacatataaatatatccttttatcatatcctggcaaacttgagcctgaagagtttagaaatatattgattcagtctgaagcaaattatcccttaagcaagctacaaaagtccttctgagaggcgtgtttggagttgggggctgtgtgaagaagagagaagtggcagacagctgttgtttctgtgatggacaagtccagaagcctttcctcatagctgagaaccaaattcctaaaaactctgcgcaccctcccccatccccaagacagggtggtaatctttgttgttgtttttgccctgagaaaatttgagtgctgcctaatttagggggctctctgcattttttcctcctcattaaaataaaactagaagcattgctaaatgcaaagttctgatgatggatgttttgtttctaaacttaacatatgccaatacacttattatcatttcagttgaatctgcccatcatgaaaacactgatcaagtaaaatgattcaacacaaattattcaagtctgcaactgttacttcagtttacttaattctacagtcttaagatgatgtgcttattagaatattcaaaaattgaaaatgcatgccatttatttcattaataacaaccaggttatttaaactataggttataaaatataggtttcaactacaggttataaactatttaaatacagtttctttgcatgcacattgatatgaaaacctgaaaaaatatatgctttttcttttaaaatgaaataattatttgcctgagatatcctttgccaaaaaatgaaagtcaattccctttcaatttcagttttttattcttttctcaactgaaaatgctaattcaaccaaacgatgttatctttgcctttaggaattgtttacggaatgctggcagtcaatttgggagtcctgagtgtgagataacagttaatcaatttatctgtgaactgtgaagttttcaggttttgatcaacattattcactattctccaccccatgctcattctggttataaagactatttaccttcattattatatttgaacctgagagcgtcaagtttattagaattgattttctttccaggttgatcttctgaaatactttggccatttttcactactgccttatgaggttatcattaatctggcatatatttattgagtgcttgggtgtcactcatatggcacacgtttgctgttagagatgaaagctatgttttgtggagtttattgcagaggcgaccaaggctagaagggaaagaccaactcgtgctgttctaacaattgtttgccagctcccgtggttcagttgcgaatgtggtttcagcaacaacgaaaaactcttaattcttctgaattattgatacattaaaatatgttactggctacttggaacctgtgagctgagttaatcaataaccctctcacattgcacaagacccactgtgtgttattctcatcactggccatttaaataattcaaaagaaaggtttctcgtgaattaaccttgccattgcacaaattgggaaaatacagaacaaaacattccagcatccttaatctttagagcttataaattactgttccttctcatttttttcttgatgtattagttttttctgttagatgacttttgttaaatgttttgatatatcataataatacacataatttgcaataatgtcagtaagaaaaaagaatcatgggaaagaaatgaacatgtcttgaatccaccatataccagacactgccctggcccctttacaagcatgttatcatttactcttctcaacaatactgcaaaataggtattattgggcccattttaaagatgatggaatgaaggaccagagaatttaagaataaattcatgccacactactaaggtagcaaacccaaatctgttccctgctccacaaaagcactttttagcacacttctatattgctctcttaccagccatgtctttcttcccagatctcgtatcaattgagaactcactatagcttaccttaatgcttccagagaatctcccttgacagcttctgcctgttccctatcttcctttatgatcagagagccaacacatgtaactatggattggacaggcaccatatgtatttacgtgtaaaaatggcttttgaaacatcaaggtagaaacatcatattaggttaaaatacagaatacagtattttagatttgctcagttaagagaaattacagacttggtttagtttggtttctggccatgcctgccctggtttccaccagctatccagtagggagccccggtctgcatgtacgctgtgacatatttgtttgtatagagatctgcttgtataaagatctaggtttctataccgacacagcctcactttctgcccccagcaggtgagcagaagacaggatggagttgtagaaaaatgcatcccttacccccatctgaagttactggttgagggaaagaaaatcataacacatcattaataaaaagaattctaaatatatcagtgcattagtctggtactctcatagtatagtcattcatttaccgcaacacaattatttagtcagcactatctatccaattgccttgtgtactagtttccgatggctgctgtaataaattaccacaaattattaaaaatttaaacaacacggccaggcgcagtggctcatacttgtaatcccagcacattgggaggctgaggcaggaagatcacttgagcctaggagttcaagaccagcttgggaagcatagagaaacccctcctctgcaaaaaaaataaaaagttaactgggtgtggtagcacatgcctgtggtcccaactacttgggaggctaaggagggaggatcctttgaggccaggagtttgaggctgcaatgagctataatcatgccactgcactccagcctgcccatctcaaaaaaaaattaaacaacacaaatttattttattacattcctggaggtctgaagcacaaaatggatctaaaatcaaggtatcagcaggcctgcattccttctgaaggctctagacaagaatctgttccctgcttttccaacttcaagaggcttctggcactccttggctcatggcgctgcatgtttctgactctgcttcattcgtcacattgccttctctgactcttctgcctccctctttccactataaggacctgtgcaattacactggggccaccaggtgaccccatggaaatcttcccatcttgcatccttagatctaaccatattgaaggatgtcgaaggatgtggttaaacatccttagccacatctgcaaggtcccttttgccatgtaacataacacatacaaaagtttgggagattagaacgtggacaactttggtggggagcattgttctgactaccacatcttctttcaattttttttttttttgagacaggatctcgctctgtcacccagattggagtgcagtggtgcaaacatggctcactgcagcctcaacttcctgtggtcaagtgatcctcccacctcagcctcctgagtagctgggactataggcatgcaccaccacgctcagctaatttttgtattttttgcagacatggggtttcaccatgttgcctaggctggtctggaactcctgggctcaagcggtccacctgccacagcctcccaaagtgctagggttataggtgtgagccaccatgcccagacacaaatttctttatattaacttgatatgtatttattccatgatcttgtaggcagtagggagccatggaaatatttcaagtggagaggtgaaatgaaaatgatcaggtttccatgttagaaagctcactgagagagccctatggagatggaggcccaactaggctgcctgttggaatgcaggagagagaggtcgagaacatgacttctgagagaatctgtagagaaaaggacaagaagtttgagaaatactaaggacagtgcattggcaggacagctgagaggaagaggtttgtgacttggatatctcaggtagatgatggggaggtagagaggatgggggactctgagaagatgtgtgtatgctgcactaggacctggggatagaacaccggccagaaacaccttttctcctaagaagctaaaagcccatctgtgaagacaccagtaataataataggaataactcatattcactgagtactttagcttcttccaagcacactacatttaattttcatatcaaccctctttggtagacactagtaacattatcatctcagttttctgatgaagaaactgaagcaaggagaccttacgtgatttgcccaacatcatgcaatttgtaaggagagagaaggcagttgaagtcaagtagtctggttccagaatccatggttttaattcttacactctactgccttgcttaacaaacaattataattttgtgagatatttagtatgagagctacctgtacatttaatgggggcgggagcaaaccacagggttagcaattactgctatcaagatgaactgtgaatttttctgaggcacattcctgtagaagcctggctatcagtagggtgtgatccatgacaaaataaaacatttatatggagcattagcctggaagcctggacatcagggcaaaattggagaaagttcttatttccctgctgtctaagaatttataaccacactgagaaaaccatattgcaatcataaaaaatagatgaccaaaaattaaatggttccaaggccctctggataaatatgaagtgagagcatagttcttttctaaaagagagtgggaaagaacaaggcaataagaaggtcaagatgatgggatgcagagccattgtgtacattcattgaatgacttaatgtgttatgcacttgcattctcccatttccaacaacactataaaataatggcagggtgaaatttgaatcccaaggtctctcactctgctatgtgtgtgtttaaagaatgttgggacagagctccctttgaataaaatttttaaatgccttaggaatcctaaaatgatgcttacattttgtaagatcttgataccttgacgtagttgttcttcattatcattatcattgactagttgttgggtggagctgccctgggcgtgtgaagatttcagtatcactcaatataggtgggtctttaaaagaaaatcatgccaagaaagatagatgtaaacttatttttttttacattctcttttattttctttaatattctgtatctttgtagaagctataatatggaattatagactatttacttatgggctttaaaaagcactgtggtaatcattaggtaataaatttcttaccaagagatattactgaaaggaatgtggtttttattcttttatagccagatcaccaggaagatatgagaccttgccatttaagtttgctttttaatttgtgtaacagaaagattcacatttaaccttttctactagacatgtatttaacaaacaattatttggtatctactatgtgaaagggacacattttattccatttgttccttgcaattcttgttcggaaagaccctctttacagtggaagaaggagaatctcagagaatggcccagctagacttgaactcctgtcttctgtctcagcccagaagacttgctcccatgtcctttaacctacttagctaagacagatattcaaagccactgaggaaggactccatatttcttcatttggaacagcaaactaggagagtttggttatatccccatgaccaatggtaggtatatcttggggcaattatctctatgctaaaatcaatattgctatttatcaagataatctacagcttgccttaaagatagagaggggatttcaaagtctatttgttgaaaagattactctctggaattgtagaatttgcttcaaagtgagatttgcaaaaaatatgagatttataccatagctgtctacccaatccctgaaagatttccattcaaggtgacatctgttcaggcttacacactgcttacctatgtgttggtgaaacactttctgtgaaccttctaaatgttctcacagcactctgacttcacccaatactcatgacaagaagaggacaaagctagaattattataccagagtatctgaccctgggttcaatgctgagagtgggtcacaattagttttaatagaaaataacatataattactgacaggtgccttggggcatgggaaaatagcatttaaaataatgtttttagtgatacattgcctacaggatgacatcatgcaagcttaatggcaatgcttgaaggtgagaactgactatgatgttgaaagggaaagtttgttcagatttattcatccaccatcagggaatcaaacgtgtcctagatttcttttttttttttttttttttttttttattttgagacggagtctcactctgtcgcccaggccggactgcggactgcagtggtgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattataggcgtgagccaccgcgcccggccgtgtcctagatttctaagactaacgaaacaagaaactaaaatctactattgaaacctaaataaatacagttatcaatgtgctgataagatctgcaaagactaatagcataagcccttaatgaaaaattattttattcaatgacttaccaatacaaaggttagatatccttacatcaaagtaatactgtattattcttccctatagttctgtaccacaaggaaaaattagtgctttatttttgctaattcacaaatttgttaaagtgatcaacaaatttaatttccatatacatgtgtaacttcaaatgtacagaggcgtgaagctactgcaaacacaagcttgctcactaaattttatttgataatatctattgccttgccatataacagcaagagcaaacattctaaaacttctaagtaaaaggaaatcatccgtctttttaaattatgtgaactttaccttatttgtaaagtactgtatagaaccaagaaaagtgtgggaaattggaacataattggaacataataggcatttaagccttatattttcacaacaaaattgccttaaattaaaataaaaatgatatgcaaataggatttgtttatccaaatgtgggcaaaagggctgtaaagataccagtatgtattagaacgacatgaataatttattttataatgtaaaacctaataaagatttaatgatcacccataagcctttaaaattatgtgagtaatagcactatggcaagcaaatacaggcagctattacagctctaccaaaactctgtttataactctttgtatgttactttttggaaagggtgggtcacagaatgatgtaataaatggttgcaaagaagtttctgtcccaagatgcgtattcagtgaattctagagctcaagctgcttttctctaaaaccatgcaatacatgcctttgcttcaggactggactaaccattttctgatttataaatttaatgatttcaatattatggagtaacttcagtgaagaaaaattgttttaggggcttactttcctgcaacgattattgccctattgcttttaattccatttgaatgcatgctatggagtagttgagttaaatccatggcatcttggttattcttcacggatgagttccagttctttgggtgatacaactaaaagctcacaagatgctgtgtatcggcactgaaacaatcagtctttgagctttggggaaattactcaagcagcgaattaatcattgcgattctggtcccccttcacaaatgctaggtctccgaaaagactccccccacacacccctgttcctggtgctcttattaaaggtgtaaaatttcataaaactttagtaaaacattatgaattctctttttgtgcaatacagctggtatttcttccagacatatatttccataattaaacatcctaaaatacaaatcccattattatttgttatgtctagtcagtaattagacctcagctggtagggcaatttcagaacagagtttaccaatttacatactaatccagcagagtctggtgggacatgattagcatagattcagtcaacatcttaattagccctaatcccagcatgcactccgaggtgcctttaccccacccccactcatgtaggtcttgtttagctgactattttccttcaacaaattccagctcttccaaacatattttccagtgctctttttcacagaggagatgattacatctcaaagtggtgtgccagggaggacattttgtgtaaagccagggaaatgtgaggcattgggccaggcgaggggtgcatacacaagtctgaagcaaaatcaaggtaccagaatctgttcttctagaatgttagagtatacccacttccctgtcccacccccaactctaggtagcaagatctgtaaaccattccaaacctgtgagaattttacctattttgtaagaagaatattccttattcctgtccatgatcaggagcccatttcatcatttaccagctttcatgtcaggaaattccttatacctaaatgaaatcccccatattgcatatttaagcccctgcctttctatccatccatagtggaaacagagaacaggtggccacctatgaaaagctcgtcttatagctgaggaccgtaattaaattatctcctttaccttctcttcttcaggttggatttttccagctcctcgactttcctctgagctcccttttcttcacctctttgatctttgtggttttcctctgaactctttccaagttccccacaccccctttaattgtgctcagaactaggccgagtatctttgaaatcatttgaatggccagatttcctcaggataaataccaacacttgagtatacctccatatccaatttacttctagaatcagtgcctgctgttagttagctggctagtttcacttattcctcttccatttttcaaaaaactcatttggtgtgctattgcataatctagaggggatttcttctatttgctttttttttttttttttgcagtttatcaagggcactttgagtttcaatttcaatttgcaaagctataaactaccagtatctcctgctaaggtttgaagtcatttgcaaattcaatttgagcattaccaataaattattgcacaatcctaggggaaagacatcaatagcgactgagaagatcccaggagattatcacttgctaagaccttcatctcaagattcttctctctgctttccctgttctctgccactctttcccactttgacctttgtcttatgacatagcctttccctatttcactcttttttctctctctttttttatttttacttattctttctctctcatcgtgtcttgcgttttcactcaacactttccagccatcccctgcttgagattgttccccatccagaaaatgtgtctggtcatagggaagagacaatggaataagagaaacatcccaaacaattttcctttttggctttgtactgacctagctgaaatcaggtcacgtgtgtcacagaaaaaagcaagtcaaaagtgctgactgatggatataataaacatcagggcaaagaagtgaagatggctacttggccaggcggggtggctcacgcctataatcctggcactttgggaggccgaggtgggtggatcacttgagcccaggagtttgagaccagcccaagcaatatggcaagacctcgtctctacagaaaataagaaaattagctgggtgtggtggcgtgtgcctgcagtcccatctactccggagactgaggtgggaggattgcttgagcccaggagatcaaggctgcagtgagctaggattgcaccactacactccagcctgggcgacaaagcaagaatctgtctcaaaaaaaaaaaaaaaaagtggctatttgagtctagcagtgacaggtcaggaactgtttgcagcctcgaagcctcaagacctttctggccacacaaaaagagctagtcagagtgttgcgaggttcgtgtgtaaaagaaccagccgaattcacctccagactctagcttgacttgtcaggggccaagcatgtgttttgaattccagaaggtgtcccagcttgctttaaaagtcagggtctgtatcaatctctgtctagaggcttaagaatccttaagattataaaaggtttattcatatggttttggagatttttttgaaatagttgtacatctgtgagcaagaagcaagtgtgagggctttgacctagatgtcttcatagccaaaaatatctcttgctattaagagctacaaaaacggttcaaatatctcatattgttgcactacttcaggggctacagatggaagatcaaatgccaaggatgatgttgtgaatctctgtttgactggttggttgatttggtttgttttttatttttgtatggccgcttgaattgtgtgtgtgtatttgatgcaacttaaagttttaaatttcctcaccaataaataacttacattctagatgtttaattaatatgcatatccttaatctccttgtttcccattctaatttctgatggcttttctgaaatcatgtgaggcaaatacactctcccacttttcacctgaccagacccagaagtgtgtgcaagaaaggactttgatggttagtttagtaactaccaggagccatcacggaggctttaccagctcaagttaagaaaaggattattagtggaaatgaaatatggtgcagtcactttggaaatggtttggcagttcctcaaaaagttaaacataaggttaccatatgatccaacgagtgtacttttaggtatatatccaagagaaatgaaaacatatgttcacacaacaacatgtatatgaatgttcatagcagcattatttacaatagccaaaaagtggaaacagcgcaaatgtttatcagtggatgaatggataaataaaacgtagcatattgctgggcgtggtggctcatgcctataatcctagcactttgggaggccgaggcaggtggatcatttgaggtcaggagtttgagtccaccctggccaacatggtgaaaccaccatctctactaaaaatacaaaaaaataaaaatagctggacatggtggtacatgactgtaatcctagcttctcaggaggctgaggcaggagaatcgcttgaacccgggaggtggaggttgtggtgagccgagatcacaccattgcactccagcctgggcaacaagagccaaacactgtctcaaaacaaacaaacaaagaaacaaacagatacacacacaaaacaagcaaacaaacaaaaaccctcttttaactccatagttaaaaccatagttttgcattcctagctgtcatgagtgaagctgagatttaaaaaagtaatataggactatcacaaaccaaagttacatctaacataaatgtccattcatatttcatttggctgtgattgtgtatttgtggcatgtatatgggtgtgtagggaggatgcgtgtatactcatacaatgttagcatcaacaggaccataggaatctcctaattcaagctcaatattaacacattcaatatacataggtttgatatttataatatatactgctgattgtgcaataattcttcacattcccatggccttctttaagaggccatcatagcacacatctaattttatcctaacataattctacgagcttgctagagggcattattattattctactgagaaaatgggcagctaattccaaagaggtccagctttggctcagtcttacacggcatgtgaatggtgaggttgaggattaaaacccagattccacatccttgctcagagtacttcattctggcccacaatctctaaagctacaactgtctaaatacaaacaaacaaacaaaaaacaaacaaaaaaacaaatgcaggatatccatgcatttccgtacaaccggatagtattcagctctaaaaagtattattcagctgctgatacatgctacatcatgctcagagaaagaaggcagtcacagaggatcacatattgtaggattccatttatgtgaaatgtccagaataggcaaattcatagagatagaaagtcaattagtggttgcaaggggctaggggtgaagggtagggggaaagggagtgactgctaatgggcacagcatttcttttattggggggataaagctgttctaaaattagatgttgatgatggttgtaggacactgggaatatactttaaaacattaaattgtccacattagatgggtacattgtgtggtatgtgaattgtatctcaactaaactttaaaaaaaaagaaaagagaaaggggttatgatacagagccgtgttcctaggtcactcacaaaatgcttttaattgttacagtttaaaaagaattaactaactcctattatcattttaatagaactctccctccaacatgcactgtttcagatattatacaagacagtgtagacagtgtatttagacagttgtagctttagagattgtgggccagaatgaagtactctgagcaaggatgtggaatctgggttttaatcctcaacctcaccattcacatgccgtgtaagactgagccaaagctggacctctttggaattagctgcccattttctcagtagaataataataatgccctctagcaagctcgtagaattatgttaggataaaattagatgtgtgctatgatgacctcttaaagaaggccatgggaatgtgaagaattattgcacaatcagcagtatatattataaatatcgaacctatgtatattgaatatgttaatattgagcttgaattaggagattcctatggtcctgccgatcctaacattgtatgagtacacacgcatcctccctacacaccgatatacatgccacaaatacacaatcacagccaaatgaaatatgaatggacatttatgttagatgtaactttggtttgtgatagtcctatattacttttttaaatctcagcttcactcatgacagctaggaatgcaaaactatggttttaactatggagttaaaagagggtttttgtttgtttgcttgttttgtgtgtgtatctgtttgtttctttgtttgtttgttttgagacagtgtttggctcttgttgcccaggctggagtgcaatggtgtgatctcggctcaccacaacctccgcctccccggttcaagagattctcctgcctcagcctcctgagaagctaggattacaggcatgcgccaccatgcccagctaattttgtatttttagtagagatggagtttctccctgttggtcaggctggtctcaaactcctgacctcaggtgatctgcccacctcggcctcccaaagtgctgggattacaggcgtgagccaccacaccgagccaaaagagtttttaaaaagagcgaaaaaggcaaaggaaatgagatccaattatgcctccagatttatgagaattgtaaatactgttttaataacttctagaagagcgtctgaaacagtaaaagtaagtagatttctcattcataactgtttacaaattcttttctgaacaagttgaaaattcggggtaaagagattttctttgagaaagttaactcattgtctaaaattcctttgactccagatgccaagacaaatattgagagtaatgtcatatggttctgtaatagtaatattctaagctctactgagacagcatattcttctacaagtagaaaaaatatatttttattaggtatgaaaaatagatttttgatataactttttttattatgaaatagttggagacacaatgccgggtgcggtggctcatgcctgtaatcccagcactttgggaggccgaagtgggtggatcacgaggtcaggagattgagaccatcctggctaacacggtggaaaccccgtctctgctaaatatacaaaaaatcagctgggtgtggtggtgggtgcctgtagtcccagctactcgggaggctgaggcaggagaatggtgtgaacccagaaggtagagtttgcagtgagccgagatcgcaccactgcactccagcctgggcagcagagcgagactccatctcaaaaaaaaaaaagaaatagttggagacacacaagagtttgcaaaactaatgcagagagttcccccgtaccattcatgcggcttcccccaatgaaaacatctttcataaccacagtaatgtcaaaaccaggacattgactttgacacagtattgtcaaaaatagattttcatatggcaaaatttcccttagaaattggactacaaattatcacatcatttcaagtctcaagtgtcacagttggatcaagcttttattattaaagggtataatttgattctttgtgtaaacaagcattgccctaagtgtttttttaattacatgcattgaaacctgaataatagttcatttcagcttacatttgtatctaaaaatactaataagctccacttcaaaatatatagtactatttttaaaaactctgtgtcgctttcaaacaacacttagatcattaaattagatcctcattgttccctcagaggtgacaggcattattaaaatgtattctgcatattttgtttctgtaattatgtctaatcagtgtgaattgatgctgtggaaaataattaaaaacacatatttgagctataagtgggaaacaaaggagaaactctcatagttggactctaaatgacaagaactgatagaaagttgaaatattagacaagaccagcagcccggaaaaaaaaatgtgttaataggtagaaaatgcaaaatgtctatagaaatatcctgaccttaaaacaaaagaaagggctttgtcattgtgtattctttttcccctgcagaatcgattctgaaagatgtggagatctcataaacgtctccaaagaacagttcacagcacccagggagtgaggctttctgaaagaaatgccttcccatgccgtgtaaatggcatgtgtcaagggggaaaggccccagcgctgtggtgattgagcaggggctgctgtgggcagcttcctttgtgtcctgatcatttacatgacttaaacacaacaatgtgctccatcgtcaataacacaagacgctttgccatagcaacagtttcagaatgtggcacagcctcagtggtgtccctgaaacagaaaagttccctaaagaaacactccttatgaatatgttcagagatttctttatcctactaggacttgtttcaaattccattgggtttaggttttatttgcacagcccatctttcctttgctctgtgagaaccagctttggggagaagttgggagagacacgactgtggggtcagagggtgggaatacatacatggctgtgatagaaatggaattcttaagaacattctcagaaaactgttaatgctatccagaaaatcatgtaaaattcaggaatgcaacatacatcccaaagtcattgttggtttccttgaaggtctgtaataaatggcccttttattgtttgtacattttgcttctttccatcacaacatgtgcatgtactgtgacacactttagacaatcataaggacatgaaccccacactcaatggcattgtccaaaagacacagcacatacgttatcaaagctgtgattaaactccaatacctccctctaatttcaaggtcattttctggcaagacacaattttcccgttaagaaagtacccatcctcccccaccccccttttttaagcaatagcgctttctacaagtttgaatctaagagttgttctagtgaaactttcacctaagacagcatagaagagaagaaaaacataaataattttaatgataagtgataacagttgaattatatttggctatgtaacatacagtggtgttttacctttaggggatagttagagcactttatagtttgtctggctcagtgagaaggaaattgtttaccttgatatgtttgtgtttctgaaagatgtgccttctgtggcatatgtgccatgttgccccctttcctcatctgttccccttcgttgatttctgggaagtagccatcccttaacactggagctgcctatagtgatagatgatactctgaatctgtgcacctgactccatagtaatctataaattattgatgagctggtaataaaaaatcctaaatgttcctgcttctcagggagccacagaccccaggggtcgccaagcaatgaaagatcaaactggactcaccagtgaaaacacaattaattatttacacacatcagcatttgacattggtatcatttgaatcaagagatcctttgttggctacattgctacattgatttgtgctccaaagactgtaagtttggatgcacccttgttcaggcaaagggagatgagtagatactgagtgatgaaaggtgagcactgagtgtcaaattttatgcacatgttaatataaagaaattgatgtcatatattatagtgatattttaaggagttttgaaaacacaaagattgtgtgtgggtgcaaagtgaaaaggaaaggggatagagaagcaattataattatcttatctcagtccagtaaagccaaattaatttaaccagagctggggagaagtctcaagagaaacaccttctgaataagaccccactggagaaacttaagcaacaccagtgaggagtagctccctctcatgtctcttggttgctctgctgtcctctaaaatgatttcctgagggcagcagggctggtgagtttcattgcagaaacttcgagtcctctatcataggcattttatgggttaaattgtgcgagtaaaacacgtcctcctgagttggagtgcctctaatatttagcctactcaaaaggctgagcaggttcagttctttctgtgaacctggggaagagaaataaaaatctttatttttgtatgttctgtaattttcaaggcttttttttttttttttttttttttttttttttttttacagttgaaggactgccattttaatgctgtggattttgtgggccgctgctcaacaatggggaaatttcattaagctgagccaaagctaattttgaagcagttctgagacattccctattaagtagagaaaggatttgattccttatccttcctttcatgcttgagggatctcagaacccttgacaaagcaatgactgcaatactgactgaaagtaaaggaagccctattcaaatggttagcattgcctcccagatgccaaaattcccaattttttaagaaagttcatcattcagaactattaagaatttttccactctttggtagaagaataataggtcatagatttatagagaggtctttcttcaatcagttcagacgcctcaattgctcactgtctcaaaagatggagtgtaaacatgtgtaatatttaatttctatgtacaagcaaagactcataattttctggaccacacagaatctctgtaaaagttttggatctaatctctgcttctgtactaattccaaaaaagtcaatgaagtctgaaggcatttggcaatagaactaaccaatttaaactctgtgctttagcctacaacccaaaagtcaatgtttcataaatatttgaacatagctattggaagtcccgctggttatcttttaagttgtactttgcttttggacgaagaaccatatcagagtatcattctcccataaaaatctgtaaaataatgtttaaatagtcacacattacaaaaaaattaaattccacaagtttattgccctgtggatattgggcaaagtgactgatgcccacacccatggattaatcaggttataaccaaaaatttcccttatattcatccttggttcacatactctactatcaggaaggtcacccaagactaagatagagggcaaatggggcctggtagcaacactgattttgctcaccatctaagtggctggttctgatcatcatcatattattgtgctgtttttccttttaaattgttaccatctccatagatccagctcctgtcctatagagtattcagttactgggtggattattatcttggtttgggttctcttggatgcagaccttgagacaaaatttcaagggcatgtaatttatttgggggagagagacaaggaagagaggaaaaccaataaagaataggttatcaggtaagttaccactgtgggcactgaagcttaatcttattggggaactctgagatccagtggaaaacatactcctcagagatatcctatctgagggacaagggagcgggggtattaatacaccaattctggccagtcactgcatgaggactgcacagtggtagaagtgggagacattaattctccagcacttctgggctgccatatgcaagcaaagctggctccagcaccagagaaaactctctggtaaaaaaattgtagagactggcagttggatgtcaggctactgggcatagaaatggaaaggcctaagggaatatgagcagagaattgacctatctggttgatattgagaatcaatttcattgtctacaaccccaaaggcaataaacagactccacgggtgcctgcaagagccttgtcaatattcttccacgaggaagagaatagttttcccatggcttgtttttttttttaaaaaaaatcaccatctacttctactgtatgtgatttgtcatctgaatatgagagcttaaagagattcacttaccttcccagacccagctctaacccagacagaggataaactggaagagtaatcgtatgggaatctcaatctaacgaaacagaataggccagaaagggttcagatctaggctggaaactgactgttggcatttggcaggtggatagctctcctatttgcaggagggagtgaagtctgcacagacaagtgaagagggatgacagtaggtccagcaattagtgacagatggagagtcacattgtcaagctgttggcattgaaaagagccaacaggaagtggcagtacagacccttggcaaaaggccataggaagggggccaacctgacaggtgtgggcattgaagaggagggaggagaaggttcttttgtagtttgtttatccacaaacggtagtgtctttatcctggacaaagcacaggtggataatgtcaacattgagattggaaggagaagcttggaattcaggggcatagttcaagtcacagaataactaaattaatgaacagggcaccaagtcaatgacacaagcacaagaagctctatgattttagttagaacttcttttgattgcaaatggcaaaaaattgttttactttaagaaaaaatataaagtgtgtgtagtgtgtgcatgtgtgtgtgtagagtgtatcagttatccagcgctgcataacaaaccatcataaaatttagtggcttaaaacaataatctttagctatgattctgtgggtcagcaattagctggattcagctgggcaattcttctgcttggctcacttggggtcactcatgtgtctgcagtcagctggcaggtgatgagagggctggtggatctagaaaacaccagctgagatgcttctacatgatctacatgatcaatcgctgctccacctcatctctcatcctccaggtggccagtctggcccactttatatattaatgaaaggttcccagcggccagcgagcacaagccccaaaccacaaacactttttagcctctgcttgcttcgtgtttgctaatgtcccattgaccaataagagtcatgtggccacacccagattcaaagagtgggtagatttcacttgttgacataatttgtgaccaattcatgtgatctactatcagagggcatttgaagctgcacagaaacaggaatacaatggtagaatgacctgtctgcttcttcctgtttctattctttctctctaccaacttcagtctcatgggtgagctgtcttcataaggcaggaggtccgggtcacttttagctcttgggatcacatcctcactgcatcataacctgagaggaaagtactctcttctgtcaggcccaatttagaaaatcctgcaactaaagcttattggcctggcttgcatactgggggatgatactggtggctcatattcaacccagatgatgggagaggaagggggaagaactgttcctcccatgttttctttgcctttctctggcttaattcttgtgtttcctagattccattttttctctttcttggttttctctttcatttttttctggaacacatactggaaaatgttacatggaaggcaacttttttgaggtcttgcatatccattcttccgctgtccaacttgaaggaaaatttgatttatttccccatagggcttatcctctaagatattatgtaatttccttgttcgttgtgtttcttgtctatcgtttttatatcctgctatgcaagcacatcaaaggcagagttttttgtcagtttatttcactggtgtgtctcaagcatctagaccagtgtatacagcaggcactcaatcaatatttgtggaattactgaatgaatcaggctgagttttctgtagcacatgctcctaatgtcaccctttgtccctccagtccccactgcactgtgggtttttgagggttttgtgcattttcacatctccagtgccttgcccactctggcatgtgtgggagtcccataaatcaggggcccccaagtccccaggccatggactagtaccggtcccagtctgtggcttgttaggaaccaggctacacagtaggagatgagtggccagtgagtgagcattatcgcctgagctctctctcttgtcagatcagcggcggcattagactctcataggagcgcaaaccttattgtgaaccgtgcatgcgagggatctaggttgcccactccttatggtaatctaacgcttgatgatctgaagtggaacagtttcatcctgagaccaccttcctcccacccatcccggattcatggaaaaattgtcttccatgaaaccggtccctggcgccaaaagggttggggcatcactgccataaattgttcttgaatgaataactgaattaccagggaaagcaaaactagctaatgctatttggagggaaagttcttctcaggacagaagtgttttctgtaatatttaaattatattctcgaggtagaggaagtacatgaataaacttatagaataagaccaaatttattttgcttgctgctatatttatatataactataactatattagtatctctatatctagatgccctagttaaagattcagttgacccagctggaattccgtctttgccaggactatctctgctgtgaaaaatcttctcttttcaaatcctgtgtataaagcaagctgcctataaatatttgttgtctgaataaacatagaaatgatgcatacatctttctaatgtttcacagaggggtttagttaactgaagctaaagaacagttctattaaaatcttggtagaattttctgttattcaagtagaatgcttggcagggacaaattatacaatgtaatcttttggcaattttcttttgcattcctgtgaagcacagcctttaaaggtattgctgggaagagttttgttttccaaaagtgatgatagatttcggcaaaaggccataaaacttatcaatgttttttaacctccatcaacaaaataattaaattttgttatgttttcaaatttgaggggatttttatttttcatatttcaactctttgagttttcattagaaaagcaatgttttccttgttttaagaaatacaggtttttatttctacctttttgaccaatgatgtataggaaagtttaaggaggcacagacctcatccccaattattaagagcagatgttttctgagaaatgtgctgtggatgattttagcattaacaacacccagtgtggacaatattgtcttggagagaactttggttaccgcaccagagtttatttctaagtcgagaggcagaaatacaagacaagacatgggaattgctgaactggttttgcccaagttaacttagagtctcaactagttcatgccttaatgaagctacattttactcattaatctacacatttgaagggtaacacataaagctaggaaagcagctaatactttgaaatacaaatttaggaaccaggggatgatctgtctctgcaaagagcataggaagctacggggaagtgtatgaagctgggggaagcaggaagctggggacagtaaagcatctgtgccttcttcagccaatctttattgagcaccagcagcacatctagtgctattctggatgctgaggccacaaaagtcaattaaatgagtccctgcccttgttcagtttatattctaatggagggagatggacaataaaccaatcactgtcagctagtgaggggtgctgcaaatacaaataaagcaggatatacaggaaccaaggccctccacaaaggagaggagcaaggaggttaccctttcgtgtaaggtgtctaggaaggccttttgggagaggttaagaattgagcagacacctgaagaaactaagagtgcaaatcatgctgatatcctggaggcaagaactatgggcagaaagaacagcaagtgcaaaggcctgagatgggagcctgtggcgtctgtgaagaactgacggggcctcagagtggtgagggcagcgggagtcaggggcaactgggagaggactaggtcacagcaaggacagcctcttagagctttgggagcattgcgtggactttgtcttttactcttgtgaaatgggagccaacgaagagtcttgagcagaagagttcaaaagaatgacagctttgaaataggctgggaaggagtgcaggggaatgcaaggtaggagcaagcacccagaagaggctccagcagtaatgcaatcaaaagatgaagcagaaggacaggaagagaggccatcagattctgggtgtgttttcaaggtgaagtcaacaggattttcttataagattggatgctggatttgagagacagaaaaaacaacaacaacaaaaaaccatggataactacaaagattctgatctgagcatctggtggtccttatggttggctcttaaatgccctctcttttaggtatgggcacatctgtttacagggccagagatgggacagacacgagctgaagtattataattcagctagtgatggtattcaaattcaacaaaatgaaatgaagaaaatatcaagacttccagtaataaactaagtgcaaaaaggaagaaaatgtagcttagcagccaaattagctaaatcatttagaaggagtaagttcaatatgaattaacagaacctaatatggtaatttgtagtaataaatttacaatatctcaagctggggtcactattggagtatctcattcagttttcattcaaactgtaaagcaattggagcttaggaaaacaaaaaatgacctggcacagtggctcacacctgtaatccgagcacattgggaggcagaagtgggaggatgacttgagcccaggagagcaagactaacctgggcaacatggtgggaccccgcctttactgaaaaaaaattttaattagctggatgtggtggcatgtgcctatagccccagctactcaggaggctgagatgggaggatcacttgaacccagaaggtggaggctgcagtgagccattatcgtgccaatgcactccagcctggacaacagagcgagaccctgtctcaaaaaacaaacaaacaaatcatgaggggatgtgaaaactgatgatatgagaacaagttgactaattggatgaatagcccagaagcaagtagacgtagaggcataatgactgtcttcaaatatctgtggggctgtcatatgaaagcagaattaaacttggtcaatgtgacccaaagttaagctgggttctataggtagaaactactgcaagaaacaccttagctcaatggaaggacagttttccataacagacactgctagtactctccaacatctgtgaactcatctccatcttggttaccctgatagtctatatattttaaccccttgctatctaagtggggccatgtgcctatgtcagtcaagccaataaagtatgggtgagcttagtatatgctacttccagtcctgacctctaaagccccctctgagctcttccacatattctctgttcccctgctgctagtcagatgcagagggtcctggggaggactctgaggtcctgtaagatggtaggtgaaagaagccaagatctgcgaaaagagccagctgagcagaactgcctggtgcattgtgatatgaacattaaataaacctttattgtgtcaagccatgtagatgtgggggatcttttcttgtgcagctagattcacttaccctgactaacacatctactaacttttagagctgtccagctataaggggattgcaagggagagaatgagttttctgtccctggatgtgttcaagaacccccacttagacatgaaactctcaaggttgtaggggcaaagggaaagctttcccttcgcccttggaaggtttgttgaaaaatcaactcacaaaaagggagattaagagaaaagccatataaaggtattactaccgtgggcagggggacaatcacagactgaatgcccaatatcccaacagggtacagatgcttatacaccctgcttcttaggagagcgggagatggggaagtgtggatgattttagggattagtaaattatttttagggagattcaatgggcttgaagaacatacaatggtctggaacaaagtttgttgggcctgcagagcagacaatggtttgtgacaaaatctgtccaggtttgttaatagacttcagccttccttcctgcaataatgaaaactcaggggagggaccagaggtaattgttttcttctttgttaggtccggactttaggctgaaactttagagaacaacttcagcctgtgctttgggagagatagaggattcagagatgggaggggcaagttgcggggagggagaagtaattgttcttcttggtgggtctgtccaatccttatgtagatggcggggagctctcttcttttatctgttgatttctaaaggcctttaattcgaaatactcattataccagggagccatattttggggaagttccttgtgctccaaggttaaaatcaagctagagataagtgacctgaccaaataattcgaacagtacttttcaaaactttccactgaggttcccttatcaacagagagatgtggctttttatccccaagtgacaggagttatatgtctcctgtgaattttctttgaactcttttgttttcataatcttatcttaaatatgaatgcagtttctgtgttcttatctacaacctatcagtttattttcatatactttttaaagttataaagtacatactattactgaacaagactttttcttttaaatattacagtcagattgacacgttaagtgttcaaaaattaatattttcaaagttaagctatgccaaaatcaataaattcatatgtgagcactgttttaagtgaaatataagatcagaattcaaatgaacacatacattatttttcaacaaactaaagtttgaagatcattccccatgccaaatcaacagtattccacattgcacggttcatattaaaaattataatggtagctagggtcctttgaaaaacgctagagacttctttatcttctaggtttcttttatagaaatgattttcattgcttattttcttacttagatggatacaaattgcaattctgttattgtgcctgcttacaaaaagaagaggttgctataaacatgatatgattcacaaaacgaaaaccatgctgacgttagtgggcacacacattttgcttgctcacatgttgtaatgtgatccaactagaaggagaggtagatttctccttcagcatattctcacatcttcccttcaaccagccccgccagatggaatggaaatgcagagattgtgttaaaagctgcagaagataagatgtctaggctgtacttgaaaaaggggaaaaagatgtaggtgcctccagacatcattttcttaatgggctttctctttagtagatgtttaggcatgtataatacccacttacatgcacctacttagaggggcctcatttgtactgctaggagtagctgctttgcttctatggagaaaatttgcctatagatttttgtaaactttatctgatattttaaagccatttccccatacttattttaatataggttttgagctagctttcctaattattaatttatatttcctttttaaagggaaagcaagaagcatgtgtgaaaaagcatgaacaaagttgtgaacttaaggaaatcttcaatattttaataaaataaaactactcaatgtctatatagtggccaatatgaaggcttgatctcctgcttgtagtggttagaccttcatattcaaacgtaatagtaacatgacaccaggaaagaaggcagaggatcatgtgcaacagtaataaaaaccaggccacatgtggctttcatcactttttcccacagctcagatctcagtcacatgatcacagcctaacaacacgggaagctgggaaataatggtcttcccgtgtgcccaggaagaaaaacaaaatgtaacaggagttactggacatataacattgtctctgccacactttctaatgcaaaataaaatagtcaaataatgaatccttactatggacttacgatctcaatgaggtagatatatcttagattctatttagcaaatgaagaaaaggaagatcacatatgttaaggagtttttctctcctggcatcactcatcttcttcttttattggtctgaaataaatttgctttctcacaatattgtttggcctgtgaatgcgttaaaaaatatttcaaagtatcataatgcagagttttggattgcatgttttagttagttgattatagtggctttaaaaacacagatttccttaaaacacacacacacgcacacagagagagacacacaaattcaaacacagttccacagttgactacttctttggcataatgatgtcatcaagaatcctggtgtgtctctgttttccactctgccatcctcagcaagacttatccaagttcacagtcactggggcattgtaacaacaccatagctacgaaaatacatactaaaatatacagatagaggaaagcttcgtggaaatctttcttactgttggtgttcatgtgtacatatatgaaatctgtgaaaactggatttatggcagtggaatctcatatttttctgccagaggtgatggttttaaaaagtcagaactggaacagttggagcctgtggctggagattattgaggaattttgtgtattcctttttcataaagatggtagtcatacagtgatgtgtataagatgaaagcaaaatttaattttgatacctggaggaaatgcctaaaatgagaaatgaaaaattcttattctgggtaatttgtggtagttctgctcttcttttacctacgtatatgatgattctgacgctcagagatttcaccctaaaccacacttgaatggcgatgactgcattttccatgctttcccacacaaagggctggtattgttctgagttggctcactacatgctagggacacgtggaatcaggtacatctcaacccactactaacccccaaatagataacttacttatttgtggcactgtgagcagaatatgccctttattcttccattttcaaaatatcatgttattttttcagggttttttatttttaatttttagcactctttaatattaacccttctagagtctaattctccatttgaagttagagttgaaaggcacacaatactcttaatagttttccagcagtgatgttgacccttctcaacctcatatgtttcattttgtgggagtagtattggggaaagatcaaatcacaactagaaataaaaagcaattccccttctatagaatgggatgctaaataaataaactaataaaaatgtcaaaatatagatgtggtggtggtaacaatgctggatcgggagctggaagacatagatctgatttcctggctctgcctcccccatcacttaaatataggtgaacactgaactgttttctctatcaaagagtaaaggttcctgttacacctacctcctggatggttgtgtagcttgagaggtgtgggtgagatggagcaatgccatatataccctaattcaccataaaaagatttggtcatttgtatatcttatgccacaagtactgtatcaggatcatagtgagagaagcagccttgagtgtttacctattacatcctccaattaagatattgttaaaatcaagcaaaaaagacagccttcttttcgtttctctgatataattagaaaaattcctgtttcacaccttctttttctgcaaaatggcctgtggaaaaatggttaggtcaaaaaataaattaggtaaatgctgttttctcagcctccctctcaaagaatcacaatatatgttactattttcaaggctcagagaaaatttgccatttattttataaaagattacttaacttattttccaaacctaattgacaaagaatactctttttccccctaaccattattaatgtcccttggctgtgttctaaagggagaaatggcacacttccctcattttgggcaacatgcaaaaatgtgcttctcagacatttttctcctgaactttaaaacttctgtattgagcagaaatggaggcgaaaatttccttcccctatggttttccttaacatcagggggtggaaagagagaagaacagttttggggtctttctcattagcctatttctgtttaaattactctctgttatacctcctttccacttatattaggttgctgtgtgatatagccaaatataccctgggactataccagagtcttatacccggtggcctcttgaagtcaggcaaaaagctggaagtaattttcagttatcctggccactcagcttcttcccagtctgttcttattacaaggaccactgggcagaattgaactctgccagcaagcaattgcacacccatcaacatttaaagcgggaaaggatgaagatgtctgatatggagtaggtgcttgtcttagcctgtgtctgcccacagcagatcttgaagcaaggcttccttagaggaagtttgtatgggaggtggtctcagggagtggcagtgtggttcggggagtggtggcgaggagagtaaaacacagctgtaaagcccagacaagggcattaccaacttggcttctcctatggacaactgaggttcatcccagggagtgttctgaggagcttatcaaatctgtctcagaactcccctgttctgagggaaaagaggctcctgtggcccatccatcttgggtggccccatgaaagtcaactccctgtacatctgggttgccaatccaggagagttgagggatgggtttcctttgccctgtcagaaaagcctcaaggtaggaatcaagaggtccttggtacaaccaggggcaagacactgtcagactgcacccaagggaaactggttaaagccaacatagaaactgtcaccacagcagtggctggaggaagagttggcaactagaagccttgatgtggtacttaagaggtgtccaatagggtgcttagtaaaccctagtggtttatctgcacaaagcccagcccctcactactgttaaatcaagtttagcctaaagctgcctccttacatattttaagctcgacctaaaggtttctctgtatatcatgaactatcacctaaatggagttgtaaagagactgtagtctactcttgcaccaaccactaagttttggccaatcaaaggtgaccaactgttcaaaccatgttcaaataagacaaaactgagctgtgaccaattcagctgtttctgtaagtcatttccgttttctgtatgtcactttcctttttctgtccataaatcttaccatgtggctgcactggagtctctgagcttcaggaggctacctgatttgagaatcatcctttgctccattaaactcttaaatttaattcagctaaagtttttcttttaacactacccacctcaggacttggagaccctgagaagttacataggttgccccaggacacaaagcatgctggtgacagagaaaattgaagagagccctcctgaccccctgttcacttggactttcagccatgttgcactgccccggctcaactaactgtacttaccactatggtagaaaagcttgagaacaaagtgccatgctgtcgcacctacaacatttaggaagaagttcaaaagatgtctgacttcaatcacggcaatgacaaagcagcaaatgcaagaaagaacaggatcaataaaagtcccagtggaattaaaaagaagacaagagaggtttaaaaggaaactgggctttggatacatactctttctgcttgtaatctgtgcttcttacactttctgagtttgaaaaggagtaatgtttttgtgtcacacttggaaattttgccacatgactgtcatcatgggaactttggaccctgttctggagctaagaatagctgagatactaattaggttgcttgaaaagtgctaaagaactgatcaagtccagagaattcacaatggaacttcatggccagaccgaggtctgttctaactaggattcttgtgttgccatcagcacatcaactgccccttgctttttcatatgaaaaactaatacctgtaatgatctcaaaattcaaatatttgagtatcagaatatttattctgatactcaaacatatgaataatgaaaaagaaatgtcgtggtgggaaccaataaagacagggtttggaggggccgaagatcctagggacggataaaatagggagatggctgagaggaaggaggaatgaaggtctcctactgaaatttaagcaccacacttctggacttgttttcttatgaattggttcttttttttaatgagagcaggtaataatattcctttatcaatgcatttaaagggcacaatttaatttagtttctgtagttaaggtgtgtagttaagtgcctggtacataacaaacaacagtgattaataacctactgtttttttattatttttattatactttaagttctagggtacatgtgcacaacgtgcaggtttgttacatatgtatacacgtgccaggttggtgtgctgcacccattaactcattatttacataaggtatatctcctaatgctatccctcctccctcccccaaccccacaacaggccccggtgtgtgatgttccccaccctgtgtccaagtgttctcattgttcaattcccacctatgagtgagaacatatggtgtttggttttctgtccttgtgatagtttgctcagaatgatggtttccagcttcatccttgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttatagtcctttgggtatatacccagtaatgggatggctgggtcaaatggtatttctagttctagatccctgaggaatcgctacactgacttccacaatggttgaactagttgacagtcccaccaaccgttcctatttctccacatgctctccagcacctgttgtttcctgactttttaatgatcgccattgtaactggtgtgagatggtatctcattgtggttttgatttgcatttctctgatggccagtgatgatgagcattttttcacgtgtctgttggctgcataaatgtcttcttttgagaagtgtctgttcatatcctttgcccactttttgatggggctgtttgattttttcttgtaaatttgtttaagttctttgtagattctggatattagccctttgtcagatgggtagattgtaaaaattttctcccattctgtaggttgcctgttcactctgatggtagtttcttttgctgtgcagaagctctttagtttaattagatcccatttgtcatttttggcttttgttgccattgcttttggtgttttagacatgaagtccctgcccatgcctacgttctgaatggtattgcctaggttttcttctagggtttttatggttttaggtcttacatttaagtctttaatccatcttgaattaatttttgtataagatgtaaggaaggtatccagtttcagctttctacatatggctagccagttttcccaacaccatttattaaatggggaatcttttccccatttcttgtttttgtcaggtttgtcaaagatcagatggttgtagatgtgtggtattatttctgagggctctgttctgttccattggtctatatctctgttttggtaccagtatcatgctgttttggttactgtaaacttgtagtatagtttgaagtcaggtagcgtgatgcctccagctttgttcttttggcttaggattgtcttagcaatgtgggctcatttttggttccatatgaactttaaagtagttttttccaattctgtgaagaaagtcattgatagcttgatggggatggcattgaatctataaattaccttgggtagtacggccattttcacaatattgattcttcctatccatgagcatggaatgttcttccatttgtttgtgtcctcttttatttcgttgagcagtggtttgtagttctccttgaagaggtccttcacatcccttgtaagttggattcctaggtattttattctctttgaagcaattgtgaatgggagttcactcatgatttggctctctgtctgttattgctgtgtaggaatgcttgtgatttttgcacattgattttttatcctgagactttgctgaagttgcttatcagcttaaggagattttgggctgagacgatgggattttctaaatatacagtcatgtcatctgcaaagagggacaatttgacttcctcttttcctaattgaataccctttatttctttctcctgcctgattgccctggccagaacttccaacactgtgttgaataggagtggtgagagagggcatccctgtcttgtgccagttttcaaagggaatgcgtccagtttttgcccattcagtatgatattggctgtaagtttgtcataaatagctcttactattttgagatacattccatcaatacctagtttattgagagtttttagcatgaagtgttgttgaattttgtcgaaggccttttctgcatctattgagataatcatgtggtttttgtctttggttctgtttatatgatggattacgtttactgatttgtgtatgttgaaccagccttgcatcccagggatgaagccaacttgatcgcggtggataaacgttttgatgtgctgctggatttggtttgccagtattttattgaggatttttgcatcaatgttcatcagggatattggtctaaaattctctttttttgttgtgtctctgccaggctttggtatcaggatgatgttggccttataaaatgaactagggaggattccttctttttctattgattggaatagtttcagaaggaatggtactagctcctctttgtacctctggtagaatttgactgtgaatctgtctggtccttgacttttttggttggtaggctacttattgcctcaatttcagaacctgtcattggtctattcagggattcaacttcttcctggtttagtcttgggaggatgtatgtgtccaggaatttgtccatttcttctagattttctagtttatttgtgtagaggtgtttatagtattctctgatggttgtttgtatttctgtgggatcggtggtgatatcccctttatcattttttattgtgtctatttgattcttctctcttttcttctttattaatcttgctagcagtctatcaattttgttgatcttttcaaaaaaccagctcctggattcattgattttttgaagagtttttttgtgtctctatcttagttcttcagttctgctctgatcttagttatttcttgccttctgctagcttttgaatgtgtttgctcttgcttctctagttcttttaattgtgatgttggggtgtcaattttagatctttcctgctttctcttgtgggcatttagtgctataaatttccctctacacactgcttaaatgtgtcccagagattctggtatgttgtgtctttgttctcattggtttcaaagaacatctttatttctgccttcatttcgttatgtacccagtagtcattcaggagcaggttgttcagtttccatgcagttgagtggttttgagtgagtttcttaatcctgagttctagtttgattgcactgtggtctgagagacagtttgttataatttctgttcttttacatttgctgaggagtgctttacttccaactatgtggtcaattttggaataagtgtggtgtggtgctgagaagaatgtatattctgttgatttggggtggagagttctgtagatgtctattaggtccgcttggtgcagagctgagttcaattcctggatatccttgttaactttctgtcttgttgatttgtctaatgttgacagtggggtgttaacgtctcccattattattgtgtgggagtctaagtctctttgtaggtctctaaggacttgctttatgaatctgggtgctcctgtattgggtgcatatatatttaggacagttagctctgcttgttgaattgatccctttaccattatgtaatggccttctttgtcccttttgatgtttgttggtttaaagtctgttttatcagagactaggattgcaacccctgctttttttgccccccatttgcttggtaggtcttcttccatccctttattttgagcctatgtgtgtctctgcacatgagatgggtctcctgaatacagcacactgatgggtcttgactctttatccaatttgccagtctgtgtcttttaattggagcatttagctcatttacatttaaagttaatattgttatgtgtgaatttgatcctgtcataatgatattagctggttattttgctcgttagttgatgcagtttcttcctagcactgatggtctttacaatttggcatgtttttgctgtggctggtacctgttgttcctctccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttcttcaagaatgttgaatattggccctcactcccttctggcttgtagagtttctgccgacagatcagctgttagtctgatgggcttccctttgtgggtaacccgacctttctctctggctgcccttaacatttttttccttcatttcgaccatggtgaatctgacaattatgtgtcttggaattgctcttctcaaggagtatctttgtggcattctctgtatttcctgaatttgaatgttggcctgcctcactaggttggggaggttctcctggataatatcctgaagagtgttttccaacttggttccattctccccgtcactttcaggcacaccaatccgacgtagatttggtcttttcacatagtgccataattcttggaggctttgttcatttctttttactcttttttctctaaagttctcttttcgcttcatttcactcatttgatcttcaatcactgataccctttcttccacttgatcaaattggctactgaagcttgtgcgtgcatcacgtagttctcatgccatggttttcagctcagtcaggtcatttaaggacttctctacactgtttattctagttagccattcatctcatctttttgcaaggtttttagcttctttgtgatgggttcaaacatcctcctttagctcggagaagtttgttattactgatcacctgaagccttcttctctcaactcgtcaaagtcattctctgtccagctttgttccattgctggcaaggacctgcgttcctttggaggagaagacgtgtgctggtttttagaattttcagcttttctgctctggtttctccccatctttgtggttttatctacctttggtctttgatgatggtgatgtacagatggggttttggtgtgaatgtcctttctctttgttagttttccttctaacagtcatgactctcagctgcaggtctgctggagtttgctggaggtccactccaggccctgtttgcctgggtatcaccagcagaggctgcagaacagcaaatgttgcagaacagcaaattttgctatctgatccttcctctggaagcttcatctcagaggggcacccagctgtatgaggtgtcagttggcccttactgggatgtgtctcccagttaggctacttgggggtcagggacccacttgaggaggcagtctgtctgttctcagatctcaaactccatgctgggagaagcactactctcttcaaagctgtcagacagggacatttaagtctgcagaagtttctgctgccttttgttcagctatgccctgaccccagaggtggagtctacagaggcaggcaggcctccttgagctgcagtgggctccacccagtttgagcttcctggcagctttgttcaccttctcaagcctcagcaatggcggacgcccctccctccacctcgctgccaccttgcagttcgatctcagattgctgtgctagcagtgagccaggctctgtgggtgtgggaccctccgagccatgcgcaggatataatctcctggtgtgccgtttgctaaggccattggaaaagcacagtattagggtgggagtgtcccgattttccagttgctgtctgtcacggcttcccttttctaggaaagggaattccccaaccccttgtgcttcccaggtgaggcaacgccctgccctgctctgtgggctgcacccactgtctgacaagccccaatgagatgaacctggtacctcagttggaatatgctgggagctgcagactggagctgttcctattcagccatcttggatgacaaggccaatatcctactgttattaaacttttcttctgccagagaactttgtccatcttttcccacttcccgagtgtatttgccgacattactctctgtactttttttaaaaaagaaactcttgattttggaacattttaagatttacagaaagttgcaaaggtagtacagagagttcctgcatgcctttcccccagcctcccctgttatgaacatcttacctaatggtggcacatttgtccagactaagaagttcatctgtacattactattaattccttgtacttccaaatagctgctgtctctttttcaggcattaattaggagcccagataattctaatgttgatatttgattgaaccaggatacttccttgtgaataagaagtgggctctataaattcaacattgtacacacaagttatcataggtctttctttctttcttttttttttttttagatggagtcttgctctgtcacccaggctggagtacagtggtgcaatctcggctcactccaacctctgcctcctgggttcaagcgattgtcctgcctcagcttcctgagtagctgggattacaggcgtgcaccaccatgcctggctaatttttgtatttttagtagagatggagtttcaccatgttggtcaggctggtcttgaactcctgataccatagatcttttgtagggtccatgtggtcctaacaaaattccatcacctctggcaggcccagagaactgctggttaattactaaaaaaaaaaatacataaagcagactcctattgaaaccaatttaaaatatgtgtttgagtattcacaaacttaccctcactgtgtttgaaaccttcaagttttttttggtgaacacagaatatctgtttttgaacaaaacattctaacctgatgtgtaaatgtgatatgctcatagaaagggagctgaagattgcagcactcttttggacatgatatttgatacaagttagattataagactcaagattttgaaaagggccccttggaaacttcccagatgagatggttcaatggggaacataccagatggaatgtataggcctctgtcctaaacagatgttgtacagctgggaaagctgtgacaagaaaatgcaccccaaatgcttctgatggacagatctctgtgcacacatgcacacacacacacacacacacacacagcgttttaagaatcaaaatattcagattgcttaaaaattagaatttcaggtgtcagtcaccagtggtgtatatatatatatatatatatatatatatatatccccattgttggaatggcccagtttgtcagcatcaaatccatagtccatctgtgattgcccttgaaactgatgaattcacttcaattccaacctaatcaattctgaactagtgccttgaagtcatttaaatagtaacttcctttgcacaaaatcttaagaccgtggagagtggaggtcaagagaacactagtaaggtggcctctgacttcttgagcttttgacattcagccaccagaggctgctctgagaccattatcctcttttcactccgggtccaaatcccaacggtgaaacctgtaaggactgattttgtttccattgctttgaattttccttcctcaatgcagttccctggaggtctgctgtttggagaagatgattaattatagttaaagaggaacagctgaaagaagaaaaaaactacagattactgttttgccctcctctctatttttaaactcttaatcttgttctgtttcttttaaataaaagaaaattggtcagggtggaaagagaaagtgctttcttactggcactggctaatttttcttcatttttcccctctgtgttgctggattttcaaagaacatttctgaagggttttaaatctttattccacaatacttacttccacatggtttctattcttccagattttgccagcattttatagttgctttcatgctgttccctctgttttatgtttttaaatctttgcctttctcctttctctctatctaacaaagcaaatccaaaattaaatggaatatctatagttaggtaagaaggattaaaaatggttttgttgcctctaacatattttgtagtctgggacaactaagcactgatttaaattgttaactgaagaatgaaaccagtttcttcatgtgacattgctttcaatcttcacgagtgaagacatgactgtgacagacaatgaccagcctgtcaaaaataagtgtttttatgttattgttacatacaccaccctaattattatacttccatatttatgaaagtaagttactatgtaaagaacttaagttctaaagccatggcaaatactaaattaatagttttgcagcagacaaagtaatcaatgtgtaaatgacctggagaatttcagcatgacaattctttcattctagacttattctttttttttcttagtaaaattccatgtctgattggaaaaggtataatttaaatgtatgcattcttatagaaggcatatagaaaacatgctcattttctacagattacagaaaaatcaattgagttgcaaggaaaatgaatacttattttattaatttctatttgcagtaaaagatggaaatgtaaagatttccttttgctctgaaaaggaattcttgagataccatgaaacattcctaagtggtatcatattcatagagtggaactatcattagaagcatttgaaatgtttggtatttcacctcaagtgtaatcataatggtaaagattcttaatattggtgactaaagtaggatacatgtgggtttatattttcaggtagaatactggcagctacagtatgtcaactggagcatatttcaccaaatgccttgacaaagatggaatgacaatgaaattgctagatctcttctctggggcaggttatgcttttcaacttgcccctactaaggagagtaccagaagccatttgcccatgagtaataccttattaaaccatcatgatttaatgtggcatatttttctctcaatttgcatgcctgacagtcgacttcctgaatatcacattcgagctgagccacagaagaaaaatagacccactgaagtagcattaggtcagcttcgcgggatgcattagcaacctgtctgaacaaagacgggggactcaggcgcagaaaatcataacgtggccccaggccctgggaggtggccccattgccttgcaaatgtatcgcatgactcattattaaacacaccaagaacagacgaattccaggcgagtgaagcatccactgattcaattgcagttaggtgggttgtacgatattcgtcttacttgcttttccttaaagaacacccacaccatctcttacgctcttgaacacggcacgtcaaatgcatgaagcaagtgtattaagataaaaattgctagcattaaatacaggcacttaaattagtataaccctctggccagatatagtgcactaaattgcacaggctttaaaatgccagcactcaatttaaaaaaaaaaaaatgtatccatagcaacctctttgttaagggaatagttaccaggaaggatacacatctttccagagaatcagagataaaaccatattagttaactggatgatattacttggatttaaatttaactagaggcatggttcaggagaaggggctttttaaaaactttacaacttatatgcttatttccagtaaaatgtgttttcatatctttcttattaccaaaagattcttacatatgggacttttattaaaataccatggaataactttgggtttcagatatttagaaataaatatcaaccatcctgttcttcctgcccacagcatgcctatcattttttttcttagcattttcttttagcatacacataggtattattctgcaatttttgctctatatgcatctttgatggtcctttcatggatatttgttaccagaaagggcacagggtcttgtaataacccacaatccttctattgtgaggtcatctgacttaagtcatcctgtttccaagagactttctctctgtctaatggagtggcctttcgtgcagttatgtcatgtgatgtgggctgtaggggagggggaaatgggggatgactaacagtgaggtgaagagcctgcaaataacaatgtctcacatttcttaggcaacgagtattggggaggaaatcttttcatctaccttcttctgttcaatccctgggggcctgcaaactaaactaacaaaagatagattaacaggagaaaaggcacacaattttaatcaatatttacatgtacaaggctgtgtttggaagctctagcctgtaattccagcactttgggaggccaaggcgggaggattgcctgagcccaggagtttgagaccagcctgagcagcatagggagaccctgcctctacaaaaaaaatttaaaaattagccaggcatggtggtgtgcacctgtagtctcagctactctggaggctgaggtaggaggattgcttgggcctgggaggttgattgaggctgcagtgagccataatcacatcactgcactctagcctgggcaacagagagagaccttgtctcaaaaaaagaaaaaaaagtacatacacaagagttcacacaaaaggagcaaaacacaaagaagcagctagactcaggggcttttaacatacccttttaacaaaggaaagagggtttgggcttcaagggataataaattatgggaaaatgactaggaaatatataggggaactaatgaacaataaggactaaggtctatttatacaaactcttcttggtatcaactccccatcttctatgataaaagtcattcttctctctctggtacagggggcaccttcttcaaagggaaatgtatgttctgcttttaggcagatagagggagggcagagaactcttccgacagctgttgattttcatttgactttagctcaaaataattattatgccaaagaggcatatttggggttggcatattctgatccccttcaggaggtaaacacatcaagcttggagcttaaattagtcaatgtcagtcagagccagcttcttgggcatacaacctgtgcagttacatgaggtcccacacttggtctaatggtagactgaatgggcatggctgcattccaataaaactttatctatgggcactgaaattttaatttcacatacttttcatatgtcatgaaatataattcttttgattctttcaactatttgaaaatgttaaaaaaaaaattcttaactcatggaccatacaaaaacaggtggtgggcaggcttgggctggagtacctgagtttgccaacccctgatatacagaagcatttccaaaaccaacagcatcggccctacctgggaacttgtcagaaatgcaaatttctaggccccaccccagactgctgaatcagaaactctggggtggggccctgtaacctgtgttttaacaagccctctaggggattctgatgcccactccaatttgagaaccactgatctagacctgtggttctcaaccttggctactcatcaaaattccctaaggtagcttttaaaaactctgctccaaggcccagcccaggtcaattaaatcagactttctgggggtgggactcaggcacccgtatcttttaaatctcttccaggtgatttcaatgggcagccaaagcaactaatggttccattgtacaaataagggaactgtagctcagagagtttaagtgacttgcccaagatacacaacaagaagaaacaggtacagcacagctcatttacgtttgtttttttagacatatgagggttagaatagtacatttggtaatggaatgtatttgctagaagcttcaggggtcaggttaccttttatttagcaccaattaatttaacacatctgaaaacatgccctaaataaaatgaaaactagctttggaaactcattaggccagacaatgcaagcgtaattgaaagaaataaggtgcagacgctcagcaaggtcccatctgaaagcactttggggctgaagggtgagctccatgattcaaaggaaagacaaatatggagagctaatgtcagacattgttgcctgccctggagctacttagaagtgtgtctgaacaattgcttcctgttcggtatctgggacataggtaaatatgttacagtcctaaatgacattaatgacagaaaaaaagtctccatgcttgtgatggattttatgactcttaaggattcctgtgccttgggcatttttaaggcgaactttcaaatgataaatattttgttctgattttctcagcaaagacttcatcatatcaaggaaggaagaatatgggctacgtacccaaaatagagctggagaaagcaatgcacgatggaaactgagtcatgcaatgattacaagtggagtcatataaacatacaactgactctttgacgtttttgttttatgagttacctgatcataatacaagctactatttttgagtatttactatgtgctgtgttctcctcatagttctatggttaagggcatgttttcaggaactggtcagcctgagtgcacaaactagtatctatggcctcctagctgtgtgactttggcaagttactttgcctctctgtgcctcagttttctcctctggaaaatggggataatattagtaccttttctcatagggtgaaggaagattaaatgtgctcacaacagtgtctggcttctaataagcattcaataaatgttaaataatattatttttaaacaaatcacctcaattctcacaataactttgagggatattaagcagatgggccaacttatcacaactattaagtgacaggattgatatttggactaaggctgtttccagcatcagtgctgccagccacagtgctatactgcattgattgggaataataaattaagtatttatgttcaattttttccatgtatagtataaacttttgggcatgatccaaatatccctggaccttcttgttatctggatgattttacaaagcctccagactgcccctcccacaggacactgaagcaaggttgtggtccctcctatcaactgctcctcctgcagttgtccccatctcagtaaatagtgacttcattctcccagctgtcccaggaaacaacctggaaacctcgtttctgctctttatctgacacatacagtccatcagcaagccacactcattgtactatcaaaatctatccaggaactccccaagtcaccccacttccagtgccacccccgtcccaatccaccatcatctcttaacatctcctgccttgcaggctgctctctgtctagcagtcagactgagctctataatatcaattggatattgttactcctgagctctgaaaccttcccatctcactccaaggaaaacccaagatccttctagtgatctactagaccctacaggatctgcaaacactgcctcaccaacacccacccacaaccactgcccccgccccccgcacacatacaccctcagacacattcctgagacttcagctcctactactgtagtgcttcctccctctgctccaacctacataggcttcctgcgttggttgagttcaccctggcctcacagcttctgcaatcactgtttcctctgcccgggtaactctgcccccatccatcactgtagttgaaagtcttgcttcctcacttccttaggactttgctaaaatatcaccctataaaatatagaaactcctcatcccattgacactccttaccccacatacaatagcccctatcaccatcagacctactttctacttatttgttgatgtgtttgtctatctcccttcactagaaggtatgctcatgacagcagcacttaacctatttgtacctgtctgtatcgtcagcacctagaacaatgcctggcacatagtagacacccaataaatacttactgacatgatcaggcatgttcagggtgttatagctgtagtccataaatacttactgaatacctatgaccgttctggcataaagaaggtataccatctttgttagcatatggttaaggcatgagagtctctccgattctttttcttatatgaagcacttgtctctatgcttgagatctttggattccctgggagtgatgaaaatcaattcatagagatgtacagatatctatctatatgttgctaatgaaatcgatggctagaacattgatgcaccaattagctctgaataaagaaaagtgctctaaggctgcattcctaactgtggaaatgaatcacacaaacgtattccactaggaacatcattcagcaattctgaatggaaaaggaaaacctcattcacagtcctagacaaagagccctaaaatccaaatcctcctctgcatagcacaataccaacatctttttccatgagggctactcccttaacagacaaatgcattgttttttcctacctctggttgattggatgaacacagcccaaatttggagagccatttaaggtgattaaaaatcattacagtgctggccaggcttagtggctcacgcctgtaatcccagcactttgggaggccaagactggtggatcacttgaggccaggagtttgagaccagcctggccaatatggcgagaccctgtttctactaaaaaagaaaaaaaaaatagccaggcatggtggcactcacctataatcccagccactagagtggctgaggctggagaatagcttgaactcaggaagcagaggttgcagtgagctgagatcacgccactgcacaacagcctggatgacagagcaagactgtctaaaaaaaaaaaaaatcattaaagtgcttcagtttgcttccaaatgtaatggcaaattcctgactcatcttgaaggtgcaacatgagagacttttggaggtagattgtggttggggatcttagaaccatctaagtggtaaattccatcacccccattgaggcacaggaggtgaaggagtgtttgtgatgagtcatgggcatactgcattttgagcctcattccaaaggggacctgcatctgaactagggtgccagcaccacatgctgctggaaagagtatgggttctcgagtttgagagatggattccgatgtcccatataccaactgtacacttcctgcatgtccaaaaagggactgatgtataactggtccatgatagatacgagagtttttcaattgcctgccttttaattcagcacaaatacctcctggtgggttatattatatcatattatattgtattgtgcatctctgtaatgtaggtactcgtatttttatctcattagacctctcagtgtgtggtgtatcagctggttttaaattcccttaattgggctaaattaatttgcccagttgaagaaaagtccacctatttgcgaattggttggtttctaaagatgaccataacaaaattatcttttttttccacacagatatagtttaggacaaatatcactagggcactgtggtacaacttaaataatgctatgaaaaagaatagttattttgttcattgtatgatgctatttaaatcactcacattaaaataatattaaatagcattgctatttataagataatgtagacaggcaatataagcccttccttttgtaaattaatgattcaaaggagaaataaaatgaagcctcatttgaatgtagtttctcagatatttagatttctttaataaatatgggaaaagctgaggcactgatacccatgtttgcatttttttcttgccatgactaaatatgtttattttgcatcaggggaataatataagaaagcctatctcagtatgtgttgattttcataagtggttctcaacagaaaaaaaaaacttatgacaagttacctagttataaggaaataagggtaaatattatttccttggccattaaaaatgttaaaaaaaaacacacaccatgatctgtgtgtaacaaaggaaagtgacacataaaccatgattcctaagtagtttttatctttactaccatcttagatccaggtatgtgtgaagtgggagaggattttcaccaatcagaaataacacaaccatcctggcaatctttctgttcatttaagtaccaatctaaaagataaagcattgactttttgtaagcaaggagcgcaaatcctgttcaaagcttcttttgattaaaatttttattcacctccttatgtccacatgcttatcaatgatccagcctgatttgcttgtttctaacatacaaaaaaagagatctgattcataaaagttaatatttttaatctctaagactaatttaaatatcagctttgtgcattaaaatattaaaggtttgagggactaatctttctcgtatataaggaaagtgagataaaagaataagaagtaaaatggttaaatatgaaggacagtaaccagctattcctagtcatacaaaaacccacaaaaaatggatttaaatcaagaatgataccaattaggaataagaacaaaaggtggttttcgattactctaatgaattattaaggtgtcttggatatagaatattcattcctggagatctaaaagaatgtccaaaacaatttggatcagaactgtctatatgtatctctggttacatgtggaaaaactatcataagccttgaacaaattaaagctgaaatggtggaaacaggaaatgccaatcaggtcatatgtgtatgacgtgatcacattacacttgggtttcagaatggaccattaggcatataatttctctgaagctctaccacgactctggtcatctatgggccagatgataataaaacactgctagttcataggaagtgactttaaggacaagaaattgatttaataaccagagagtatctttttgtttattttaaactaattttaattttatcaaagtaatacatgttcaacatacaaatgtatgaaagactcttaatgaaaaacagtaatccctgtcccatcccactccaccctagggacaatcactttcaactggcaaatatctcctctgctatgtatctccatatttcccataatgtgcctttactgctctttcctggtttatgaattttggatattattcttaacattctacatatgatcaaaaaggaattagccctcctcatcccaataccacattcttccaatataatggtgtcaggaattatgttcacccagtaacacagatcccaaaacattggctcaaacaaattagcaatttattttttcatagaacatgaagcttagggctcatttggaggctccaggatgtcatcagaaatccaagatccttctatcttttctgttatccagctttactaggtgttctgtcctcgtcattgttacagaaaggccccagtccctcagacattgcaaccattcctggtggagaaatccaggaagggcaaagagcaaacagtgtgtgttccctttaaatagctttcccaaaagccctacatagcacatagcagcttctattaaaatttcataggcctaccagacatggtggtgtgagcttgtagtcccagctacttgggaggctgaggcaggaggatggctcgtgcccaggagtttgaggctgtagtgcaatatgagtgtgcctgtgactagccactgcactccagcctgggcaacacagcgagacctagtctttaataataataataataataataataataataatagtttcatatgatcacctatacctgcaaagggggctgggaaatgttcttcagctgggcacatttctgccccaagtaaactgaggttctgttgaaaagaagcaaagggaagatgaatactggattggctaccagtagtctctgccataatatctatatcagaaatcactgccaagttaaggactgttctataacaatgcttcctttttttgtgcattcttttgttttgcctggagttaataatagcctcacatattgcttatatttatgtgtaactatttgccctcaaatgttacctatagtatcatttttcccccagagtcctaactccaggactcctccatcctcctgctacaatttagatggggcctttctaagatgctgcacacaactgcatgataattatgtagttattatcctggactttccttacttctttttatgttggttcctctattttctgggtcccattgacttatctttcttagtttaacactctcattttgctaaaacacatctttgagtggtttccaaagaaagagtacatgggatgcaaaaatgttgagccttggtatgaaaacaattgcattatattctgacatttgattgatagtatgacttggtaaagaactgtcagctagaaatcacttaatctcaaaattaaataaaatggagctcttaacttccagcactgcagttgataagtacataataaatcgattagcaaaatttcattattgataaagaagacggccttctactaatggagattttaaaattattaatattattattagtcacaacaactcagtaaacatttattgactgaccacacactctgtgcttgttgttgcaatggatatacaaatgtttgggcatgggccttgtgacggtttatgtgttaacttggctaggctgtagtacccacttattcaaccaaatgttaatcaaggtgttgccatgaaggtatattgaacatatatggtgaatatctacaatcagttgacttcagtaaaggagattatccttgataatgtaggtgggccacaccccattagttaaagcctttacagcaaaatcgaggtttccctgaggaaggagaaattctgcctcaagtctacagagtccgcacctgccagcctgccccatggatgtcagacttgccagaccccatagttacataagcctgttttatgtttctctggagagccctgactgatacaggcaatcacttaaaaaataattaatttaaataattttcctctttaaatttaaataaaaaattatagtaaaaaataaatgacagaaattgaagaattattcttgggaagtatgatattattgtattgaaatgaagtagaaagttcaattgggagtggagattttgaccacaggaggaggatataacaagcccttggtaaattcatgcataaaccatttttggcggctgaagcaggaggatcacttgagcccaggagttcaagaccagcctgggcaacatagcaagacccccatctctacaaattagtaaaaaatattagccaggcatggtgacatgcacctgtggtgccagctactcaggaggctgaggtgggagaatcacttgagtccagacggttgagggtgcagtgagccgagattatgccactgcactccagcctaggcagcagagtgagaccctgtttcaaaaaaattttaaaaaagtaataaagttaaatgaaataaaataaaaatcttaaaaattcatgcataaaccatttaccagattactcaagggcagataatgaagaatctgctatatttaatcttaagacaaactagatgctgttaaaatatttcacctttaaaagcatagaattattaaatagtaaggtttaattaacattaaaaatgacatgatttgctttgattccttaattttctagtgaggaaacaacaagcttagggtacatttctgactacatagattttttcccttctttccagtgttggtcatccaacacatttacacaacaagcaatagcgattgcactgggcacacttcccaatatatgaatttattcaagctgtgcaattgtcccctgagaaatcttgggcttagaggtatcaactggcttatctgaggtctattagccagttagtgaccaagtcagcacagaaaactgactccaagtcttatttggcccatccttgtggtatgccacattgtttcccttaaccaactgaaagaaactaatttaaggagtacctgtacacaggaagtagaaacttttttctctttttgtgactttctataagaattatagatgagatttttttttctaagtggggactcatgttgttgtcaacttaaattacctttactaatcacttcgaacacggtattccatacatttccctctgtcccgataataaaacaactggatttctgaaacctctgagggagaataaacatgctcttttcatagctcccaaagtctgtgcacttgtactgggcactgtccaggtggctgcatagacaacttcagcttgattttcattgacttttgatgtgtcctgacacacattaaaataacctatgtgaaattgctgatattcagccattttttacttacacaaacattcactccatgttctttgatctatgagatcactgagagaggtggcacaaatactgttaggtatcgtccaagggcgccacagcaatgcctgtccatgtctgagtagcgctgcctgtccaggactatccacccagaacctatgttaggtttgctacaaggtctgttaataaccaaacccgcacataactaacaagattatcgactaggctgctttttttgaagaagagctttcaaaacttccaacatcccttcagctaatatttgcaaacatgtttaatcacagatttgggaacagaacatctgttcgtttggtagagcaagctcttttactcacttcacctttcttttctttttcccttccttccttccttccttccttccttccttctttctttctctctttcttttctttctttctttcctttctttatttttttttcttttttttcggggtcttatttgtcgcccaggctggagtgcagtggcacaacctaggctcactgcagcctcgacctcctgggttcaagtgatcctcctgtcttagctccccaagtacctgagactacaggcacacaccaccatgcccagctatttttttttttttttttttgtagagacagcatttcaccatgttgcccaggctggtctcaaactcctgagctcaagcgatcatccgccctcctcggccttcaaaagttctaggattacaggtgtgagccacctcaccgggcctcactgtttctaataggtggatcaaatcctcactcaatgaacattctccaaaggaccatttatttcattcagaattttaaacatttccatttgtttatttgtaaatgaaaaagactttgtgtatccccacctttcattttttttagaggttttctgaaacatggaggcagcatattttatggcactgtgttagttcaggctgctataacaaaatactgtaccttagactgggtcatttataaacaacagacaattatttctcgtagttctggaggcaggtaaatccaagatcaaggtgccagcagatttggtgtctggcgagggctctctgcttcatcagtggctccttgttgctgtgtcctcacatggcagaaggggcaaataggctctctgaaacctcttttataagggtattttgctttaagggcatagaagatggaagggattaatttttcttggggcatttggggaaatcacgaatgagtggtgacatttgagattgttggatagttggtgagtgagtcaaaggagaataaaaatggaaggaacattaaaagggctcagtccttgagagaggaaatcccagctcatatttacctttgaggtgatgaaagcagaaggcagacgcagttgtagcttctactgaaggtgataaacagatgtgccatgggattaagctccagtatttaatggcaggagccctgggtagcttcctgtgtcctgtggctggggcatacctagggctgggatagacgcaatatttctcaaagtaaatcagagtcctttgtcagtgggataaaatgctgattctcaggctcctcagcaaacctactgaatcagattattttggtgcaggggcctggagatttgcatttttaacaatctccccagaggtttccttgcaccctcaagtttaagaaccaccctttcaaagcgtgatttcatcacccaggagacatttggtaatgtctggagacattattggtcatcacgattgtgggggtgctactggcatctagtgtgcagaatccagggatgctgctacacatcttacagtgcacaggacagccctcacgacaaagaattatcctgcccaaaatgtcaatagtgctgagattgagaaatcctgaactccatcatatgaagggctctcaaggaaaagtacaagaagtggactgaagtcagtttgtgtcactaggtggctccttaggctactcaggcagggggctagcgttatgggcttccaggcccagttatcggaccaccaaattttcacagaactgggcagagctcacatgtattgaacccatgcagctgacactcctgaagccaccaatgcattatttgctaagtaattttttttcctctgataccaacacatttaaaatctttattgaattatcgtcacaaaattgcggtcatttcttgggggaaaatatgccattagttctacacaaagtactctttgctcaacttgcactttcttgaaatccagaaggtagatttacattaaaatcatgttggctaagagttgaaaaaagttattgcttatatggagttaagaaagcaaactttggaaattttttttggtctgagtttgtttctaagaagccaactacttctccagctctcctgcaatcctgccaaggtgatgtccagcttgtccctgttaataagttcaacagatcaaccctgtagggaagccaaaccatagagaaaggtggatgcactaaatttttttttttctgaacaaaatgtcagtgtgtattgttctatgacaatagtgttatttgaaattatgcctcgggccttcagtaggtaaagattcttgttcatttgctgcatttcaaaaaaattgtgtgcacgttcccattaagatttatttttcttaaattgaatatacagttaatctatatgcagatgaggtaggtaacaccctcctttctggattgttcgttttagttaaggtgttactcataacaatttggtttcctttccagtcttttgcaaaagtagggcttcagtgcaagatatccttttaaaaatacccttgggtcctgagtgttgaacttttctggctgaaataattttgcaccttccaaatgttttaatgctgttagggagctcttaaaatgcaaggatttaaggcccttagctagttaagcttttagcagaactagagctgttagataagaatagaactcatcctttacttttggagctttggacattgtttccagctgcttccagtcatttgaatcccgaaagcgcccctaatcctcgcggaggcagcctttctggctcccaggacccacccccttgcttctgattggcgaagctcctccgcggcccaagccagccacctacaacgtctctgagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcaggtaagctcaggcggttgcgctggcggcggagggggcgggcgccgcccgggacccctgcgacgtgttactgcggagagcttgctgggttagcaggcgcctggccgtagtcgatgcgtttggcggaaagacggggctgcattttcctaagacaaccaaagaagcacattttacctgagccaccccggtctggtcctcgccacccgcccccacttttgcctctaattgtggttgatgtcaggcagtcgttgtaaagggcttacaagcagtttgtagaatatatgtaaatcaattccagtttgcggccgctggaatgtatcgtgcaggatgtatctcgagcttttagtgcctctaccctatgctttgggctagaataaagacagctgaatgtcctgaaaaagaatttcacggggcctcttatctcattttggtttcgcattctgagcacttactgtgtttctggcggagaaggcggaaccagcttgaaatgagcacagacagtccttccagaaaaatgcaaatttgtttttctgttctagcagtttggaaactgtattgcttctggacgtgagaaggcagccctgaaagtagtgagcggagaaagggctgggggattacttaaatgagtctttgaaaagaattctaaaccaacagcttcttctgtggctctggggcatgatgataaaattccttatcagtccaggaagaggtttatagctttgctgttaagcaagaaaaggaaagaaaaagtggatgtaggaagccaaggagagggtgtgatttacaactcaatcaaagttatggaagaattttatgtcaatatttaaatatcaagaacaatactcatataaggagaaaacaaggctggaaaaacatgccaataggcttggaagggcagggatttcaagaggaatgctattgcttttaccagctctgaataaatctggatgggaaagttagcatctgtatcgcaaccggaaaagctcttcactttttcttctaagtgggttgggtgctcgccaccctgcacactttgggggaagtgagctttccatttaagagcgcaggggaggggtttcgaactttctgtccctttcccacagccttgggagatgaagcagagcccccttcgaatggtcagcgcaaaccctccgccttcttgccccctcgcttgttcgctcagcaagcaggcttggcaagtttcagtgagtgcagaaaaacacttgcggaggagcaagtgccgtctgcttgcaatgaattgcccttgccttggtagggactgtggggaggacgtctttaagttctgcaaactcacagtccaacctcatacttttaatgtctactaaagtgggatgaggaaaaggaaggagaagggtaattggaaaggattgaaaaggaaaaagaggaacgcaaaacatttttgacaaaggtccttagctggaacaaagaagttatttgatcctgtgcagagccacctgtcctctcctcggtggtgtctgagctcaatttccagaatccctgttcccacacaattcctcaggaaccatggcagtctccgtgccttatgcctaaggtttgcttcccccagcttggaatggtttttcccatgcctagtttgttgtggcatttacgtgaagttggaaaacagcccagtattgaaattttaggggtacaagtacacatatagtgaactccttagttatttaatgaatgggcaacttttcatctcacagctacgtatgtctactaatttttttggcctgttcagaactttgaaagagggtgggatggaacaggggaggagatgaaggagagagacaggatcattgttcatccaaagaacgaggacagtttccagaatctagcatgttgttccactgcagtcagaacaagaatgtagggaggaatgagatggcagtgttattggcatgggttaatccctactttatttgagtttctcttggggaaacctgactgttgcatccaggcagggtgagtcgaattcaccagccaatttgtcatctcagcccggcagctccagctggatttacagggttaactatcaaacagacctgtgtgtcatcagctcagcaatgaaattggatctctttgctgatgagtgatctgtccctagggctgcacaaatgttgtacactggtgtggcagcccagaagagacccctgcctgccactgatagccagaaattctgggtagccagaaattgcccgcagaattagaaggctgtttgcctagctataagattcagaggggtttgggcttctgccaggttggcagaaaaggaacattcctgaagccaccacttcaggtgtagaaggatagtattctttgagggttcctaaggccacggctgagttaggccaaagaaaagtgtaaatctgattcaccttgatcaggaagtaattttaaaatatgtgccaacctgtctctgccctctgatcataaacgggaaacttttatgaaccttccttgagaaggaatttgctctgttcccaggcaaaaggaaaagcatggccacctgttctagaagcctggccgaaaacaacaggtttgcctgtggcattcccgcaactgcatatatcctccccacatggcaagccacccattgtccctacacacaagaagaacaaatagttcattcttgagctgggggaaaaatcagattctctaggcaaaattgcctactagacatattttgtgtttttaacatcctgataactttagaaaaaaaactctaagggaagaaggtgcatgatgtatttctgatctactaaaacaaagtaagtcacgtagctgctaaattcttgcaaggccaggatgctgctgtttcaaggaagccgtgaatctgtttggttagcccgttctgcattctttagattggaattaaaatgcccaaggacatctggcttaataatgaaagtcttcgtattaatctttcctctgaggattagaaagtcctttacaaacacgatctatttattctctgccacatccccaggagagaatgaggtggcaatttgatcctcattgaacaaatggtgagacgaaggcagagaaaggttaagtataaagagacacagcaagttaggggcaagtctggggatgaatactcacccacccagaaagactacctgtgcaggtttaggatctcaaatggcattctagggattaaaacagaatctctcttacgacattctttttcttatcattctgtaactggcaagtatattgtgtcccaagtatgttgtatggtttccttcatttgaaagtccagactcttaacagttcaaaaggcagttctgttctcatttctcccaacattgagatcaggcagcttttatgaaatctaatagaaagatacagtaactaactggaattttaaatatgcatctgagaaatgttccctttcaacagatgttttaagtttttgcacatggtttatagagctcagtgtcttcaacatatgttaaaattttaatttcttctctgctatctctctttcagcaaatgttataatcataagacttgctgtcagtttaaagatccttgttggtcattttgaaataatttttttgagtcatgtttttagttcgcttggctgtagaccgcataggctacaagcaaatccgttaattggtagttgcatgttatccacagacattccagcaagttttaaggctaagtgcatatgtggatgtctcctggctttgatcgtttgtgtggtaaatagacatccaaggtagctatggcaacctgggctgtgcgttggtgaaaggaggggatttagttactggacaaagagtaatttgtttgattagaaaaaggtaggggcaaatcaggacatttttaacccacatgatttgaggatcccagttcaatcaaatcatttggatttttctcaataggcaaaaagaagtaatggctaagcgcaccagagtatcttgcagacgtaatttaattatttttaaacaagtggttgctactttccaaaagcaatttatacaatgaaaaggaagtacaatatatcatataaatatcatcaatatccctattgtactaagtatgaacgtttttattttcagaacttgatgggactttgaaagaccaggatctgattagaggtgtgcatttcagttatctacctgcaggggtcaggcttgaagttcccgtggtcggaagatcaggcagcggacttcactgcagggagcccgaggcagagtcagagagaattgctctgcttatttggaacaattagttagcgattctttaatcttgtgaccaaagctactatgaaaatgagttcattcaaggaagagaatatcaaatacgctgtgattaaagaaagggcgataaagccaggtcaaacagcaatctaatctccgtttacatgtaaggcagtttatcgggaagattctggctcattatcaattcctttgatttcacacaaaagtgagctcagcggttttgttctagaaatttgtttgcccagttttatgagctggcatgttataaaaatttctttaaactaaaaaggacacaatattagggagccatctggatccgaaatatttttccccctctggaggaaaatattccattgacacaagatcaggatggttaatggcctccaggaggtcaggtgatagtaggagcacagaaaattgaggcgcagaacaaaatgccaagaggggactttcctgaaaaaacaaaccagaccaaagaaaataacttacctgctttgcgctatgaaagagaggttctgagtaaacatggaagaggtgctgatcatttgtagtacaagtggatgttgaaggtcttatattcagtccagtgtttatgatgaatataatataaaggctgtccttcctttcttatatcattcaatgacatttactgagcactcacagaattaatatattctgccacattatacgtgattattaatgtgccagggcactttctgggttccaaatatgactttggtaaggcccctgccctcaaagaacttttgatctggtgtacaatttattgtaccagtagcataatgtaggtttttccatggtcaaaatggatgctcattaatatctatatttgtatgggtagggatccacttgaaaaactgatggtatccaaaaccttactgaacttaggagacttgagaagtgatttgtaattgtgaaatttagttgatttttagcccacatgtccatttgtagaaatttatgacttcttacataaagcagatttctcataattattaaatagtaatttatttttctcaatagagaaaagtaactcataggtagtccccaatctaggaatactttatgttttaggagtttgttgtttgaaacccagagcattttccagcgaaaaataatcaatctgattaatgtgagatcaagttctgtgttttgaggacatgccactgtgttatacaggatggaaacagaaggagaaagaattggcatacttttggtaataggccagtcatggcaatatttgaaataggaagttcgtactagttttcacctttctttctccatccttctgatgtcttctggtctcactggggcatctcccccaggcctgtcctaatatatagtgaattcataattgttcatcttcccacccttcccttccccacctccaaaccactctcctgtttcctttagtcaatggtctctaccacatggcaggaaagaagtaatatgggtgagccaaagctcatgactcttatccctttaacccttaggatgaatctttaattggggaaatttcaagcagtggagcctggagctacaaaacacatgattttcctttcagggacaatatttgggggcagggccatgcctttggcagacagaacttgctggtgtgtctgcccgtgggtcagacctcttcatttgttctttctcagcaacctgcctgaacttctggacccactagggtctttgtgagtaacagccagggagccacaggcccccagttgagagggaattatggcgtttgtgggtttgggttgtttgtaagtatgctctttgtatgctgagcactgtctacttggattagaataaatggaaagaaaatagctgtagcatcctcttatccacacgagtatttgagttggtgtatatatttctactcgtttgtctgcttatcttggaactgagttactccagagcaagagtcacatattaattacctttgaatccccagacccaagcccagtgtctggcacacaataagaatcattaagtgttctacaggcacatgctgggtgaattttagtaaaaaagagaatggaaaatgctccttaaaatccgaagggatatgaagaagaaagggcattagaaaggtccgggaaacagcaaggactaaatagatcagtagtagagaaaattagcataggttatgattactgaactatatgtatatggttttatatatatatagtccatttatatacacatagtctctctctgtctgtctgtctgtctgtctgtctctctctctctctctctctctctctctctctctctatatatatatatatatatatatatatatatatatattcctttcagttgtgttctgggcaagaacacaacccaaaacatggtaagcagcttggcttatcctctgtttgattgttctgcagaaatgattacgaaatgggtcatgccctccaatagctcaaagcctaatcgccaagatagaatctgctgctttctctcattgaacccagcctgatagtttaggccttaggtccatgtgcagttgtttaattttgcaggtgagtggcatgcccaaggttactccagaactgagatagcgtgtctgagagaagactgaagccttctccatgtagatggtggccacatttttcatagtgaagttcaagatttgtgccggacaaagcattttcattgctggtaggtgtaacagaccagaagttatagttaaaaatgacaaaatagaaatttcagggacatttaatagtttatggaaacaacaggactaatatattaccaaagggtctatgcggtagactgtggtatctgtcctatgtcaagttttggagtgttgctttggttgtgtgtatttagaagtggtcttccccaaacaattcggaggaagggggatgttactgggaaaatggaattcattgaatgccctgctgagttaataataagtagatgaatggccaaataaagcaatatatagatggacggcaccaccaaatattattaatagagatttatttacttacataggatcaagtcttctgtacgaaatacattaggaatccagactaagaatactggttaaagtttagcatttctgggttgacgttttagcacaagaaacactttaccctccatctgggagcaaggtatgagggagacttaggttctacacctagaagctaagtcttctagactccccatctcattctcttttgtgactgtaccacatgccttctactaagatataatttggatgttttcaggtcatgtgctataattcaatatgctaataaattccaaggcaatttgaatggaatgttggtttataatgaggcaactcaggaaagactacatcatctttagtggaaaatactgtccaaaaaatccaaatagttaaatgatcttatatttgggttttgtgcttcttttatgtgtatattctttgctctgattttagttaagtatgaaaatgtcagacagcaaaaactaggaggattatatttatataaaagaaagtttagggaatgagatgagtcatttagcccatgaattaatcagctgtgctttgaggaaatagtgcaggaaggtaaaatggaacaaatagacgagagaagaaagcgtgacttcttttagtcaacatatgatggggaaagcggtagagaaaaattggctatttggtgagtgattcacttgagttccttttcagtggtcaatgtttaaagtgaaatcctaatgagattgttgctgccctttttgtacggctctgactaaaagagggaaaacagtcataataattaattgagaggggtatgactttctgagtagataaaaacatgatagactattagataatgaatatttattgcttgatgcttctcagtctggaagagacactttctgaatatttctccgctttctaacatttcagctgtcagaattgaatggttcacatataaactacattgttttggtttaactaacaaagagtgataagacatgaattgtttgtgacagccccgaacattgataacagaagacattaatgcctgcagacacagcctacatggtaaaaatctggaaacaaaaatgcttattatgttaggccatcgtgctttgacctagttttgcttttctgcttggaaattatgtcaatattagttacatcatcccttcggatgagcaattccacattcttgtttatttcagtgtcatattattagtttttgtatatttagttctgacctctgaggagccaaactaatcctcattgacttgcattttccttttgaaatgagacttctgcatgataaagagagaggattttatgtattaacaaaacaatctaagatgcctctttaaaggcattcatttctccttgatccggagctactgccctcttgaaggttcctagaggccatccagttttctgctgatcagaattagtctttttttctttgtcttatggggatggaatagattactgggcctagaactgccatagttgaataacaaaaagtaaaactgtgaggctgatgggacatttcccagcccatcatccttaaatttgcccttttcatgtttctgctttacttcttcatccagcagaaacgggcttagcatatttttcccatttaacatttttattgaatacttttcaaaatgaattatttccgcagttgatttcgaacacatttttttctgtcatttaatactttatatcactagaggaaagaaccatttaattctttcatacatttatgaattctaatcttcaaagagtgtgagttcttcaagtgatcaacttacatcaaatttacaagtataatttactaccaaaagaccttgaacgctttttggtgcacatgttttggcattccttattaacaaatgtaatgaggcaaaagcccacaagaatatgtattcctggttcctctttaaaaatgtaccatttgctcttattttctaattaaggctttgaaggttaaaaatccctttgttgttagctcctttacaagtctcctgcctgagtgcagaaaacataagaagggagtgtcctcttcagagcataaccaaaccaactaaattttaaccaggtaaattgttgattagcattggatcatgtaaagaaacagtatgaaagtaattgagataggcacaactcctaattgtgtgatcccagggggcttcaaacattgtttgaaacattcacctcagagattatattccatgtctgatccttatgctaatttgaatactaggatcctgaagaaaaactttataggatttcttgagtccctaattggtatgtaaacatcgtcattcccaagctgcccaaagttgtgaattatagtataccatgtgtctcctgttgtgatatcaatttctacagcaatttttctgcttgttgtaggcaaatgtaaatatatttccctcctcttacacaaatagtggcctttcacatacattattcttcaccctggcttttttctgctttagagtataccctagagatctttccataacagtccacagagagcttcctctttaaaaacaaaacaaaactgcatatcattgcactatgacgatgtaccataattgatttgacccttcccctactagtcacgtggagtgtgtccaatattttgccattaaagcaatgtgcactgaaaaacgttgtgttcatcagtttgtatggggcggatgtatctgtattaaaaatccccagaagtgggattgctgggccaaagggcaaatgcagtttctaattttgataaataaataacattgtctaaccagcctgtgtgagagcactgccccagagcctcatcaatagagagcattgtccaacttgtgcacctttgcctatctgatatctgaaaagcggcatctctgtgtagctttgcattctcttctgagtgacgttgagtgtctctgcatgtgttgaaggtctatttgcatttcttgtgcaatgtctgctcatatcctctgtttagaaaaacaaaaagaaggccgggcgcggtggctcacgcctgtaatcccagcactttgggaagccgaggcgggcggatcacgaggtcaggagaacgagaccatcctggctaacacggtgaaaccccgtctctactaaaaatacaaaaaaattagccgggcatggtggcgggcgcctgtagtcccagctactctagaggctgaggcaggagaatggcgtgaacccgcgaggcggagcttgcagtgagccgagatcgcgccactgcactccagcctgggccaaagtgcgagactcagtctcaaaaaaaaaaaaaaaaaaaagaaagaaagaaagaaagaaaatgccaggtctagtacaacgatgtttgatgggtttttttgacaatgataaaactactatttagtaagagaatcactcccggcagtagacttagaagcacactatcagagaccctcgagtaaagaccctaacgtgccacatcttaactctgtgaccttgggttgattccttaaacttcccaagtttcctcacctgtaaaattgaaatgatgtggacaactcacagggtttatagaataatcactaaatgaaggattatatatataaatgatatataaagcacttaacagagtattggttacatactaggcacttaaaaatgttaggttaacttctctttttttaggtacaaacttaaggtttcagagaaggctgggttttatggacatttctacctcttaccctctgaatgaatacacatccacccacacagaggcatgtaaatatacacatatgtacacacggtggaataatatctgaaatggctgtaatgattcaaaagcatctctttagacaaatgtgtgtgtgtgtgtgtgtgtgtatgcacgtgtgcatgtatatgtataaatatccctgtaatgtaagaaaactaatttgttgctaaaaatgtacccttttcggacaaattatcctaatatgctaaaacaacaccaaatagtattaaatggacatgatcacttatcactacctttcatattataatccaaaaaagcatatttttccttcatctatcttattctttacaacaattaaactcttttacaatgttacacaccttatacttacagctatacctagaaataaaattacacttatactcatgtttatgtatttctgtctttaaaacaaaaaaataaacacagcagtaaatacaaaaggtagaaatggaaaaaatgcattttagagggcatggtgctgagggctgagaatataacactggtctttaaaacaactctaccactgtgaatgagaccatttgggtgatcttgtttcccagggctgtgttgttacagaaacataattttaaaaattgtattttgaaataattacagatccataggaagttgcaaaaaaatgtactgggcagtctgcaccctttacccaccccttaccccatccctaacccccagaaaccagtaatcatctgttctccatctctataattgtgctacttcaagaatataaacgtaatcatacagtatgcaattgtttgagattgacattttttcccgctcacttaattttctagaggtttatccaagttgttgcatgtatcagtcgttttttcctttttattgctgagtaatgttccttggtgtggatatatgacagtttaatcatcaacttgtttaaggactttggagctattacaaacaaagttgctatgagcatttgtgtgtaggattttgtatgactgtaagtttgcatttctctgggataaatgcccaggagtgcaattgctgggtcatatggcaagtacacattcagttttgtaagaaactgccaaagcgtattgcagagtggctgaatcattttacatccccaccagaaatgtatcagtgacccagctttctctgcatcctccccagcatttggtgttgtccctgttttcattttagccattctggtaggtgtgtagtggtgtctcatttgtattggttttcaaaaagtgcagaagatacttcataatccagtttgggtgtgttcaatacctcccaggtaaaattctcacacataatatgggcctatcttggtacatgactgaattgtcaaaaatatctatgattgctgccttttttgttgaaccttaactgaaatattgagagcaaaaaagaaactgtgttgtgcaaaatatatccgaacattagactgggcttcaatttatactctgagacactcagagaattgttacttgctcaagacatggcagatgcacgccccaacacctaacttcactttaggaatagacacattaggtatcaggaaaaattgctaagactatttaaattcctctccccttttccaacatattccattgcctttgcatttgcataaattaaataggggcatgatctgtcttcattgtcaatatacatgtagatgtgtgtaaatctacaaacatacatatacacagacatacatacactggctctgtgggcgtcaatcccaaatgttccccaacatccagtctagattctcccgggtcaggatttctcaactttggcactattgacatttggggtttcataattatttgtggggctgtcctgtgcactgtaggatgtttagctgtatccctggccttaagcaactggatgccagtaacactcccatgcccccaaagtgtgacaaccaaaaatgtctcagcacattgcaaaatgtctactgggggcaaaataaacctccctttgagaatcactggggtagacagaagagaaggagaatctcaggcttcaggttacctcactgggtttgctgaaacttgataagaatctccttaccagcggggatcaggttttggtgcccacctgttcatttctgataactaccaatctctaaatctgtttctgcaagttatggctgaagattagtggttaacagagaacgatatcagcctttgtttcttaaagagcttatattcaatgctttaaaatacaaattggatctggcactgttgtggttcacacctgtaactccagcactttgggaggccaaggtgggaggattgcttgagccagggagtttgagaccagcctgggcaatatactgagaccccatctctacaaaacaaataaaaaattagccaggcctggtggtgcaaacctgtagtcccagctacttgggaggctgagtcgggaggatcgcttgagtctgggaggtcagttctgcagtgagctaagatggcaccactgcactcgcctgggaccttgtctcaaaaaacaaaacaaaacaaaataaaataaaacacaaattgaacacacataattgaaaagcaaacttcatgcatacctggttttgttttacttttaatgatgttttatcacttatattagatatcatgattattttaacagatacaaaatttaataggtaataaaatacctcataaaatagggtatatctccatatgcatagagaattttatagagaaattggcacaattcctggatcttcctctgattcaatgtgtttatctttgaattctaataggttttaaaagacatttaaagaattgcaaaacaggcaaaggaaaatatgatagtgttttataatttaaattatgtctacatggcaacaataattattatataaattatagaaaatgttatgtattttttaactttataaatttacccctacttgataaataatatattttgtatttattacatttggtatataaatatatttctactttagaattaaaataaggtgaaaatagttattttttgaaatactgttaagttgcatattcttacctgtattagaattaaaatatgtatcttatatttatatataaattacaaattacctgaaaaaagaataaattataaccgcatgtaaaaataaaatattcctgtatcagttgtgcaatttaaattccggttttagttttcattctttaagttgttacatttggaagatttggatagtagttatcatgaactcactgttatctatggctctgacagtaaaatacgccattgagttgtactgtaatatgaatctcccgggaacgctaagccaattcagaatgaggcattcctgtctcaggaatagagatttataaagtgaccggaggtatcactatttctagaggaaggtgcaccttgaagtattctcattcttttctatgcatttatgatcccagcctactaaactcaagcaacacttcaatacagcaaagcctcttggaagtatatgagtttaataagaaaatttatgaagaaagaatacactgaaatgcagactgacccccaaaataataggatactttttaaaaaatgtattagtttcatagcatggcaaataatactcaaaaatactttgaaaatgcacattttaaaaatgcccaaagggtttagtagattatgttgagagaaggcattggaggaagaaacattatagccataagaaccaggaaaatgatcctcctttgtttataggattacaaagaggaattttaacttctaaagtgaaaatacaaattacttgtgtaggctaaaatcacccttcttagaggaaatggtacaaattttcttcatatagtttatgttcctccagaaagtctctgtgaagtgataacattataactgcatgcattctcctggtgacttcatttaaagtctgtgatgtagtaacatcatgcacacttccctttcctacagagcccttatgttctctatagaccaagaggttaattaatttttagagttatatagcaaagagttgccagaaccccaaataacatatctctaatttccaaaattgcctgacaaactatattttaaagaagccatgttattcttaggataaacctaataatgtcactttaatccccagtcatgctcatctttgcctttcttccaatatgtgcaaggaatatataaggtgaccttttaaggttacagtatcttcttacaaattagagttgatgcactgaggttataacagcagctgagcattctcaaaagctgcagattgagccgacaggcagattagcaagtacataaaatgttagtagagaaaaaaaatagacttcaattttttggcaatcctgttaaacaactctgtgaataagtctttgaaacttgtacagtggaaggtttgaattttcctcaatgcctggcacaaaacttacctatctgttgcatatgtgcattgctgaattaattaatggaaagtaaaattttaaaatgtaaccttggttatttgggataaaatggcacttccatgtaatggaatgtcataactgaaattgtagggattttcagatactctagctggcactaaatctcatcagagcccttcaagttataacataagatagcatattcaatatgagaaaatatttaattgtcagccttaaaaatgtatatagcagaggcaatcccttttttttctgacaacaaagccttctaaaagcttttcaaactatacagctttgagatttataactttgaaccaagaaaacataatttcaagaaatgaagagaacttctgattaattctagtctaaggcagtgaagtcctgctagattttaaagtattatattcttcataattaatgtcaagataggttcctccctgtggctcattattttcttgtaaaaagtacatactgcctgtgtttttaaatttcaggttttctcatgccgctcttgtctaatgatccagcaagttcaggcatataatacttttgaagaatctatatttaaagactaattatttatgcatgtgtgtctatgtattttgaaatatatatatttcaaaagactgtttttagcctttggctcaaatattttttttttaaggaatataatattgaatatctggacaggttaaaaatctccaacatttaactataaatgttaactaatgctttccttttcatttgttaaattgctgcataaatgctttaaaaagtatgttaccgttggcattaagacatcatctcttttacttaccaaagtgcaccaatctttgggattgaaccattgtagctgctttaagccaaaaattctccccagccgggttccttatcatcacccttgccacagaatctatatcgttgggagttaaagatctttggtctcaaaccttatcctggttgaattcctgtcatatcaccagcaacccctttctaatggcccccaggaatgctagcacaacaggggatcttcaggaggctcattccaatgagagacatcatttgcagtgacaaagtttgtccttagatgaaatctgtatctctctctccctatagcttttacccctgtttggccccctctctacaacacagaacacgtgcagttactctgttctctgacagctcttcaaagacaaagctaacatggccttctgggggcattttttccaggttaaatatgcccagatgtgcttgatttggactctatcctttaggatcaagccatgttagtaagtacaaatgtccaacatttaaaagaactgttcataagagagactcaccagattagaggaaagagataccattcagtttctaatacacagtgaccttaatgccactattttaagctctctctgcctggattgtagagactttgcctagtttacctctggaatagaaattctgaacctttgctagtgagtgagcaataacaatgatgacagacatctagctagatactaagaaaaaaagtcatgaatgaccaaagtgtgaattttgtttctttgcttgtctgataccccatggctatttgcaatatcttattgtcatgtgctaaaggatttaggatattaatcaaagagaaaagcggttctaagatggaagaaaagacaaaaatgtgggcagataagtaggaaaagaaggggatgaggattcaggagctttttccaggtacttggaaagttgaaggcaacttaaatcatttttaataatttaagaaatatcatttttcatttttatataaaatactaaaagtctggaaaatatataggcaggcacagtgtgttggcaatatgctgtttacaggttggcaaaacaagccagtgtctaatgaaaaggaaggttgcgaagagcttagatctgaaactgagaggcatgtcttgttccacaccttgagaaacacttggcatataccaggtgctctgtaaatatttgcttagtaaatgatagaatgagcatgtggtggcagaatgatgccttacatggcattacccagactcataggcatccctagggactgtaagaaaagtttgtgggcttttttcagcgttttgaaaaacccagaagatattgtataattactttttcaatgattgttttatcaaatacttctaaacctgaggatttatgaagttaaaagtgaaaaggttttttaaaaaatgttatgccaaatgagagaagccagtcacaaagggccacatattgtatgatctttttatattaaatgtccagaagaggcaaattcatagatccagaaagtagattcgtggttgccgggggataggggaggggagaatgcggagtgagtgctaatgggtatggggtttcttttgggagtgatgaaaatgctctggaattaagtagtggtgatggttgcaaaactctgaatatactaaaacccactgaattatacacttgaaatggatgtttgtaatgtgtgaattgtatctcaataaagctgtttttaagaatgataagcatagcatccaagcatttaaaaatttttttaaaagtggtcattggtggtaaaaaaaaaaaaaaaaaagtcagaaactatttgcttaattgttacagagattttatcccagattaaaatactccaattccgcactttgggaggctgaggcgggtggatcacgaggttaggagatcgagaccatcctggctaacatggtgaaaccccgtctgtactaaaaatacaaaaaattagccgggcatggtggcgggcacttgtagtcccagctactcgggaggctgaggcaggagaatgggcgtgaacccgggaggcggagcttgcagtgagtcgagattgcgccactgtactccagcctgggcgacagagcgagactctgtctcaaaaaaaaaaaaacaaaaacaaaaacaaaaacaaaaactccaattccatttcgccaaagggaacaagcagaatattcccacaaccctagggaacaggggtaggcttggctattagtcattctccttcttccccattcccaataattggaaaaaaaaatgtgtgtgcacacgtacgtgtgtgtgtatgtatatgtctgtgtgcatatgtgacaagggcagtagtcagagcaggatcatgtgactaccaggatctatggacagccccacactattaggggagaaagtgtcaagctatttgtacggttcttatagagcatgaatctaggccaggggtcagcacccttgttcataaaggaccagacagtaaatattttgggttttgtggccatgcagtctctgtccaaacccctcagctcgacatagactatataaagcaattggaggtaactgtgttccaaaaaaactttatttatagacactgaaatttgaatttcacataattttcacaagtcacaaaataatatttaaacaatttttttttcaaccacttaaaaatgtaagaaccattcttagcttgtgggccacacaaaaacaggcagaggcctggatttggtacataggcggcctgtggtctatagtttgcagaaccctgctctagggtaatgactgagaaagggactctactaatcagcaggttgttgggaagcacgttacttaccttaagccagtataaaacttaaagcaataatgctacattatgtctaaaggctaagctagtgagaggctaaattataacactcaacttttttagcaaataattatgaagcatcagctaataagaccttttcttaagagtattcagagtataataatgctaccttgtgtggtttggggatttttattttaagttagggaagctatgaatctcttgaactttgtccattaagaagtctgccaaagctgtgaattttaaagccatgggaatttttcattgcgcttggctgctgaattttaacagcaaagttattcattaagtccacatttaaaaaaaaaagtatcaacaatgcttctttatactttatctgcatttgacacacttccagatagatgatctttaatttgactaatgagtgcatcctttgttattttaatgacaagtaatttacagaaagagaaaagcttttcaacacgcaagtctcttaaatctggaatttaaagtccctgatgttcagaagcaggaagcaacagttggtgtaagacagggccactaggacactggaaatgcatcctgggtaatgagtgggaaatacaaaaggaagaaaacagttggaaatatgttggccattttatatgacactttctgggtttattttcaggttggagcacaagtcagaagctgaagaacttggagattttggggagcatatgtcccaccttccccaacccccaagtatccaaatatcccctttggttctatcagagaagtattaagatttattaattagaagaaaaattaaagttataaatgttcaataggaacataaggagaattcaaaaaaataaaatgttgagctcaccacagttttcagcagaaattttactcttttttttttctttgttgagatggggtctcactatgttgctcaggctggcctcgaactcctgggctcaagcgatcttcccacctcagccacccaaaatgctgagactacaagcatgccactgtgcccagctaaattttactctttaactgatttttcaatgcataaataaatgaataagtgggtaagtacttactgaggacacagttttcaaccaaaccctgtagatactcaggatgaattaagcatgggccctgccttcatggggcctagggtttactcaactttacagaaaacccagaaatatcctaacaaatgtggcaactgaagaactttattcctaatcctaaaactcactttctttattctcagagcaatggatacagcattctaatgtcaaatcattgtttccatgttacacaatactctaactgtcaaggctaaaccctgtcttaaggaagggtgacaatggctttgttcttatgataatagaagagataaaaagattatttacaaagctacagcctctgaaaaattggaagtattttatacaaacaaccacctcaattcttctcacagtgatatttaagtgtttgtgcgtgctggtttctgttatgtgggtctttaccattttcattcctccttgcagctctatgagttaagtattactattattcttttacaaatgaggagcatgaggcctggaaaaatttaaaaacatgcagaggtgataaaatactgggaaagtttcacattcaaccatgtctgatgcttaatccttttccttctctttccaccatagcatatgatcatggcatatcatcactgtttctgtttcccctatagaaaattcaggaaaattaacacatggaagagtattcagactttcacttttcttcttacataatctttgagcagcccattataggaaaataagggcattggagatttgaagaggcagaatgaacacgttctagatgtagaaagaaaagttctaagcaggtaaaagacaaccagagtgaaatacaccagatggatgcttgacttggagaagatgctaagcactaaataagccaggtggtagagggtgtgaaagcggagagccctgagaaattgatcattaagcggaaggtgattaaaatcttcctaagggacagttggtcagagcagaggtcaagagctaggacttgtctggcaagacttattgtggattcttgaagggttaagaagtcagtcagagacccgggattggatactgtatttgaactgattgtcactcaccagaatctgtgatctaggagacagacattgccaggatcccccccgtcaggatggtcatagagaagggaaggtgtgttcatttactattgctgcatagcaaattagcacaaatgtacagattaaaccaacaccccatttattagctcgtggctctgtaggttgcaagtctgggtggcccagctgtgttctctgctcagggtctcacaagactgaaatcgagctgttggccagacgaagctcttatctggaggccctagggaagaatttgctgccaagctcgctctggttgttggcagaatttactctctggcagctgtaagactgaactccttgatagctataagctgtggtccactctttctaagggacatctgcattccttcttaagtggccatctccaacctcaaagcaacagcacattgagtccttcacacacatagaatctctctaaattcctctttcatcagtcaggaaacgttctcagcagttaagggttcatgtgattaggtcaggcccacctgcatcatctccctttctaacatcaactgtgctctgtaacacaacacaatccaaggagtgatgtcacattcacaagttccagggcttcaggtggacatctttgggctgccattttagaaagtctgcctaccacagaaggtgatgaagaatctcagctcctgccttgctccttggtgagctgtgtgacctgtaataacagcagctttgtggaaaattggcccaccctttcctagggttaaagggccaaagcgaagttttgtgactttttcttcctcttctgacactggcttcttcctctaaggaaatctgctgcttttggtgttctcttctttccttcaccatctcctggtgttggtgccaagaagcactggaaggcaggtggtccatcaatttagggcaactgaaggttttgagatcaaggcatactggaggcccagacatcacaagagggcagcacagagcaagagctgataaatgttgagatgcagacttagcaggccctagctctttctgagatgatgtgttcatctgccctcaaaacatcctctcactcaacatgtgcctcctaacccagaccccaaggagtctttagtaagaacatggcagatatcacatgtgctgaccatggggttatcacaaaacattaactctccaaaaatctgctgcttggaaccttggtttctgcaactaagaaatgagttaaaaatgtattcaaggttgataaatttaaaatggaaaaaatcatcttctgaactctagcaatatgaaggccactttttacaagtctgatgctgtagtgcagtgtttacaacctattttcattttcaaccccctgtcacaaggagcctgttgaaacattttttgctaattgctccttgcatgaaattttaataccacaaatatagtataaatctatttatgtatatctgtgctttgtgcataaaaagagtaaggttttttgtttgtttgtttgtttgtttgccactgagaactagttttctcgctcttgggggcaatattgcccctattgacagtgcatgttataatggggaaaaattgctaacattttaatatttagtaaatcttcagcttatatagtctatttgatttggaaggtggctgtaatactttagttgtactaaaaggtacttgaaattaatcttgaaaagtcagaagaatctttacacatgaaaaatcacccaatatattatatttaaaataacaacttgcaaaacaaaacgtaaagtctgatcccatttttgtggctaagaggtacagaaaatgactagaaagatcaacctgtggaatgttgcttctttgcggttagatccttctataggtgttttgctctttgggaatgttataaatattcaccaatatacattatacatatgtataataaatacatattatattcatgtcaagaagaatactatttaaaaagttagccattctctctctctctctttttttttgccttcaacatttaggattaatgggcagtataaattcaatcattcacatgtagcaaaaggagaaatatttcacatggcccattcatgactcctttagatctctagagggcttcaagcctcaaagtttattgttgcattcttcttaattctggttgaatgcatgtacattattttctgcaaagaaataccacccactaaagactgttccttctcttctaacagggttttggtgtccccagggctcccttagtcctatttactttggatatttcaggagttactgtaggtttaactgtggtgagtccttaagccctctttttaaattcataaactgtctctaatcttagcaaaatgtcaggttacacttttgagaggtttgggaacttgacattttgtagcccagttggggtgtaggctgcttctattctgagcaccttgttccaatttatgtcaggaggaattatatacaggtcagggctgggagcaggttataattaatggggtggacaagtggatttttaatgtttcataaaataaaatggaaatcacatgttcttggaactgttgtatgttttaaaatatttacatttattctagtaaacattaattataactgatatatttctcctatgaactcgctaactgtgaggtcacaagccattgttcactgagtagaaagaatgggtgacaagctagttacaagaaaaaagacagtacttgggcgggtatcggtgagtgaactcgtggaagtaatccagtcttaggtctttctcctaattttctcttatgtttaaagcacccccttgccaatatgatccagatgtcagtccttctaagacagaactgggagggtttagcctgtgaaatttctgaatagctcctggtgaagaaggaacacatgaccaatgtttaactatttgtcttttcaaaattaaagtttagaagtagttgaaatactgccagaatctacagcgtccacgttttattcatattagtttatcaaaaatttccaattccttgaagctgtagcagcaatatgttgctgaggaaagaaattttttttaaaaaaaatttgtacttataattgacacctaataattgtacatatttatggggtacaatgtgatgtttcagtacatggatacacagtataattatcagattggggtaattaccacatccatcattttaagcatttattatttctttgtggtgacaacagtcaaaatattctcttctagctgtcttgaatatatattacattgttatttgctgtagtcaccctactgtgtgatagcacatcaaaacttactcttcttgtctaactttgtgtacctattgaccaatctctacccgttcctcccttcccccataccctcagcagcctctgggaaccactgttctactctctactgctatgaaattgacttctttagattccacatatgagtgagatcatgtggtatttatcttttttaatgtttttaaattttattttattttatttataatttgaatttttattttagattcaaggggtaaatgtgcaggtttgttccatgtagtaattgtcttctgtgcctgacttattccacctaacataatgtcctccaggctcatccatgttgccaaaaatgacaggatttcatcctttttatggctgaatagtattccattgtcctaatcatccccataaagaaatatattttctttatccttttgtctgtagatgggcacttaggctgattccatatcttgactattgtgaagagtgctgcaataaacatgaatatgcgggtgtgtcttcgacatagtaatttcacttccagaaagagatctttaagagtcagaaaaacccagattctaaactggtctctgccatgtgccagttgtgtggccctggagaagatgctttaactctgtgtctcagtttcctcatctgcagaagggggaaaatgatacccactatttagggattgggtagggattagacccaatttgtataaagtgcctggcatattgtaggtatttttttaaatgccagttatggatatatgaaggaaagctccaaaaaatgaaattcaaaggaagccttatgtaaattgcatcacatgtcaaccatttgggtgttaggaatattgatgcattctttattttgcctagaattcatcactccctaaataaatattatttccattaagtcaccaaattttatatatattctttgtcttgtatggtgaagaattaatacaagtgcgctactctattagggtataacagttacctaagtaatgtatcatgagacctttttgcccttttctaaggaaaataagtatttattggaaggacaacttcacacacagtcagcaggtaataatccgcagtacttcccaatgctgcttctatgggctggaagagtgtttggtggttctatatggcacagggctacttgtccatacccttgacccaaggatgtcacgtgcacccaatcaacctggaaatcactgtggtgacagaagttggggcccaatcaccctcagggccttgacactgattttgagtataccagtttggaaagtctctgcagaattccccaagacattaagtttataatatcccttgaggggtccttagaaagaaaaagtgcctatgttttggtgtcattatcgttcttcagggcaaggcttggtgaaaagatactgagagaagacagtacagatagaaggacaaagcgaacaaaaataaggacccactgattttatctttgcaagctctaaactgagttacagattgagatctaaaatatatactcaatacatgcatcctcaaaatgttcttcacacatttgtgcccaagacatagtagttgataatattaatacataaatatatatacacacagatatatatgccttacaatacagtcctatttttagtgtgtaacaactgtactattttcaaaatagtcatcggcacaaacaccagtaccacggctaaatctgacattattgatcttttctccctctaagaatatcttttgtaggcccataagtgagagatggcagatctcctgagcttcattcagtcctttatggaaatatttatgaaaaccctactgtgtgctcagtagctatcagagttcttggcatataaaagatttcaaaataaatttgcctagtattgctttgggggatgaggacttggtgatatcttcctctccccaaaagaaaaagtggtgtgtgtgtgtgtgtgtgtgtgtgtgtgtgtgtgtgtgtgtcagagggacagagacagaggtagagagacagagtgtgagagtgtgtgggtattcagagagagaacatgagtcccagtcttatccttatcttccctcatacaatgcaagctatttggaattgtagagctggaagtgatcttagctaacattttcccaatctcctacccaatacaggagcgtcttctacaataaccttcatcaaagggtggaacgctaaaatgtaagactagaggtctctttttgttgggcaataatttgattcaattatggtgtcattatttggtaactcaggtggcacagtataaatttctgtgggaaattggaatggggagcccaagctggactggacatgactgcaccatggaaggaggacatttgggaccagtcttgagctgccattgtgttccactgggaaactaaacactagtgctttctcaattagtttatatatttctcaaagtattccatagtctttagtttgtgctaacaaaattgatcggaagtactatattaaaattatcattcattttttactcttactgaacagcagtgagaaaagcaggaatctttgtcattttgtttagcatgtaaatgcacaaaaacctcagcttacctgaactttgctaaaatgtcaaacctttattaaccacaagttttctacattatacttttcctaaagatttgtgaaatacaaggaagaaggtgatattatgaattactgtaaaaatccatggtcatggatacaattatacattcaagtcaatctcctacgtcatctctatttatgatcaaatgaaaaaaggtctttttaatgatgatctcaaggaaaaataagatttgaaattacctcaaacttttcaattagatccaatatgtgatttgtagttatgcaagtaaagtggactcaagcattgtagaaatgtttcaattaggattttttttaagttaattgagatttgatcatatttttattgtcatctttgttcccacatggaaattaattccatttcagacttatttcttggagggtgtttagcatagttatcaccttaaatgagtagggtagggtgcgtagggtggcttttcatttttggaatttaattattactctctctatatatatacatgtatatatatatgaaaaagaaagagcttgccttggcagaagtgtttaaagaaacatgagtagttaatgccctcactgtgatttgacttccatcttcctttttttaagcacatttttcattttttccccctttaaacctgccatttagagctgaaaagtatttttcaagaaatggagcaatgctttctatcccatttattaaagtaatgcacagaaggaaatgcaccgtggtaaaaacaatttatacgagaaatgataatgttttgctaaagataaccaggaagtgaggaggagaaaaaaacccctcaaatagcagagagaggccagatggtctttttttttttttttttttttttttttttaacgcagtccctaagcaggaaattttgtttgattaagaagacactggtcttgattttcattcagcagttttgaggaactttttttaatggacacacacacatatacacacacacacacacacacacaccacaagccattttcattcagccaaattatcatttgtgctattgtaagcaagattctgctgatgaaaatgtgaagtcttaatgataaagaagaaaacgagttcccaagtctcagttatgaaagaacttggaatttacccactaccctaaagacgctcgatcattaccatatccatcatattgttgtaaggtctggtgttttgttttgttttcttttgatagcctggaatggaagaaagactgtgtaccacagtggctaactagggttttgtgagatacagggtagacccgggggaaaaaatagaggttttggagttcaacaccccagggggctaatgtgcataaagcgactgctccaaaggacctgagtttaatccttggagctgccagtcaggatcaggatgaagaagcacccatgcaaagaattgcttctggatgctgataggcagggaggtgaagggggggaggtgggaagggggaacggagcacccctctttggactgtgatgttttggcagtcggtgcttggaggagggtagctggcagtggctccggcacaataaagctcccttcggtgaagtcaccagcatccttgccatggtctggcaccctttgcccagcacccctggagtgtgcaatttcccagtctgtattctaaggatgaaaatgactaaagttgtgaaactaactatttgcatctgtttcaaagagaaagagtcacttggaatttggaatggaaagaatagatttagacaactggcagaattgttcggaactatgccctgaatcaagagaccctgttgacttatataaggacaagctaaaggagctacgtaaaagagagaaccaacatatctttaccatgaagatgacaaatcaggcattcaaatttgttttttcaaaaatgaaatgtgttctcatatagttgtgtgatactttctctaatcagtattcatatttatagtcaaaataagtataacttcactttaatatagcttagccaccttgaaagctcactgttcttaaagctagatttttttgtaagtgaatttttaagccctagattgcatcttaagtactgagttattttaattttgcctttttttttaatgtttaaaagccagcttcttgtctaatttgattcaatggataaaatgtacaggatgaaactcacacttaaaatgcatttcaatgagaattaaattgtttaaaatgaaacttttttcctttaaattttaaataaacaaataagatgcaaagcaaaataacaacaaaaaactcttaagtcaactcccttggggataagggataaccttagggataaggtcataccttttgatattaactccaaactcatgccttgtattcgtgttttacaaattacatttataatttatctcaaagataacaaggaagcatactttgataatacaagaagaatctctcagactttagcctgccttgagaatatgttttaaaagccattagaagcttcctagcgtttatgggatttgttcttatatagagtacatttttttttacatatattttgggcagaattctcaagtctccaaataaacagtttaaatcttggcttttaggccaaaaagtctttgggctgggaataactcaccctcagaagactacttgctttataacccctcccctggaatgctgcgaccctgtcttcccacaaaccttatttgcttcactgtggaagagtggcacagggcacccaccacccagacttcccaagctcttctcttggtctctgctatagctacaatagcaactttattctcctacaactgagagaagagagacagaccctctcatattgttgtatattgttttatactcagaaaaggaaagagaagcaaaactaaaggcaggtagcccggcgcctaagaaccagacgcgaaaccaaggaaccagacctgaaaccaggcctgggcctgcctgacctaagcctggtagttaaaattccacccctgacctagcaactgatgttatctatagattatagaaagacattgtaaaacttcccggtctgttctgtttcactctaaccaccagtgcatgcagcccctgtcacgtaccccctgcttgctcaatcgatcacaaccctcttacgtggaccccccttagagttgtgagcccttaaaagggacaggaattgctcactcggggagctcggctcttgagacaggagtcttgctgatgcctctggccaaataaacccctttcttctttatctcggtgtctgaggagttttgtctgcggcttgtcttgctacatttcttggttccctgaccaggaagcgaggtgattaacagacggttgaggcagctccttaggtggctttagcctgccctgtggaacatccctgcgggggactccaaccagccggagcgacgcggatcctgagagcgctcccgggtaggcatttgcccaggtgggacgcctcgccagagccgtgtgtggcaggcccccgtggaggatcaacgcagtggctgaacactgggaaggaactggcacttggagtccagacatctaaaacttggtaagactagtctttggaacttgcccactccatttgtgtggaagcgtggtctgatcacccacggcatgcctttatcggcactttggttttggttttgacttggtttgaattgcttgacggaactggtcttgggaacttgcccgctccatttgagtggaagcgtggcctgatcacccacagcgtgcctttatcagcactttggtgttggttttggttttgacttggtttgaattgcttcacaggactggtcttgggaacttgcctactccatttgagtaggaacttgcctactccatttgagtggaagcatggcctgatcacccacggtgtggcagtaccggcactttggtttttgtttttgacttgacttggattgcttgatacttggattgcctggattgcttagttttggttttgacctggcttagatttctggatactctaattttggttttgattctggtttggtgtaaactgcaaaagtgtgtgtgtgccctttttacctgttctttgttttgtggtgtgcgtgtggtgtgagcatggtgttttgtctcaaagaagcatgggtcaggcacaaataagcccaccctactaggaactatgttgaaaaatttcaagaaaggatttaaggaagactatggagtactatgacaccaggagaacttaaaactttgtgtgaaatagactggccagcattagaggtggcttggccatcagaaggaagcctagacaagtcccttgtttcaaaggtatggcacaaggtagcctgtaagccaaggcacccagaccagtttccgtacagagacagttacagctggttttagatccccttccccccacagtagttaagagaacagcagcataagcggctggcagaggcaaggaaagaccagcagacagaaagagagaggcagaaagagaggaagaaacagaggcaaaaggaaagtcagagagagacagagagacagaaagtcaaagagagaaagaaaaagagaaagagagaaatatacaagtagttaaaaaaaaaaacaacagtataccctattcctttaaaagccaaggtaaattaaaaacctgtaattaataattaaaggtattctcagtaaccctgtaacactctaatactactttgttgtcagtgtaaacaagggcatatcccaagagcactgaggccttcctatcaaaaatccttaacccagtaacccgcgaatggcccagatgcattcaatctgtagcggcagctgctttgctaacgggaaaaaaaaaattatgcaaaaaatgttgtataatttaaaagtactcagtactattgaagaaacagtttatgttcaaggtgtataagaaaagtaaaatatacctttggtaaaaggattataaggaggcataagaatgtggatttttacctacattaaaaggttaaaaaaattattgttttgaaagtttaagcgagttttgagacgttaattgtaaagaaaattctgtgtgtaaacatattagctaaagttaaaaaggtatcatccagtttttctgtgaactggacattaaaataaaaatgcaacaggtttttcttaaagcaccaacctgctctttaacaaaaattatgaaaggttaaaaagagtatataaaatcttgcttatggtcaaacattaaaaattagataaatatgtctacaaggttttattaaaattaagtttaacatcaataacactaatataaaggtaaaatttggcttatctagtataaaaatcatacagaaagcattgttaaatgtaaaatggtatttggctttctttggtctaaaaactaataaaaataggtgctaaaggaaacattcattttactagaagatcataaaagttaaaaacttaaaacaaactttggcaattaagacagcataccaagatgcaaatgcctggttggaatggatcaaatattccatgtgcacgttaaacaaaagcaattgttatgcttgtgcacatggcaggccagaggccctgattgtcccccttccactaaggtggtcctccagtcgacaaggcatggactgtgtggtagttcttttccaggattctacagcctggagtaataagtcatgccaagctctctctgctatatcccaaagtccggcaccctgcgggtcagcccccgagggctgtccagcctccgtctcccaacactaagttcacttcgtgtctctcacgacagggaggaaacttagcattccttggagacctgaagggatgcgatgagcttaagaattttcaagagcttatcaatcagtcagcccttgttcatcctcacgcggatgtgtggtggtattgtggtggacctttactgggcactctgccgaataactggagtggcacttatactttagtccaattggctatccctttcaccctggcatttcatcaaccagcaggagaaaaaataagacattgtaaagcgagagaagccccttgtaggtctttcaactctcatgtccatttagacgcaattggagtcccatgaggaataccagatcaatgtaaagcttgaaatcaaatagttacaggatttgagtcaatattttggtagatgacagttaataaaaatgtagattagtaaactacatctattacaaccaacagcagcaagcttttcatgagttaaaagaaaaactcacgtcagccccagccctggggctacctgacctaacaaaaccctttacaccctatgtgtcagaaaaagaaaaacatggcagttagagttttaacccagactgtaaggccctggccaaggccagtggcctatctctcaaaacaactagacggggtttccaaaggctggcctgcatgtctaagggccctagcagcaacagccctgttagcacaagaagcagataagctaactcttaggcaaaacctaaacataaagtccccccatgctgtggtgactttaataaataccaaaggacatcattagctaatgaatgctagactaactagataccaaagcttgctctgtgaaaatccccacataacaattgaagtttgcaacactctaaaccccgccaccttactcctggtatcagagagcccagttaaacataactgtgtagaggtattagactcagtttattctagtgggcccaacctccaagaccatccttaaacatcagtagaccgagagctgtacgtggatgggagcagcttcgccaacccttgcaaagtgactctgaagaagacgacaagccctgcttcagtcacacccagaagctaactggtccatgcacggccgaaacatgaggaaactcatcgcaggactcattttccttaaaatttggacttgtacagtaaggacttcaactgaccttcctcagactgagggctgttcccagtatatacatcaagtcactgaagtgggacaaaaggttgctacagtcctattattttacagttattataagtgtactggaactctaaaaaaacttgtttgtataatgttactctatacaaggtatgtagcccgggaaatgaccaacctgatgtgtgttatgacccatctgagcctcccatgaccatagtttttaaaataagattaaggactgaagactggtggaggctcataaacgatacaagtaaagtgttagccaaaacaaaacaaaacaaaaaaagaagtgcccaaacaagtcaccttgaaattcgatgcctgtgctgtcattaataataataggttaaaaataggatgtggttctcttaattaagaaagaggctatatggcagaaaataagtacatttatcataaattaagactgtgtaaaaataaatgtggatactggtcttgtgtcatttaggctacttggataaaaaaaaaaaatcctgtccaccttcagcaagggaaaagtggcccttcctgtaccagtggtcagtgtaaccccttagaactagtaataaccaacccccttaatcctcactagaaaaaagaggaacgtgtaaccctaaaaattgatggagctggactggatcttcaagtaaatgtcgtggtttgaggaaaagtttataaacgctctcctgagccagtatttcaaaccttctatgatgaactgaatgtgtcagtaccagaaattccaggaaaaacaggaaatttgtttttgcaattagccgagcatatagcccagtctctcagtgtcacttcgtgttatgtatcagcacaagtgtaaatatgtgaatcattatcaatctattgcacaggaagacataagtagcaaaaataagagtgagaactcccactaataaaaagtgagagtctcaaaggggggaaatgagagaagagagacagaccctctcatattgttttatattgttttatactcagaaaaggaaagagaagcaaaactaaaggcaggtagcccggcgcctagcaaccagacgtgaaaccaaggaaccagacctgaaaccgggcctgggcctgcctgacccaagcctggtagttaaaattccacccctgacctagcaactgatgttatctatagattataggaagacattgtaaaacttcccagtctgttctgtttcactctaaccaccggtgcatgaagcccctgtcatgtaccccctgcttgctcaattgatcatgaccctctcacgtggacccccccaccttagagttatgagcctttaaaagggacaggaattgctcattcagggagctcggctcttgagacaggagtcttgccgatgcccccagccgaataaaccccttccgtctttaacttggtgtctgaggagttttgtctgcggctcgtcctgctacccaattttctctgcgattattttccttctaaccctttcttaaagtgatgggctctaaaaaatcatgattcagctgctattgcaattttacctagccagtgaatttatttattttgagatgctttttgatattattgtcattgtcaaatgacattatgacatttcaaaagacattggctgtcagccagtgggatctagtcttaactcatctttggtgctcaccggtcataaagctgtagtcacatgtgtttatttcccccagcactcttccctcatttccttcctttccttcctgaaatttcctcttccagtggtgcaaaagctggtgagtaagtactgacaaaaccaatgcctcttccaatgtctctattcatttccttcctgtccatccctataagcttaactgtacatccatggttattttcaactttgagttaacatcgtagaatcaaacacttaagatattcaggtaattctgaataccatatgctatggtttgaatgtgtctcccaaaattcgtttgttggaaacttaatccccaatgcagcagtactgggatgtggggcttaatggtaaagcccttacgaatggattaatgccgctattaaaagggtttgtggaagtgggttcttcctctcctgctcttttgccatgtgaggacatagcattcctcccttccagaggacacaggcttcaaggtgccattttggaaacagagataccaggcccctaacctgctctctgttcttcttttttttttttttagatggagtctcagtctgtcgcccaggctggagtgcagtggtgtgatctctgctcaccgcaacctctgccgcccgggttcaagcaattctcctgcctcagcctcccgagtagctgggattacaggcgtctgccaccgtgcccagctaatttttgtatttttagtagagacggggtttcaccatcttggccaggctggtcttgaactcctaatgtcgtgatccacccgcctcagcctcccaaagttctgggtttacaggcgtgagccaccgtacctggcctaaatcgctgttctttataaattacttagtctcaagaattctgttatagcagcacaaaatggactaaaacatcatggttcctgcttttttggctcactaagtgttcgtggcttttctctttcaaaattttattgctaaaataaataaagatgtcactactttacaataattcatcacattccatttttttgtaagaaatagtaaaagttggatttctatgcccttgaaaaagaactctatccttgaggcaatctgaaactaagcatttaacaacttgaaaaattagatcacaaccctctgaccaaacaccagaaagttttatactgaaattcagatactctttgcttgtttattggcagggaaaaagccaaaatatcaagaaagccagcacaaatatgagtagtaatatccccttagctaacatagatttgcaccacccatctaccttctatcatgtcatcctttttatttctttcattttatgtatgagtctttgaaatgtttgtgtttttaaaaaccttttatttttttatttccttcattaaaatgtaagctctccaagggcaggcctttatgctcatatttaccaccaatttgctgctgcctagagcagctcctggcacacagaatgacctcaaaaaataccagtggaatgaaagagtaatgaaagaaatgactcatctggttttactccaaaagaagtagttctaattttttttaatgcttaaagaaagccaaatggatatacatataggatttccagtgtcataaaagtaacaaaattagcttactcttccaaactcttattttattaatattttttaataataaaaaattatagaatgcttcatgaatttgtcatccttgcattggggccatgctaatcttctttgtatcattccagttttagtctatgtgctgctgaaacaagcaccaaactcttaaaattagcttaggttcagagtgaagagctgaagttgcagaccagacccaagctgttttgggactatgaaggacattaagggctctgtttatttgagcaaaatctatgggtgaggcttacctgctttctgccaattttccttgtacaacagctgatgtcagagggtggttggataaggagcttggagccgttggtaaggaagttcttatcactttcttgcaggctccttttacctctagtcttctatgactcaagggtcattcagtgccaaatgaaattctgcctctgtggtaactgctagaaagtccagtgatgatctgatttctagtaacaactattggccatatccccaggaggagataagaattgtgtctattaggaaataattttccatggatctatcacctttttgtacctcttgtgagctggagcactgaatgattttattccagactattccccaggatgtttgtatagcaaacagtcttgggagatagaggtagtatctcgcgccaggggagaaggcaggtttgtttgttgttcattatattaaagacaatgtcttcctccagggcaaaagttgggcaggctaacttgcagtccattataaaagattcagatttcctaagcttggagttgcttaggtatgatgcaaatctcctgagtgtgcaaacatggacctaggatgctccgtaggacttcgagaacaaggggaaccaacagaacatgaaacacataccatttgagtaaaaacagcctttatctttgattcaggtgtcttctgccagcattcatgaaacgaaactggcaaatagcaaaaatctgaaacatttcactgttcttgatagtttcacatgctccatccatgccagggtcccttatttcctgcaaaataaaaaaattctgacaaagagtgcatatgggacagggtgaccttcactgggaagcggaagtgaagccccaagttcatggtgggagatcagtggtaatgaacagaggtatgtcatagtgtaggaaacagatgaaattgccaatgtgaagataagtcattagtgttaagaataaaaatgctagttcatttcacattcacatactgtttgttcacataagatgctccataaatgttattgaataaatggatttatatccttcttgcttgcaaaaatggtatgaagaggtttccagtaaaaaacacagataatgaatttattcaaagaagagtgggaagaggcgattcaggacaagaagggaagaaggaccccaatcccccatcccctaccaccctgtccttccataagagtgagaattttgtcaggcattttaaaaagttcacctcactaatcctcaaaggacccttaagattgctctcagataaggaaactgcatagaagataggaagagcatctgtgagtataagatatgtacagtatctggctccgatctgcctttgcaaggaaatggcagagccaggatttgaactcaggttatctggcttcaaggtactacatgttttttgtttgtttgtttgtttgttttttgtttttgttttgttttatatgactgagtttttttactctatcacccaggctggagtgcagtggcgcaatctcggttcactgcaacctccgcctcccaggttcaagtgattctcttgcctcagcctcccgagtagctgggattacaggcacccgccaccatgaccagctaatttttctatttttagtagagatgaggtttcactacattggccaggctggtctcgaactcctgacctcaggtgatccgcctgcctcggcctcccacagtgctgggattacaggcgtgagccactgcgcctgacctctacatgtttttttttttttttttttttttttacaggacaccacattgacagtgtcagcccaaaactagaccaagaacacttgggcacactgagctcagggcttagcccaaagttttctgaaagcatgccagagggaaagctggatgaaatgctttggtaaagaagaaagcacatcagctcatcactcatctgacaatagaaaggactgatcaggaagtggggaaaaggagaatagtggcaaaacatagaaaagagaaaaaaaaagactgaaatttttaatggagcgcaaaatcagacatatttttttacttttttgaacttctttagagactacaataataattcttatgtgataagtccaataagctatgatgatgttttattaaatgtaccatcatactagcagcttttgcagaatttgcatcagaagaaaagtataagatattaccaccatgacttggcaaaagcggtatactatattaatgttagccacttagttgctgtcattgtttctcagcacagtacccattgcctagtttccctgggagttcttgaaagctctattgaaaagttatatttaaagtgtaagttagagtgtgctgtgaatggagagaaaattgtttttctttttgtaaaaaattcactttccttgggactatatactaagttagctcagttatttgacagaaccagtatcttattttacaaagagaaaaacatagatctagaaatttccagaagcagatcactggttgaaagggcggggcgggggggggcatgtgattgaatgtgatttgaaggcagttttaattttatgacactttacagtgtgtgtgtgtgtgtgtgtgtgtatgtgttttaatgataacctaattttattgtcccagacttaaagatctgtgccacctggagaaactacagttcatccattagcatgtaaatctgttaagagtatttttgcttgaatttctccgagaaggctcccggctttgttctgtacagacacacagtcccgacgctgttcttaatatcctgttttcatttgtcagcgctgttgtccttttcattgccatgttcccatcattcctcttctttcatgtggtgctttacaataacattcagaacaaaagagtcactcctctttctgttgcctttaaaaaaaaaaaaaaaagacttcttcccctgactgcagagcttcagtgatcaggggaaatgtttaaagcatgttattcgtaatagttaaccaggagttgtgaataagggttcgttttccttactttttaagatcaggaggtagcttcagggtattgtgagcaaaaggtttttgtgtgtggctgactttgaagttgagggaaaaagcgattttctttgagaaaaggaggcatcatatttgagagaatttccaatctgctcacacaatgggaatcagttactctataacatcgtcattacctccatgagtcacgagactagtatttgttcttgtctttgaacttaagctttccagtgttcagagaacagttgtgaaatgttgcattggccatcatcaataactattttgctcctggttggtaataattgggaaggggagggtgtgtactttctctgccttctaggagagtattatataaataaagtgagaaaaagtttccccaagcggcaagcttttctccagggcacaatctattatacttgctgcaaaaatcccacttgactggtctttcagagaatagatcacttgcgtcattttgctcatttccaggtgaccttttgcagatatgagcaggcagttgtttttaaataaacattatctacaggtttctgtttctgcactaaggaaggaatgtttctgtaatgcagaagggatgctatgactgaggggtttgtgaagagtgaattctagccagtctcaaataattctgaaaaggtgcttttgtatatgtatatgtgtacttatgtatacatgcacattgtatataactacaaaaactaattccattatggacatatataggactttatacagacatagttatatgaatatatatagaaatacctatcaaactataaatacatttgagaaagcattcagggacagcagtgttaaaagcttttcatctgtgactggtttcacagaaattagtgacttccatttctgctaccatcacgctgttggtctgttcaccaggagggttgatttagacttctgccaggagactaggtgtggccatctctcaccctcttcctctctgtccagtctgctatcattgccttcagaaccaaattcttgcatgatacccagtacagcatagacctggaaaacatcggtcattttcaatataatgtaaaataggttctgtgtgcctttaaaactaaatgctttatttcttaaactgtaaaagacatgaaatgtctgagacattcagatagtgggaaatttcatctgcaagttgtcagattatgccctttagaagattgtaattttttttgttgtttatcattttctcttgaggggtggagtaaatatttctttcctgatgtttcaacttcagatgttcaggctaattttccactacagtgccaaaatagggaaaagttaggcctgtagaattttgacaatttaaatgttgttttaacaaaagccatgtcttgatgaaaagttctttagaattctacttgatgatctatgtgtgtctcttccgaggacaatgagaacttcttaaggaagtcatctatatgtgaaattgagtaatccttttattcattgttaaaagacaaatgaagttataatttggagagacataagccaaaaaatctatgtttgcatttttatgtcctaacatgtgaagcatgctttgatttactgtgaagtgttgcaatggcaataaagtagatgttgagacgtgcagactgggcagcccgaggaagcagttcttgcctctgcttcccctttatcatgaatgttccttaaacacctttggtggagtccaaatgtctggattatgaattgaattgtgcaagattctttttttaaacactttcctgatgatttactttacttgcagtttcttgtcttgcatggtgataagcaatatccttcaaagaactgcagcgcaggactttttttttttttttttcttttaggaagactacttccccttcctcctttagtcaatcaaattttaaaagattacttctttccattctcagttcaccctttctttgccattctggagactgaaattttggacacccatcacagatttgctattatatatataccgtgtatgtaatattaaatatatatatatatatacacacacgatgtttttatatatgtgtgtacataatgtatgcatacgtgtgtatgtgaaacctgtgtgtatatacatatattttaaattgtttatcaggatgatagattgctatttaggtcactatttttggaagaaataaatgactgttctttgtgtctgtactggagattgttcttcctgatataactttgaagaaaacttcttccagacattatacattaattcagaagataaaggcacaaaataatgtgtatattatttttttaaatgaacaagccagcatgcagagcataatgtgatcatgtgctcagtacgacactgaaaggccccaaaggcaaatgagtctagtgcctgttcccagccccaggagctgggcaggacggctcctattggtggcattgaaagctagcattcagccttctgccacaggacagtgtctcattcggccaagctgctgctggtccctgtaaggaatgagagtacagatcccgttgccaagtcctcatttttttggaccaggcagtgggtgttgagctgacctgagctacctttccatttgggttcagttgaacattgagtaggccagaggatagggaagttgtggcgggggccgtggaaaaggcagttgattcttcaactcgggcaaccctggcggagtggatgaggtggagctggccttcctggaattgttggaccgattttcctgttgtgtttcactgttgacgcactcacagacacacaggaccgctccagcactgcctgccacccaccgtctggtctcggtggcctgtctatcatttcgtgggtccccatcctctgcctacggcgatgtttcttcaaaaagaactagtgtgcagtccattggtgggtattcaaggtgatctctttgtcagaatctagagaggtgctcaaagaactattaaggaccaatgtactagttcctgtttttaacctgtttatcagtctttcaattgaacaaattggatttctgaaactgctgaggggttttctgcactattaggacagaacaggatagggtggttgttcctccaggaatctgggttgttcttttgcattgccatttgtctttgtgcttgtctgcttgtataaatgaacctcgagaaggagtgtttaagtattctgttaagtaaatttggaagactaggtttcaattaaaataaccagacagtgtgacccagcttccatttccccttaattttgatcattaaagccttcatatccccacagacatctgccatgcttcgaagtgattcttctcaggaatgttcattcattattaatcaggttgcatggtcaggcgagtatgtgattattttaaagaatgtcctagagatccagttactaagaatgagcatgttataggcagatgtgaaagtacagaaaagatttggttaacagtttaatttgatttgcatgaattccaccaggtgggtgtttggcgaaattaaaagtcttccctggttctcacttcagatatgaggtaaaaaaataataataataataataatttcagcacttcttaaagaagaaatgtcaagttattcaaaatatctattgtattaattattttaaaacttgaggctagcatctcagtgctcatctgcttgtcacttttttttttcaaacagtccctctggtcccctacaattttcttggcagaaattcttagttgtctgttactggttgagcaaatgaatttgagtgtgctgacatttggaggctaaatgcagtgataattcagagtaacattctttacctataaaatgttactggatcaccttttttcacctgttcttacttgatgtattatttatactgttgtttttaagaaccactttgcgtttgtactgaaacagcctacattatgctatcaatttccagtctttcagaatgcagttaaatccaactggatccccttctcccctttttccatcagttcatggccctgttttactgtgcctttgctaacccacctgcttctcaaattggccagagtgctaatcagtaaagtaacatttgggtagtgtctttattcggtggtctttatcactcaaagtcaaatactaaatggcataattgaatatgcagatgctgagtgcttgtattatgttattcaaaataccctatgatgaattcatcttggatgtagcagccagtttttattgagtttgtgttagacaagtttttgagttgagaaattatgcttatttaagatgagagcaagtcccttctgagttgggtccccgttgcaatctgcctcccaaactcaggttgatttccagtgtttcacacttcagtagttttgagtcctctgaaagtctgtatttctgctggtccaagatagaaacatcactctgcagtctttaaaaaatatttcacctatagttctataataaagataatctcatagcaaaaatccaaacagcaatagtcaactaaatctaattacccaggtgaataggggttaagaggagcggacaatcaagtaaattgacttgatttcgtttctgaaatttaggactctcaaataattcatttgtacattttcaatgctatttgttgtttgaaatacttataggagcttcctgttctgaaaccattttcgtgtggcttgctgtaacatcgtgcaattttaacagtgtgtttgtcatctcagttatgttttggtaaatttaacaataaagttagtctctatagtccagaggatatttggaaaagaactagaggaagtgccttgggaatcatctgggcagtggctgacagccacgtggtattaacgattaatcacaggccacccagtgttggcatacaagtttattccttggtctaatgactcactaatttccctggtagtgaaggctttagagttgtacaaagtgaggggctggaagtaaaattattgatagaattgatagaattgcatgttctttttcatatactccaaattagaaaaataattgtatttcatggagtatgcagacataacctagaatacttgtaggaaagcattgagaggtgggtttaccttatcattaaaaaggtcaatgcctccattaagggaaatttgggataaaaattatggatgatgtgctgatgatgggcgatctccttattctaatggatgctgtaacaagttagcacaaacctgatggtgttaaacaatgcaaattcattatcttacatttctagagtcaaaagtctgacacaggtctcactgggctaagagtaaggtatctttagggctgtattccttttgggggcccttggggagaattcatttccttgccttttccagcttctagcctgcattccttggcttgtggccccttcctccatcttcaaggccaggcatggctggtcgagtctttgtcatatctcatcattctgactctgactcttcttcctgccacttccacgtttaaagagccttgtgattcctttgggtccacctagatgatccatgctgctctccccatctcaaggtcagctacttagcaatcttaattatatcagcaacagtcagtcccctttgctctataacctaaaatattcacaagctctgaggaggaggctgtggatatctttggggaccataattgtgcctcccccaaagagggaggagtagaaactgtggtgtctgctgtctggtgaccaggaggacagaagccctgtgaggagacaccaggagccctgtagagaagacaaagacaggctaatgagggaagaggataaatcccacatcatgtgcattccaagtctgaggcacttgcagtacatgaagcaaagaactgtcagtgctaaaccgggttccagaaaggggttctcgaccatcttgggatacaagcctagcagtcattctcagagaggcagtacatgaaacaaacaaaaaactggatggccctgtcaaaggaaccatagaccatcagaaaacacttaggctttgattagcaagaggtagaagtcagcagtggttagacagaggaaaactaggaaagtacagtttcagtgacatacagtgatgtggtttgtttgtccccaccaaaactcatgttgaaatgtaatccccaatgtggtggcattgggaggaggggcctagtgggagatgtctgggtcatggggatggatccttcacaaatcgcttgatgcccttcttgaggtagtcagttcttgctctcatggagactagattggttctcacaggagtggattagttcccatgagaatggagttgttataaagcaaagttccttctcttgagcagatgccagtaccatgcttcttgtacttcccagcctgtggagccacgagctaaataaacctcttttgtttataaatcgcccagcctcaggtattctgttatagcaacacaaaatggactaagatacatattatgagagaggaaaggaaaggaagaagagggaggtgtgaaaacatttacatcattattttccagcaaaacatctacttattaattttccattttaaagaagtactttcctcataagtcttgaatctataagaaagttttttcaaaagatgtatccaatgcctcccacgatgtggggcttcactgtaatctgtcactgaagactctcctgcctaggggagtgattagagtgagtgctagagggactgtagggaacatctgtggacactcacccatggatactcagacagctaataagtagcagaactgcaggatgtcttagattatcccgtcacctgtccagctctctcccctttcattcattattctgtgctgtgttctagatgtttaaaccatggacaggcagaggtgtgagctgtgatttgttgccattcccagtttgttgcaagggactctcaagattatctagatcctcttctcaatgaggaccaatctgcccattcacaaaaatgttaagctataggatttcctgacaacaatatgcatgtgtgatttccttttattgaagtagaaatgaagaagtttttttttttttttgaggcatggaaattacattatgacagttaagaaaaggcaaaagctgctgttttatgatattggggtttttgttgttgttgtttgtttgttttgagacagagtcttgctctgttgcccaggctggagtgcagtggcatgatttcagctcactgcaacctctgcctcctgggttcaagtgattctcctgcctcagcctcccgagtagatggaatcacaggcgcacgccaccacacccagctaattttttgtatttttagtagagacggggtttcaccacgttagccaggctggtctcgaactcctgacctcaagcgattcacccaccttggcctcccaaagtgctgggattacaggtgtgagccaccatgcccggcctgatactgttattaatgatataaataacaatgtaagctatatatatatgtgtgtgtgtgtgtgtgtgtgtgtgtgtgtgtattagatacatatatatatagagagagagagagaaagagagagagaaagggagagagaaagagagagagagagagagagagagtgaaaagaaagataacattttgcataaaattcccacccatgtaccactatctgcttggtgaatccctgttcatcttttaaaacccacttcatactttacctccttcaggaagcttctccctgtctcctctccccctatatagagttgattattccctgtctgtctttggcatgcatctttttttatgttgcattacaccttgttcatttttttttctcgatatgggctcactctgttgcccaggctgtagtgcattggcatgatcacggttcattgcagcctcagcctcccaagtatctgggaccacaggcatgtgccaccactcctggctaatttttttatttttattttttggtagagatagggtctcactatgttgcccaggctggtctcaaactcctgggatcaagtgattatcccacttcagcctcccaaagtgctgggattacaggcatgagccaccacacctggccttgttcatattttctctctcggaatgaaccataagatcatggagacaggggccagctgttaccagtacttgtctcaggaccaagtacatagatgaacttaagtatttggtgaaagaatgaatggcaaaaaaaaaaaaaaaaggaatgaatggcattttaatttctccaaaaagatattttaaagaaagctagaaaataaaccatactaagtttcttttagaagaaggaatggaatgagtacaaataagatactgtagagtcatttaacaaaaatgctatctatgccattgtaaaatctgggtaaaagtggaaaaagtgggatgcactatagatatcaaaccaaaaccccttcctttttggtagcatacaggcaaaagatttagaaaattggctgaaattcacctaccacatctgagtattgtgtcttcacctaatacaattaaccatttacagtacagacacttgcataaagcactatgccaggtgctatggcagtaaaagaaaatatctagttttgagcagctactattaattcgttcttacatgagttgcccctaagcactcgagtcacataatttccattgatgtcagattcaaagcccattgcatatcatttcccattagcactggaaacttgtaagtgcttgttcaagtcttgctccgccatccttgctgctgttgcccacacagcattttattcatacctctctgagaatgattttcatttatgttctggttatctgtatatgcctctatcttccaatacatggctcaacaaaataagatgtgcaggccaatgctggcctgtgacctgtttttctaaatatggttatgttggaacacagccatactcattcctttatgtattgtgtctgattgcttttgcactacagtggtagattgagtagttgcaacagggcccctttggcccacaaagccaaaaatgtctactattttaccctttatagaaaaagtttgttgacctctgttcaaatatattgagagatccttaaagtcaagggctgtgtttgattctttttggttttagctgaaaagtcagtacatttaatggaatcaatgaatgtttgagtcattttgtgtgctgagtgctgttctaggtgttggtggtacgttcttcaaagagcaaagcaaaatctctgctttcacagagcttatattctagtgttgaggacagtggggacagaaggagcaataaacaaactaaaagaatatgtcagtgataaatattataaagaaaaataaaccgagatgggggaagaattaccacgatgggtaggtggtatagtggtagaaggggaattggttttatgtgggttcagagagaaagtgacactggagcagagagtcatgtggattctgaagaccttgcaggggcgagcaggggattgatgtgcttggcatgtttgaggagtcagaacgaggccatgtgctcagagcagagaaaggagtgggtagcgtgggaggaagtgagctcactgtctgagtctgtgttttctggggctggtttattctggtgaatttctctctgggtgaaatgggaagcccttacagggcagagcaaaaggagatgcatgttctgtcatgttttaacaacaggctctcttgcttctgagtggaggatagactatagggggaagggcaggagtgaacagaagccaagagaccatttagaaaggtcttatgatagtccacataagagatgatgctggcttggcccatgataatagagatgaggtgatgtgaaccccagattctggcttcttcatctaactcagtgcctggcacacagtaaacatctgttgaaggaatgaataaaatgtcagtatttccactgaggtctccccagtggaatcctttctagaaattctcatcacacctctctgggatggaatcctggcacctgcattaaaaatatagtcatcatagctctccagacataatttgatgctcatccttctattcagattcattggtaggcattcttgttttatctgagaacagagcagaccaaaagggctacatttttcctttaatttatatgcttctgatgagaaggtaaaagaactttgatttaaagataattctacattttttctatgattaaccaaaataattattaataggtaaaaacctttccatttcttctgagccatctgtaggaagaggtgacagaccaagtggggatgatatgtttcttacaacagcaaccctagggtttccattgcaggttgtagaaagatgtacaagctttaatatttcaagtcacagttgctcttttattctttcctatataataaatgctagtgaatggttgaagattttttaagataccaggcttttatgaagccagtagctgtttaatttttaacaggctcgggacatactttatacttttaatgatcagttaccattcagttggtagcaagatgagcattaatttcaccaaagcaccatattggtatttctgagggatgctatttcagaaggggtcagggtattctagaaaccgtgaattttgtaaataagcggaggtgtgaatacaaacgattgattgtcagaatcactaaacatagctttggatgtgaagccttcccataaatccggctgagaacgctctccccaccacccccgtgggtgatttgaacctcccgaccactgggtgaactgcactgttctcccacagcctgcaatgggctgcatgtaatattcccatcactggtctgcagacctctgctaatggtcttgaaagggagaaggttcaaagcggcttggttcccaggcctgctaatgagcatgaggcctcttcacccttaatgaactggggtttgtgtggaattctttctactactctttttgatgggaaggcagatgagagttcacaaaagcactcaggtctttatggcaaggggagcaggcagctgggccaccctcgggtggcctggaggagagcaacatagctagcagaggtcgtacccaggccaacatagctctgagtgtgaggctggacctcctgccagcctggcctgttgctggcaacagtgacaagcccgtggtgggagttttttggccaaaagggtccctcagcagttttgtaagcctccttaaattgctttctcaactgtaatcattatcattgtcataacataacttatcacatgaatatgatgaccactgaaatccttgttctaattaactaaatcattgctctaaatattagtcattggtactcaaacttactgcagccactgaaaaagcccccagatatttttctccacttcgttctgcctacccacgtcccactgctggattaaacaatagaattattcagaaacataatgaacacatgccaaaaatattgcctctatcacaatcatctttgtgaaagtcaatgttttttctcaggaatatattttggaaaatgacatcccacacttaaacacgatcatctctgctgaaatccccacatttgatttcatgtacatttcatgcccatttctatagttactgccttcctattgttctgaaacctggtttggtattgcagagtaaaagtccttaaatctcgtatacattaatacgtaagtttataaattcaaatttataaaagactctagtttattgatgaatatttctacattttaattttctgtgcgaggttaaacctgactctgacacaataagattattctgattaaatacaaattatggaaattacagtttcaattacattctagttttgaatgaagccttttaaaaaacaaaattgaaaaaaaaaattgcacattttcagttactgaactttgagaaaatgttaactggtatatgatggctcaggatgctttttcctccttttttccccagtgaatagaaagagaattatttggaatgtacacacacttaccctttcatgacctgtgtttggaattattctgagatgcattcaaagctgacacccccctatggttgacctccctgtgcctaatcaaatcttacattcttgtttccagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaaggttagtccgatccgccttaagccaacccctttctgccagaaaatgtcatggaaataaaaagtgtattcactgctagctacatggcaggtgaaggttttctcctcacctttgttatctgattagttttagcatgtttttggcaacctataaatgttacacaataagggtatcttgtaaaagttgactgctgcttgtaattttagcgttgtcaaggtgagggcaaattctaaaaatctggatcattttcaatccatgcagtttttctggatcattttcaatccttacagttcttccaaagagagtgctgcctctctctgagagagagggagagagagagagagagagagagagagagggagagagagggagagagagggagagagagagagaatgacagataaaatctggctttgggcatttggggaacacttacttttctcactcatctgggaaaactaattcactctcattgtacctgtatctagttactgcacaaacaaaagaatagagggaagaatgtctgtagcaaatgtgggattttagaggacacgtgaccttttattccttgtataaacgatatccagcttattggtgaaattcagtgctctgacaatctcaggtttcacgaaagaattccttttcgtgtaggctctttattcagtaaggttacagtcaagactatttgaacttcattttttacatgaaattattaacctaactccagcttgggggataatgattaatatgactatatgtgaaataaaaggatcactttctaggcagggcgtggtggctcatgcctgtaatcccagcactttgggaggccgaggagagtgaatcacttgaggtcagcagttcaaaaccatcctggccaacatggtggaaccccatctctactaaaaataaaaaaattagccgggtgtggtggtgggtgcctgtaatcccagctactcgggaggctgaggcaggagaatcacttgaccctggggggtggatgttgcagtgacccaagatcgcgccactgcgctccagcctgggtgaaagagcgagactctctctcaaaaaaaaaaaaaaaaaaaatcactctctaagtatggatagaaagcactagggaagaaataataagccaagtctccacatgtttgttcaatttcaggcaacagtgggtctaattattgaaaactcagctgagagagtttgagtgagatactatgttcatcagctaattttagatcacaagacaccaattaaaagaaaggaagtataaattaaaagctctaagtaaatatatattgaagtccttcctctcaggaaaaacacataccatgttgttgagcaaacaaaatgaatcacatgatcaaaagagtgttatcacttagaaaacagtgtcacctttaacaaatggtttctatcacctctccttagcgctaatgggtggttgtgtttactgggaccacatagtttattctgtgacagtgggattaacggaccacatctgggatttggctttgctatttcttgacatgttgagggaagccgacatgctgaagtcaattcctgcttctcaatgtcacttgggcaacaaaagcatcacctgggcagcatgtttcacttcaagtatccaaagaattactggtgcaaatccatctttaaaccatgtagaggaagtcaagcacaaggactcaggtgacacagacaacagaagacagccgctgacaggctttccagaacagtgcatggcagcacaggagaaaagtaccaccaaagttaatcatagcaaaggcaatgcatgtatgagctgtgcctctagagcaaattctgaagaaattgcgaaggctattaatttttacaaaccaaggtaatctttttttttttttttttttttaccccttttttggttggtggtggagctgaagggagaatatttaggataactgaacagagatgtttgatttttgttttccaaaatgtaaacatgccagatctttgtttctttattaaaaatgttcctttgattggatttgcactaccttttaatgattgtttgttaaaacaccacaatcataatgatgttcaatatttaacaactcccaggcttgatatttatttaaatcttgtggtcaggttctgctcaagtactcatggcctgtcacagcagagttattaaatatttacataacatctccaaatttatgaagaattcctgtcatgctctagccctctttgtgataaaaacaaaactcttcagttacgagccctgcacactttaattgagccagtggcctatcggttgttctactgtcacatggagggcctgacaattaatgatgtggtttctttttatttcctagttacagaaatataagcatataaacagcatccaatgcaccgaaacacatttacagccgttcaataagatgtacttatgagcatttgaacaaataacttatcgacatagcatgtttgttttaaaacatgccacttacgttagaattttaaaaataataattatgacatttggatgtctgatatttcagttatcgcatacttatgaacatatgtacatccttgttttatttaaaacctaagcacaatataaatgttgatttttttgaaggaagtaatagcataccaagaggaccaaaaccaaggaagtatatttctgttaattactactttggtctgaaatgtgctctgaacatgcatttttctgtagctctaggatctcatatagatgtggatttgtgatgatgtgagaacacagataaagcatggaggaatttgaggatgctttcattgataagacaatagatttgctttattaatttgcatatgtaaggaccctggtgtctttggaaacatttttgtccttctgttagtaaaagtttattacctgaagaagggaattctgcaattattatgaagaataatttcttgcaataatactaaactttgggggacatattttactcattagatctcagtataagagatgtttgtttatacaaaaaatcagaatatcattttgtacattacaatctttttctaagtgtaaaagaaaaagagataaaaattctaacatgttgaactcgtacaaataaaatcatccacatcatgtaaaatagcatcatgtcagtaatctaacgctttcggagactatgcattgagaggcactcatgaaatattgaagcaaagagaaaattaaggtagcatttcctgaactctactaagataaaaagagaaaagttttcctgccaagtgcaaaggtctctaagtggagcgtatccataatgtggatatttctttacatcgttttaattgaattttaagaagcctctcagtccttcaaacttggaggaaaaatttgatttgtgaaccacataacatataagagaatttaatataattaatgcattccagagttttcaaggaattaaaatgcagtagtcctctttttctgttccaacatacaaggttggagctcttgtttcttttctctaattatacctataaaaatatacaaattgaaaaaaactgacctttccttgcctttcagtttcagcatagccccttcaaattagctgaagctgaagttccaaactattgttttgctattcttattctaaaggctggctgaggaagtttgtttgtataatgcatgtttcaacggatcatcccattgtaattttttaatagtttgatttaaaagttcaaattaaagctcagcatttctatgtagcactttttatctggaagtgaagacatgagatttcattcttgggtttaatttatagattgtaaggttctatgtttgaaaaatctttcccagtttgcaactaggaaagttgtaagtgtatactgagctagacttctttttattataatttctataacttgtttcttctttgaaaaccagtagcaggcatagtgcaggttctagtgctatggtgtgtgatgcacacacatacttgcatatacatatacatacatgcatttatttatttatttaatattataatcttcctgaatctaagttggagacaaattcaagtgaccagtattttcattagggatatttcattctgcaggcaagagatgacaacaaacatagcaataataactatattcccatcactcaaaatattttacctgttccttgaatgtttggtagatggatacaagtcaactttggacttggtatattttttgtgggaagagtcttatcttgaaggggtttttttttgaagttacaaatatgtgtattttttaaaatgtgtctttctgtttattggtttctagtttaaatcccttaagatcagggctcaagacaattgcatatggtctcacttatggatgcagtatgctttaagaaatattagaataagtttattgtatcttcaaaatttccatgagctcattaatgttttcagtctgtgtaatcaattaatgactaggagaggtgcacttaggccttccactcagagagtgaaattttcttttttttttttttttttttactttaagttctgggacacatgtgcagatttattacataagtatacatgtgccatgatggtttgctgcacctatcaacccatcatctaggttttacaccccacatgcattaggtatttgtcctaatgctctcccccgctcgccccacaaccctgacaggccccagtgtgtgatgttcccctccctgtgtccatgtgttctcattgttcaacttccacttatgagagagatcatgcggtgtttggttttctgtttctgtgttactttgctgagaatgatgggttccagcttcgtccgtgtccttgcaaaggacatgaattcattctttttcaggcctgcatagtattacatggtgtatatgtgccacattttctttatccagtctatcattggtgggcatttgggttggttccaagtctttgctattgtaaatagtactgcaataaacatatgtgtgcatgtgtctttatagcagaatgctctataatcctttgggtatctacccggtaatgggattgctggatcaaatggtatttctggttctagatttttgaggaattgccacactgtcttccacaatggttgaactaatttacaaccaccaacagtgtaaaaacattcctatttctccacagcctcgccagcatctgttgtttcctgactttttaataatcgccattctaactggcttgagatggtatctcattgtggttttgatttgcattttcctaatgaccagtgatgatgagctttttttcttcatatgtttgttggctgcataaatgtcttcttttgagaagtgtctgttcatatcctttgcccactttttgatggggttgtttgattttttcttgtaaatttgtttaagttctttgtagattctggatattagccctttgtcagatgggtagattgtaaaatttttctcccattctgtaggttgtctgttcactctgatggtagtttcttttgctgtgcagaagctctttagtttaattagatcccatttgtcaattttggcttttgttgccattgcttttggtgttttagtcatgagatccttgcccatgcctatgtcctgaatggtattgcctaggttttcttctagggtttttatggtttggggttttacatttaagtctttaatccatcgtgagttaatttttgtataagatgtaatgaaggggttcagtttctgttttctgcatatggctagccagttttcccaacaccatttattaaatagggaatcctttctccattgcttgtttttgtcaggtttgtcaaagatcagatggttgtagatgtgtggtgttatttccaaggtctctgttctgttccattggtctatatatctgttttggtaccagtaccctgctgtttttggttactgtagcctcgtatagtttgaagtcaggtagtgtgatgcctccagctttgttcgatttgcttaggattgtcttggctatatgggctcttttttggttccacgttaaatttaaagtagcttttctaattctgtgaagaaagtcaatggtagcttgatggggatagcattgaatctataaattactttgggcagtatggccattttcacgatactgattcttctatccatgagcatggattttttttccatttgtttgtgtcctctcttatttccttgagcagttgtttgtagttctccttgaagaggtccttcacgtcccttgtaagttgtattcctaggtattttattctctttgtagcaattgtgaatgggagttcactcatgatttggctctctgcttgtcgattattggtatataggaatgctcatgatttttgtacattgattttgtatcctgagactttgctgaagttgcttatcagcttaaggagctttggggccgagatgatggggttttctaaatatacagtcatgtcatatgcaaatagaaactatttgacttcctctctcctattcgaatacccatcatttctttctcttgcctgattgccctggccagaatttccaatactgtgttgaataggagtggtgagagagggcatccttgtcttgtgccagttttcaaagggaatgcttctagcttttttttgccgagagtgaaattttcaagtcctcttcatagttctgtcattttgcttgctttaggccttttgaacctatgttattaagaacgatatggctgggcatgggggctcacacctgtaatcccagcactttgggaggccaaaaaggagcattgcttgagcttggtcgtttgagaccagcttggacaacatagcaagaccctgtctctactaaaaataaaaataaaaattcaactgggtatggtggcatgtacctgtggttccagttactctggaggctgaggtgagaggatcattgagcctgggagatcagggctgcagtgagcagtgattacaccactatgctccaacctgggtgacagagcaagaccctgtctcaaaagaaaaaaaaaaaaacccacaatgaaagttaatataggttttttgagaggtcataaaaaattaatatgtgtttaattaattaaggtaatatgaacagtaacagtccctgccttcatggagcttatagtctagtagggcattccaacagctactaaatactttctctgttgatggtggcaggaagcacattgtgcccaaagcaaaggtactgaccccagtcctgagagatggagaaaggcttcccagaaaagggatcactgcacctaccatttccaagccttgtattagaaaacaatattgaatttactagatgtctgtaaaatccctgttatcagttattcctttttaactttttaccacgtatgatgttctttgtgtaaccctatatagtttttcaaacttgttcacagtaattcccagttgattttaatctaaaatacagacagactatatgatgtttcaccatgtggtatgtgaataactcagacacatgtcttctaaaatgttgtaattttatggagtttcaccagttccaactgactccaatatgcaattctgtttgtactaattttatggcagcatttgtttagtctgcaatatagatatgtatttttttccttttatctttagttggacacttaataattgcacatatttatgagatatagtctgatatttccaaacgtgtatacaatgtgttgaaatgtatattttttaatagtttccatgtgattaaaataagatttccaaatatttgtaaaatgtattaaaactatattttaattttgttagtttggtacaaggatatttatgatagatggaataaaagaaagcatctccaggcatatgttcttaatgggaaactcaaggcagcttccttttcctcctcctcacctgtctattttctggatgagtcctctctcaactccttcacctgcagagagcaatgtattattgcctagtgatttattattgttggaatcattcttggtaagctcagagagttcgaaaaatgcacaaacaagtacacatggtacctcttcatcatgtggctgtgtaaacgtaattcttgggcaccttgttaacgttcttgtgctatattttactcgtctataaaacagggctaatgtatagtacttactttcacagaaaattgggagagcaaaataaagtgtttcatgtgccttagcattgtgcctggcctacagaaagcctgcaacacatgtcagaacgactgttagaaactaggaggcagaatgtgtaatggttaagtgtatggacattggatgtagactgactgccaaatattttttaaccactgtcttgtattatgtgtatgtgagataagagtatatattgttgctttaatgtgttttgtagttttgtttctaaagcacctgccaaagggcagagacgtgacaattaataaacacttgttgatggacatgtgcagaattgatgcattagacgagtgttttgggattcggaggaggaagagatgaatctgcttttgagtagacaataaaccttgcttcagggtggtgggatttaagctgctttgacagatctgtggattatgcatcaaagaagagtgaggtgctctgcaggagtgagaccagcagagacctgtcggtaggaataggcaagacagctttggaattttagacaatcctaactagagcacagggtgccaaatggggagccaggaaagaggatgttggaagagtcacctggagggaaggtcttgaaagtctttaaatgcaaggttaagggtttaggccatttttaccattttctatagagtaatagtgaagtgttttttttttttttttaagagagagaggttaatgtatattttctgaaataaatttcatgtgagaatataagaatggatagggttactgtgttcatggaagaaataaaagggggaagagacattcacattactttagattttgtggtctctcttttaattggcagaaagaagtagtatcacaggtcaaaaaccaccaccctgtcaacagaaacatgtaaaattgtgagattcaaggtcctgccccttaaaactaggaagaaataggagatgtcgttgctgattggctcttaggtacagacacaaatgtgattcttttcctgcttttctagtgcagtaagacacagtggggacaatgcatggttatttcttctggctttttgattcacaataaggagaatgctgttcaaacctccgaatgcccactataaaccaaaataatgttttagagccagaagcaaccttggagctcatgtcattccatcctcattctgcagatgaggaaagtagggctgagagtagtaaaagaagttttccgcaatgacctagtgggttagtgactctgaactaggactagagcacagttcccagctgtccagttttgtgtctttcctgctacttcctacagcggttaacagtgccagccagcacaggcaggattgccttttgagtggttctgaaatttctgaggtctcttctgaggttttcaggagtaaacacaatgattttacggtaatttttaaacgcctgcttggcctggcaataaaccagcatcatgggtgtaggatgatgccttaccatgctgtctgggaattattgcagagatgtggctttgcaatgatgcctccagggccaccaaaataagttgcctagaagatgcccccatgctgacattttctatagctgagccagtgtagatttggccatcttgaagggccagacttcatgcctggagctgtgttcatgtacatggacccagacaacctcggggacactgcaaaagaaagcagagttaggacagtgatgtcaatgaggaaacaaaggaattgtggttgcaacttaatgggctcactaattcccttcttaggattattgttttcctgaatgtcttaatatatagattattcttagactggtaaattttttgacattgccataaagtgggcatgagtagtctgagaaactgaatgtggctaaagatttaatttattttcagtatgtggcataaacattctggaaaaatctgatacaaatgcaattgtaaaaatccatttaaaacttaatcactttatattctggacttttgggtatgacacaacgttgttgcgtacccatgaggtatggactttaagctgacaaaggaaaacacattttgcatgtcgcatcaaaaaggaaaatgcttgtaaagtgccgagcatggtgactggcacatagtaagtgttggatgtacacgaggtattattttatctgggcatttactgttacaataaaaccttcattggtgtaatccaatggtggatttcttgacagtatcataaattactcagtggttatagggttgatatgtgtttctggctgacatgggaaactttgaacaactctcaagggaattataattgggtggaaactttgatttgtcctttctaaaccaagctaagtagtgaaatggacttttaagaagcagtgagtggtgaattgaaagaaatggctttaaaaacaaggcccaatttgaagtctggggatgcgggtggcaggggtggaggggagcggctctttcatgtttctggttaatctgattggatcagcaccacaggtgccatcagagcacctacagctgtttccaagaaaagaaaagctggcattggtttatactatggctgtcacatttatacacatctagacagatgaggaaaagatgggtgacatgatacacagtaagcctagactagtcagacgagctcagggggctagctttctttttttttttttgtagggttgcctttggtatgtgagtaaatgatgaagcaagttggccctgggctgtgtgttagcagctgtctctcttagaataggaagaggaaggaacttcggtatcgactggggctggaggaggaggaaagcgctgaagtgaaggagctgtacaagaaggcagcttccaactcctccactgtaggggccctggggtgttttgttctctgtgctctcttctgtgccagttgtgcagggtgcctagaatagcggtatcatcgtctgcctcctcccttatatctcttttgctatttattgagggggaaaatccggaaaatatggtttttatttttatttacattgggatagactaggttcttattactgaaacaatatggaaatcatgagcagcttctattccttttgtgcctttataaatattcttttccctatctgctttatcagatcctgcttttaaaaaaaaaagaaagaaaaaaccttatttgtttactcagggaatattttatgtagctactatgagataaacactgagtaaattctgggaatgcagaaatgaaaaacaaagataagtcgttgcttccatggtctagagctcattataacatgtaataagaatatatagacaggatatgaaaagagctccatggagctcaatcaatgagataatttttaatgtgaataataataaaaaaccactgacttcggtgttgatatctggaaattgcctaattccaaaagctgaagtaaaaatacatttcaataaaaagcaacatttacagagaacagtgacattcagtcatttggaattgcaaattccactgttcagtcatttggaattgcaagtaagggcaaaatatgaagactccaatccatgaaaaaagccggctggatgctttcttatgaaaggtctactgttcgcgggctggactgctagcccttctcacgtgctttcctcagaggtctccatttccttcctgaacagggctaataggtcagataaatatccaggctcacaagcagtttatgtcatttccactctgaaaggatccatccctaggaagatattatgggagcaaacttgcggaagtgctattgtgttaaccaagccagctggtgggtttgctttatctgttatggaatttttaccaacttaggtgttaggatgaatatcctgacctggtagagtgtttatttcccccttctttgacccttgacacagctgtttagagctcagtcactcttggttgacatggtcagattcaaagccaagaagagtgaaatgggcaggcttttagactcacacactgagtatggcctgtgtgagtgagtctgaaagatctaggagacatggggaagccgtatgcacttcacttaaggagcttggagggagatgctatttttgcctctggattgctgatttaagctctagagggtcccagcaaacaagggcctcacttatttatagtgtccagcttgttaactggttccagtagctctttcattctaaataccctgacttgatcattacagattctatgcatgtaacaaaatatcacatgtaccccataaatatgtacaaatattatgtatcaataaaacgttcatctgataacatattaggcaaggccatagggctgcttccatacctctagaaaactgcctcgtaggtcagggctgagtggtagtacaggaaggtggagtaatctgtcaagatgctgctttaagttgttttgagatgtggttcaagggtgtttgttgatcaaacaccaagagctagctattaccaagaataataactagcatttgtaaatctccagattgacagtttgcaaagcactttcaagtattatttgatccttggaacaaccacgtatctcctgcaaaaatatgggaatgataatacctgctcattagggatcttgggaggattaaatgagataatataggtccaagtgtctagcctagcatttagtgggtgggagcagctgggtaaataggaaccatctttaacaatgcagaacatgaggccatggaaaattcaaaagcataactgtagtcagatgactacgttttggagctcagacccagggaccccattttgcccttgactaatcgtcacctatgattaaagcagaaacaactatggtccaaacataccacccttaaaaaattagcgagaaagaaagagagagagtttgagtatggagagagcaagtatttttgccttcacttttgacacacaggctccctggactgagcaaagaagttccctttgaagtggtgactatgattgaggatgagctagtttccactctaatataaataaagaagtaaaaatacaaagttgaaatatggaaatccatatggaatcattttatttacttacagcaatattgaattatccaatactcaatagtttctctgtacctaagtgttaacataaatgaatgaatctctgatgatccctaaaatcatttcatcacttgaaatgtgattatttacttaccctggctaaaaatgtaaatttatagtcttggtctatgagttcaacatttcaaatttcttaagagaccaaaacgagttaatattcatatttagttattcatgccaaagcgtggatacatataaaaatgatcaccatgtgttagtcaataataaaactttttgatctgttatccattcctctttctaggatcgctaatcagtcagaattgtagatttaaattggtttctaaaacaaagatatctcaaacatggttgtgcacaaagccactcagggttcatacgtatatatatgtgtgtgtgtatacatatatatatatattttttttatttctttttttttttttagatagagtctcgctgcatagcccaggctggagtccagtggcgtgatctcggctcactgcaacctccacctcctgcattcaagcaattctcctgcctcaggctcccgagtagctgggattacaggcatgcgccaccacgcccggctaatttttgtatttttagtagagacggggtttcgccaggttggccaggctgatctcgaactcctgacatcaggtgatctgcccgcctaggcctccaaaagtactgggattacatcatgagccaccatttataagattcagcagatctgagacaggtttagagtctgatttcaacttgtgtcctggcgttgccattttagaattgtgcgaacttaagggaaaaaaaacaaaactaacttttcaagcctcaattcctcatcagtaaaacagaggtaataattcagtaataactccataatgcttgtcccctaggaagccctggacaaaggatagtggttcctctttccatcactattgttattccttgaatgcctctatctttaccccgttattctaaattttaagccttttctgtagttatatggacaatgcagttggccctccatatttgtgggttctgcatctgaggattcaaccaatcgtaaatcaaaaatatttgaaaaaaaaacaattaaaaaagataaaaacacaaataaaaaagtataacgactatttattgtattattaattattaataattattgtattattataagtaacctagagatgatttaaagtattgcaggatatgggtaggttatatgcaaatattataccattttatatcagagagttgagcatccatggatttttggtatctgtaggagggtcttgaaaccaatcccctgtagatattgaggaatgactgtatatgttcttatacaaagtcaaacaatacagtttatgtaagtgaatcctcagtccttccagctcttcctctaccaactcttgattattcttaaaggatcaactcaaatctcatggaggactactctaatttaacttttaataaaattatctgatctccgacattccctattttttttttttttaccactccttcataattgcatgctgtttgtgtattatttcatattctttgggccggattcacaaaggataggataaagtaataccatgtacagtggcttacgtttgtaatcccagaactttgggaggctgaggcaggagaatcgcttgagcccaggagttcaacaccagcctgggcaacatagtgaaaccttgtctctacaaaaaaataaaaataaaaaaaaattccaggcatgatggcacacgcctatggtcccagttactctggaagctgaagcaggaggattgcttgagcccagagttggaggctacagtgagccgtgatcacaccactacactccagcctgaatgacagagaaagaccctgtctctaaaacgttaaaaatgtaaaaataaacctactttgggcataagtcttccctccccaatagtgtttcaatttctcaagcccagtggctgtattttgtgttcttttatatctgattactcatttttcaacaataagagcattctgaaaagctacaaggtattttatcagtagtaaatagttgttgaaaccagttgaaaaaggctgtaatgatttaattagattacagtctgtattgtgtaggtagaagttgcccatcagattaaaaaaaaaggaaaatcctagcccaccagccattctttcaaattttaaatacatagtcaagcaaaataatgcctttcaggtctctgcacacctttctgaatctacaagtttcttctcaatgatttctttcaagaaagtcttataaagagaccatttgaatttttaaaactttaattcaggcagcagtgatcaaatatttgtgattcacaaaggataggataaaataataccatgtacatatacaatcggccctccgtatctgtggatttcacatctgtgtattctaccacccgaggactgaaaatattcaaaaacaataaatggttacatttgtttgtactgaacatgtatagacttttaaaaaatctctaaacaatacaatgtaacaactatttactaagcttttacattgtattaggtattataattaatctagagataaagtatatgggaggatatacataggttatatgcaaatactatgccattttatataagggacctgagcatctgtggattttggtattcataggggtcctggaacgaatcccctacaggtacctcgggacgactgtatatattttgtgtgtgtgtattttcttccctattgcctcagaatagagtttaattccactttgagacaggatggtaaggtatcatgaggaccatagggtaaacttagcaatatacaattgcttagttttcgaaacttgggagaggaaggggctgccactggcgcacaatgggtcaaggccacggatgctgctaaacatcctgaatgcacagaacagccccccagacagatagtcatccagccccaaatgtcattggtgccaaagcggagataccctgagtcgaagcaaagcatctttgttaatgacataagagaaatgctcagttttactcttacagacatttacttgtttgtgtgacccctaaaccaaatctactttgagatgtagagagctgagacattgcagaactcccctcccgccatctgcagatgccctgagtggcagcctggcagcctggcagcctggaagcagccccagagttctttgcacagcgggcttctctcacccatgcccccagcccaactctgagcagtctgggcccgcacatgccagccttcaggctgtttcaacagtatttaaacctccaaaggcttatgaaatattctttaatcccttcccaaaacatgatttaggtgtatttgatattatctgctatcccctagatttcctagtgtttgcagcttattttcaggactaccttccaggtgtagccgtctgtgtcagagacaggagagcctgaggctttcctccaagtggggagtctgcagagaacaggctggcagctgagactttcgcccaaatggcttatatttgatgtataatagttttaattgtgatattattaaaagtgaattatttccatagatcaaaagttaactcattaaatctgttagtctattttaagttggtcttccaaaggaaccatttatatttatatagcattgcgtctttatccttgcaaaactgtggattctaaactcctcaagtcagagacttggaatagcataaatcagatgtgagtcttcattgctgaggctgaatttattcagtcataatttccaagcatttgttcctgctggaaggtactacttatttcacaagaagttcatgtcatgaaagcgctgagctcgaagggccatcacgcatatctagtccagtggttctcaacctggctgcacagggattaccttgggcagaagcccagcccaatgggacaagatcttctggggtgcagctcaggcattggggtttccccaaaactaccccaagtgattctaatgtgcaaacttggtggaaaaagtttattcttttccaattcctcagttacaatgagtaaactgagggtcagattaattcataaaggcagaagtcagcaaacaccgtaaaggactagctactaaatctttctggcattgcaggccatatggtttctgtgggaactgctcaaaagcagccataggcaattcagaaacaaatggatgtggcaggctgccaatgaagctctataaaaataggtgactggccggatttggcccatgggccatagtttgccaacctctggtttagatctcacagttggttagtagaaacccatatgctaggccacagatagactaaccttcaacaagtgatcttccttctactagatgcagttttcctgtttgaagcagtgtctataacatacccaacttctgtagaggttaaataataattatctttatgtaagttaaggcaaatatcttagcataggtactcatagtctagagcgcagaaattttcattatctgtgtctttatgagaggtctgcattttgatggtatttaccaaatttaaagtaataatcacagtatatgtgttttactaaagtaataacccagacaataatattcctatccaagaaattttttcagctagaaagtcagaaaatgagacagcgtgatcagaccaccaaagcaagcaagaaaaaaaaatcagctaagaaaaatggagatctgattttcttttcacccagtaaaggaatcagttgaaaatctcttaattcttccttactgtgctgatgactcatggggagatactttatctcagatttcttttgaatacatctgagtaaatttgaatatgaattatatctaatagctagagatgcttcctacgagtccttgggaaacagcatggactaaggctgaagaagtggaaagaaagccatcacaattaatgtggagagttatgtgtttggtacttatgaaactttgggtatttttcactgtttgtatagcctttcttccaaagtacactcataaaaatagggttcctgaaatgttaaaaagccactggatctggtcattttccttggagattaatttatctctatttggcaattacttcgtatctatgtttttcagagaaagtcactctacctcttcccttttttatctaaataacacattcaataaaagtgcttcatgtcctgaaaaaacaaaactgtcttatttacgattataaaatggtgttcaatcaatgatttccctgaggggataaacactagagatggaaaaacaaaatcaatttgtttttcacaaattgacatccctctgtatgatgccatcattgaactgaagttattgaaaggggccttatagagagggcaccatagagggaaatcatagagaataacatcatagagaggggtatcatagagataataactgcatggagaggagcctcatggagagggagctttgagaggggacatggaacacacagtggtagattaaaataatccagtaatcaatttggccacataaataatagtgatcataatttatgagggcttcccatactaattaaaatatgcataataacaacagttcattttcataattgtacacttaagtcatgctattttttctctttttgcctagttctatggtatgtgtgatcatggccttacaacttttagaaggtactggcaaatgtggttgcagtgaactgtttttctctgaagctttctgcagtaatcctcctggcattattaaggtttccttaatcatacttggttagaggtgatttgcggtcctaccaaccttaatttgaattttctctctgcctcagataagcttgactctggggaggtttctgaacatctttaaatttgagttcccaaattataaagtgggttcagcaatgactgcttttcatggcttatttgagaatatatgagattgtgctttaaaggattgagtagaatgcctggtttgttcattagttttttcttttcttttcttttcttttttcttttctttttttcttttcttttctctttccttccttctttctttctcttcctttctttaccctcccttctttccttccttttttttttttttttttttttgagacagagtctcactcttgtttcccaggctggagtgcaatgatgtgatctcggctcaccgcaacctctgcttcctgggttcaagtgatctcctgtctcagccttcccgagtagctaggattacaggcacgtgccaccatgcctggctaattttgtatttttagtagagacagggtttctccatgttggtcaggctggtctcaaactcccgacctcaggtgatccgcccgccttggcctcccaaagcgctgggattacaggcataagccactgtgcccggcctccttctttcttttttgagacaacatcttgctctgtctcccaggctagagtgcagtagtgcaatcatggctcactgcagcctcgacctccccggctcagcctccagagtagctggaactacaggcatgtgccaccatgcccagctgatttttgtatttttttgtagagatggggtttttgccgtcttgcctgggctgatctcaaacttctgggctcaagcgatcttcccacttcaacctcccaaagtgctgggattataggcgtgaaccactgcacctggcccccaaaactttcaatgatgacaaattattccctgtagtaccattactattattctaccctttggcataacatagcctaggctgcatgttctgtcttcttcaaggaagtgtctatgattaggagaaatgcaagagggaggaacatactggaggatgattttatctctcgcacatatgtgaggacagcaacacctaagtttgctcactccaccctagtaaaacttcactactggcttaatccttgattcttgagtctcagtggggagtcattttctagtactgttgagagttatatagccctaagggattttatgaaataaagtgttcccaaggagtgttctagaagatgagtgatatgagttaataccaagggtttcttctgacagggagtgttaggtgataagacaactgctgaagattgaactgatctttatccagggaagttctgcacttgagattgtctttataggacaggcaacaggcataaaaaaaaagtgctataaaaataggtttgtttgtttcacagtatcattgagaaaacagctataaagaagatatataaaaatatataaatctatcatgtggtcattaaatgccagcgacttattgaacgatgatttataaatggctgaaattcaaagaattttcatggaaccaaaccaaagcatttcagaacatctttcgttctttcaaaattgaatcaactgttcttcattttacagcttctaaatattgtttgtgtgtgtttttgctgttgttgcacaggaaataatttttaccttaaaatattaaaaacttttttttctaaataataaactccatgcagtaaaaggcaacaatcagagagtgtaatgctagaacatttcaggcatgcccaaaatgcccatggcaggatgaaggaggcaacctcatggggcccagccatttgtcttgtaaagtcttaaactaccataggaaatccctgtaggatgttctattgtgtaagagttccatttaaaatacattggcaatatcctaaaaaaaaaagcagtgaaaatctaaactatgtcttgtagcttattcaaatctattattcatctactgcagcagccaacactgctgcatagagctaaaggagaaaaaaaacgaagataaaataagcaagagaatcatgactactatgaactgataaataaaagtgttaaaaaagcaataaaacaaaccaccagcttgttattgggctttcaaataggtatgtttccgcctcctcctcctcctcctgctccttctccttctccttcattcagaagcaatcatcataccacaagcaaacaaaccattttgaaggtgtttaccaggaatgtttccctcccttttaattttctgacctgagtattggtacaattttttctttcatcctttttgcaggcaaaggggttactggatgtgctaaaggaaagtatgattgtagagtgggaaaagggtgaagaacaatgttttatcttcttatgtcaattaggcaggacaaaagacacaggctcccaaaaataccttcagagtttgtcatcctggatcatgataaccttcaatatgttgaaagtctcgttcatctgggttcaagatcccacacttaacgaaagaaaggccgaaatttcccgtaatgttctttactttgggttttacaaaaacacttctatccaggtattttttcttgttgaaattctgaagtaactcaaggtgtacacatgtaatttaaaacttagctttgaagccgggtgtggtggctcatgcctgtaatctcagcactttgggaggccaaggtgggcgaatcacctgaggtcaggagttcgagaccagcctggtcaacgtggggaaacctcgtctctactaaaaatacaaaaattacccagcatggtggtatgtgcctgtgcctgtagtcccagctactaggtaggctgagacaggagaatcacttgaacctggtaggtggaggttgcagtgagccgagatcacaccactgcacttcagcctaggtgagacagcgagactcagtctcaggaaaaacaaaacaaaacaaacaaacaaacaaaaaacacttagctttgaaaggaaatagcctatgtttccacaaattagagttcataattatgttgcatttctactatataggacagcaacattttcacctgatctgagctcatctattagcctttccttacaaatttgaatcaaaactttcgccaggctataaatctccctataattggtagagagctagataagaattatcccataataagagtttgggagaaccttgtggtattaaagggatgctgacatggaatactgtatatatttctactgttaaattagatgcagtcctaatactgtttgtgaaactaaattaggtcaatgactcagagctggttttatttagagtgagctatatattaaaatgtagcaatatttcccttcttctgaaaagccttctggtaaggatttcaattcattgtagaaaaacatttcccaaattaaggtattttaattaagtcctggtaagaaattccaagcatgcttttttttcccctcctcaaaagaggccttccacattgtgcatttagtgtttactaagatttcaaatctctttggttctaaccagtatcacttagataacacatttcacttttttttttctcccttaagtgtaacctgggaaatcccaactttccctttgatgcactaagtctttggcatctcaatctgttaaaccagtgcaacaatcataacaggcattttctggagatgttacaagggatgaaaaaaaaaatgaatgaaatgagttgactttttaaagaacgatgccataagaagcaagacataaatttgctccagaagtcaaatggtgtgtggggagaacaggctttgaaatcaaatggaactggtttggagttccagcgctggcatcactagtcgtgtaaccctgggaaacagcctgagtacattttgtttgtttgtttgtatttttgagacagaatctcactctgttgcccaggctggagtgcagtggcacgatctcagctcactgcaacctccacctcctgggttcaagcgattctcctgcctcagcctccctagtagctgggattacaggtgcatgccaacacacctggctaatttttttttttaaaaaaacagagtctcgctctgtcacccaggctggagtgcaatggcataatctcagctcactgcagcctttgcttcccgggttccagtgattctcctgcttcagcctcccaagtggctgggattacagatgcacaccaccacgcccagctaatttttatatttttagtagagaccgcgtttcaccatgttggccaggctggtctcaaactcctgatttcaggtgatccacccgcctcagccccccaaagtgcttggattacaggtgtgagccaccacacccagctctgagttcatctctccatcactagaaatcagggtaatcatacattccttatcacattattaagaggactagagatagaatatgcagaatactgggcatgtagtatgtgttcaataaatggtagctgctattgttactgctactactacagctgctgctactactaaactgctgctattctcattgttactattatgactcctactattatttctactgccaaacaaggaggactgtggaaaaagaagccactttatccagctctaaacaaatgagttgttacctcactgtagcccacctttctagcaggaataggagaatgaccaagtgttttggaatcagataaacccaagagtaacttaaggagaatgataggaccatcgttgataggagagcctgagtacattcccagtgctgtacttgtgtggctgtgaaaattattgttccaaagttgaatattgtcaagggtgttgagatttatctcatggtcaatatttgatctttcaaagctgacctatacctaacacacttcaaattggttcagtgtatgtagcccttgttacgtggatattattgtgagcacttatataccagggaatgtgtcatgaggaagaattattatgtgtttggtatgtagtcattgaattaagacttccacataatgaactggaatggaattgcattagaaattctttttttcatccaaaataaaagtaaactcaaatataattatgatgttgccttctaatgtgacctgattgccatatctttgtaatgttccgttactcctgccaacctaatgtcagtgtgtactccaattcaattcagcaaacatttattgatcctagtcagggatgggaagacactaagattagcacaaagatacctttgtcattagtaagttactacccagtaaatctggctagtatattaaatctatggtcattttttacattttgcttttcattctaaacatgtaaaatgataataaaaaaagaaagtatttagaacagtaaaggttcaagtccaccccttttttcttcacctttttgtttagacactatttctgacgttaattaccacattaattgggtcttaagttccccttccagtcctcattatgacttccacatttcttacaactggcagaccttgctaagtcgtgaactataagttttttttaaaggttcagagcatttagtccagcaacacaaattaccctatggagacactatatacactagtagcaatgagcaaatgtttcttttatttttataattgttttggaaaatcatatgattgccaaagacagcctacacatggtcaagttggattcatcccagccttaaaaagtctgcgaaacacattaatacttgtgatgtatagagttgagggatgttttgttttgttttaacatgcttcttatatgtacattggtaatgtttaatttaggttaaaattctatgaatgatttaattgatattatccaggtttgttaaccattttaaatggccgttgattttgccaaattccattctatgccattagaacgctgtccacactaagttccgttaatgggggtaaaactcccatcatttgactcttaagtatggtaaaatagctgtctagaaataaatgaaccagagtcctggaaaatccagtggagatgcctagcaatgggggtccccaaagacttcagcgtaaggtgcttatcccttgaagcccccaccctcccacccttcctctatttgtttcttaattgcacattgttgttcagaaaattcacacttgggatttttatattttgtgatttgaactcatttttgcaatttcctttttacatttctagagagctgcttgaaatggatgctaaactacaattccagccttatgtgttaggaaatactttttctctactacaaagtgcaaagaactggaaactactttagtagagttttcatttaaaaaacctctatcgtacttcagtactggaggaaagaaaatgcttgtcaatcaacagccttgtgtttttcagtcttgatatatgtaattgatatatgatatatcaattatatgtaatatcaaaagagatggtgtgcacaaagcctgcctcggagtacattgaataatattttattcagatattcattttaaagttagtgatttcagatatggagaagttgtagtcaccagctgtgatttactggggggtggtgggagggcagggggacctattactggcacctgaactggtgatttctgtttacctgtaatccaaaaataagtaagtgtctgctaatttcacctgctaacatgtgacagcatctttccaggcaaagagtagaggtagccctgagagtgaggcctttcttttcggctcatgtatgggagagaattgtgttttttagcagagaaggagatagcttagacctattgcatttggtaccttccgtagaatgtcagtatgacaagtaactggactcttccagacagatctcaagagaacctgagtgcccattcaagagaactggaaaaactttcaactcccaggcagcacccgcatagctctgaaatttgagagcactctgcactctcaattcattcccaggatttgaaaccaaagtgccaaattgttttctcaaactctgtaggaaccgttatccacctactcacccatctacctgcccatttctttagcaaatatttgttgagactactatgcagcaaatactgtgttcggtgctttgaatccaatggggagggagagcaacctgggtcttgtcctaaggatgctttccttttaagggaattcatgagtcttttctgccctaaattgtctaactgtaagaagaggcagggagaacctcagtatgtgttactagagaacattggcactagtcgatttaattttcaccaaattgactatttggatgagatcctcattatgcacagtgcacatccaacttagatggaaccatctaaattggaataatagacctttgtgatctgtgactccacggatgaaatattgggtctcagacaatcaaagacagactgactctcactttgaagcaatgcatcaggctttataattaaactagtttagtcgcaaacttcttactatgaacctcaggacgttctgcaggtaacaactagaattatttgtgtggaatactaacagcccaggaaacagattaaagtcacaggcagaattctttagccttgttaagtacttggtgttaggaagaatatggaaatttcccagatcttgaaacattgtaaaggccctgggatatactatctaaaggcctgcaggcagtatccagaagtcttccacgatccttttttctttttcttttttgagatggagtctcactgtgtcacccagtctggagtgcagtagcacaatcttggctcactgcaacctctgcctccaaggttcaagcgattcttgtgcctcagcctcctgagtagctgggatcacaggcatgtgcaaccacagccagctaacttttatatttttagtagagatggggtttcaccatgttggccaggctggtcttgaactcctgacctcaagccatctgcccgcctaggctaggattacaggtgtgaaacaccgcaccgagcccaggtgtcttccacaaaaattagccaggcatggtggcacctacctgtggtcccagctactcaggaggctgaggtggaaggatcacttgagccagggaggtggaggctgcagtgaactgtaaccacaccactgtactccagcctggctgacagagtgagactctgtctcaaagaacagaaagaaaagaaaagagaagagagggtttgatttttttttggctattgaggaaactgtagctgtaaatagtgttaattctcagaaaaccagttaaatggtaaaattcaggagatcattataatcaactttaatcatgaagagatagttacatatgtggctcagtttctttttttgtttgtttggttttgttcttgttgttttgaattcagaagcagctttattttaagaatctcaatttatagtgaagtctcaatctctttagtcatcattatgtaaaatagaataacattgcaaagaaaaatcaaataaaagattaaaaatcctagggctagcacatgattgaagcaatattgaaggtcacagatagtataaattctctgattattaacagaggtgagctttgttatagggagatggatcattattaagtcatctgtctgatctagagccagccgcacgatctaatgatttcattcttggattatttttaatatgtagaattagagatgtttgggaagtgtttgctattatcttgatagtacagtttcctcctaaattacttttgtaaagtaaaataatgttacattggaagaaagtgtgtatttcttagtaatgcttcacaattcctcatcctacatttcaataaatcatcttatacctgtcagcacatgtagtctaagatttattgcatggtccattgtgaagcagatagctccttggccagagagcaatttctgaaactaatttaatcaaaatgtttttataatacagtgaactatggcttgatgtcttaaatatgcattgatgtcttcagaaccatatgattaaactctatccaattttgaaatggaattaagatttggcttcatatgacttctgttatagtcaggaaatctttggttgcattaatattatttatgtactgttattgagcaaacattcatcagtgcctctatttgcacagccaacccgctagatgttaagatgttgtgggggaacaacaacaaaatactagtttagtagaaagacgtaactgagagcttggaaggagcagtagacatggcacaatttattggccaaaaaggaatccagttttgctgaagttgaatgttcattttgcagggtggtggtaattatagctgccttctactgggaaagttttaaacctatagttttgatgagtttgcacgccaactcaggagtttgaacttcatcctttaagagttgaaaaattttggagttttgagagtgatgtaagcttactggaaagattacgttgacggccatgtgtggacccaactggacaaaaattagaggaatgaaaaccagtgattcatggaagattgttagaatggaaaccttgggaagaaaagggaaaactgaagtcaaggagtcttttaaaaaaacaactccccaaaatctttagagagtgattagatagaagacatgaagagcatagtaatatcttttgtaaagatcgaggccgggcatggtggctcatgcctgtaatcctagcactttgggaggccaaggtgggtggattgcttgagcccaggagttcaagaccagcctgggcaacatggcgaaacctcgtctctaccaaaaatgcaaaaatcagactggcgtggtggcacatgcctatagtcccagctacttggggaggctgaggcaggaggatttcttgaacctgggaggtcaaggctgcagtgagctgagatcacaccgcagtactccagcctgggtgacaaagtgagacactgtctcaataaaaataaataaataaataaataaagggaaggtggggagaaatttcaaaggaacagatgatgcatttaagacagttgagtttaaaataacaggggaccagcaaagctgaaagttggtattgaactgatagtgagagactaaagcttaggtcagagttgagatctgagatcaaaatctgaatcgtgtcaggacagaggatggagttaaagctgtgaaaaagaatgccattgctgatggaatatgtacatatgaagccactgttttattataattgtttggatagaacatgttctggtgggaaactcacttgcagtcaaaattgcacagtgctaaagtctgcctttaattatagtaaatgcattcgatttgagaatttgttcattacctgtatcagtgacactttattcaaataaaaacagcacactggagaaagataacagttgtggaaggccaaaagtcctctttgtgatttactatcaccatttaattattaagctgtctgatgtcatgtgacactgcctccccagagtgtcctatcacagtgatagacgaaggtcacagacatttggaaatcaaattataaaagtcacactaaaaagtcctgagagcaaagtttaacatgtttgttttcagctttatatattttctgtcaagctgaattttgaattttgaagaggtacactgagtccaaccaatggttgggggggcattattttttcatcataaacagatgagtctggatcctctgctggctggttgccctctccccctttcaataccacttaatttttttttttaagaacgacgtttataagtaatcaagaatacactgggagcaacttcagcatgactgtttttttgcgtgtgagagagggcacgttgtgaacatctgagttctatcttcatttttattagaaaaagcaatttagaactgccagtcagatgggttaaaaagcacagctgatcgaggtgcagcatccatgcctgaaccttctgtgtggcatgacattggctcataacccccttacaccttctctagctctctcttcagttctgcttcctgttccgcagtagagactgaaggaactcgggaaaggcccaagaatgggacctgattacaaagccttagtaagtaataagataacaaaatgtccacaagaaagggaaagtggggagagaagcagagcaattgcttacttcctacttagcttttcctctctttctgttttcccaggggaaggtgcccaacaatttgtatttttaaccggctccccaggtgactgctgtggttgggccaagctacattttgagaactcctggtctaccttctagattctacagaaaagatgagactttgcaatttgtaattgttataactggcaagtctccttccacttctgagtattggacagttttctctcactggattaaaagcaaatggcttggtttttaaaagtttttgaaagtaacatttattatttgacttccgctttagcaacacgttgtatatgtaaactcaaatatagttcagggaactgagagctagttcacttccaaaatacagtgacccataaattgtctttagtcatgtataaacaaatgaatgctattgggaaaatgccttagtaaatattttttgtaaaacacagcaaattaaatcactttctagaaaatctattttttttttccccaggcaagtggccatcaatcaaagaagcagaatactaggtgtggttttctttgtttttgttttgttttgtttgaggcagtgtctccctctgttgcccaggctggagtgcagtggcacgatcatggctcactgcagcctcgacctcctgaactcaggcgatcctcctgcctcatcctccggagttgctgggactataggtgcatgccaccacgcccagctaatttttaatttttttttttttttgagacagggtctccctatgttgcccaggctggtctcaaactcctggattcaagtgatcctccagccttggcctcccaaagtgctgggacaggtgtgtgtcaccatgcccagcctcagaatactttatcactttggtttccaaatattgggaatattttgcaatttaccttttagactacacaaggcttcagggcaatgctcttgcctgagttgacgtttgaaagtgaatagagctgtaaatctattcttttgtcgtcagaatttttttaatgtttttcctaaatatttaagttaaatgtgttaaaatattgttgaatgataaacatctgtagtacacttctgttgtgtttctggtgaaagtaactactgttaaggtcaacagaccaaatttgtatacaaatgctttggcaaattagaaattgaggtgaccattcagtagctctttttaggcattgggaatactcgaatgcaagaaagcattcccttatattttcaagtataaaaagtcctctaaattccttaacagcaacaatcagtgtttccccgctaagcactgttttaataaagttgctgggattttctatgataaaatcacataaatttatacttctacatacatctatatataattttattcctgtacttgttatatacatataagctgcattacaaatatatttttattctgaataaatcctaaagtataaaagtagtaaattgaataaattattgattttccttcactgtatcacagaacctgtttctccattttgagcaatggttctcgaacttggatgcacattggaatctcctgggtagctttcacaaatcctgctccctggacctcactcaggcgaagttatttatactctccggttgggaagggaggatagatccaggtgattgccatgtgtaggccagaatgggaactactcccctagtagacactcctcatcttctttccttccatgatttccacatttctttcaactcagtcgaaatcatcttgaatagacaaaggcagtgtcggtcctactaaaggttgaggaaatggctgagtaaagatgatgaagtcagggacaaaggatgcaatgaattttaagaatttgagattcaaacttcaaaacttaggcaagggtctgtttttgaaggttcagagctgaaaaacaatggcatgctttcatattcttctttgattctgtaggatgtcccaaatggggaattctcttacataatattgattttgtaaattcctgacagatcgtacccactttggatggaatggaattttaatctatttttttgagccaaagagtgtgacctcccttggccttaaatatttttttgtaccacacatgtggggatatgagtattgtgaaagctacgaacctttcctttgaatgccacaattcaagaacaaagctgatcatgtattgaattttaataatcattttcagcagctggtccagaaaagggcattttcctctaaaacctaaaaaattcagaagataaattcctatagaaaaaaaggaaatcatacttatctattcaaaattattagatcaaagactttcaactattttagcttcaaatatgtttaatatattgagtttaactgacatgaagtacctgcaggatgcgtggtgctggcttagaaaaagatttggttttcctacagtatctgaaaaacaaaaatgtattttcatccatccaaggctaagcatccactatgagactaatttgacattcaggtctggtaaaaatgtttgatggtatcagttaaaaccctgttgaagtaggaagaccagaacatgttcattagtgagtatctggcaatgttatcatctacttaagatggaagaaaggggataagatcaaaattattcaatccctgagtgatggaggaagtaaagcttgaaggggcctatacagacaacatgtatgacatccatcagtatcaggggattttatagacattaattatctagtgctctacaccctccctgcctgccttttaaggtgtattttatgattgaggaaaaaaaaaaagaccaggataatagaattgaggaagatagcaatcaatgagtaattccttatccagtcggcacttaaaactcaatgctttatatatttatttgcagagtggtaggaactaactaatcctcatgctgtgccttccttactcacttttgaccatgtttttgctatagcaaccttgatacaattgaagattgtcatttcttactcttcctcagtttgaagctcctgctttcctggacaaaagacacaaataaaacaggaatttattcaatcattgcattttatccataatttaagacatcttatctataatttttttctgagttaaaatttattttggtggttaacaaaaagagtctttagaattttgagtacctgaaggattggaatttgaggcatcctcctacactcccatagtaggtgttgaaaatgttaagttaattgaattatattgaaattttaaaatggcttggagcaacagaaaaaaaatgttatgtataaattaattaaaaactacatggactgtttttttttttttaccatccacatggataccagggatttcttttctttctctttctttctttctttctttctttctttctttctttctttcttttctttctttctttttctttctttctttctttctttctttctttctttctttctttctttctttcctttctttctttctttcttggattattaaaaagagaaggttgttttttaaataaggaaaacaattttctgcaaatggccagatagcagatattttggtctttgtaggtacaagtcctcaactttctcattgtactgtgaaagcaacagtaaacaatactttatggctacagaaatgtgagttttgtatacttttcatgtgtcataaaatgttattcttttcattttaaaaaaaattatttaaaaatgcaaaaatgagggcgggcacggtggctcacacctgtaatcccagcactttgggaggctgaggcgggtggatcacctgaggttgggaattcgagaccagcctgagcaacatggagaaaccccttctctgctaaaaaatacgaaaattagctgggcatggtggtggcacatgcctgtaatcccagctactcgggaggctgaggcaggagaatcgcttgaacccaggaagcggaggttgcagtgagctgagatcgccccattgcactccagcctgggcaataagagtgaaactctgtctcaaaaaaaaaaaaaccattcttagctaacaagccacacaaaaacaggcggcacgcaaggtttgaccagtggaccaaccatagtttgccaacctctggtttaggacattgaatatctcctgatttgaaagttttcacttgaacaaaaataattaactactattagtctgttctacaatatcctcctcaccatgtaattcttaactggcaagtagattgcctcttttgttttatttatttatttattttaaaagacagggcctctttctgtcccccaggctggagtccagtggtgcaatcataactcactgaagtgttgaactcccaggctcaagcaatcctccctcctcagcctcctgagtaactgggattacagatgtgtaccagctgtagtctacaaatttgacctgtacccaatccttggcttaatattaatttttaatttttaaaaaagtttttgtagagatgggggtctcactatgttgcccaggctggtcttgaactcctggtttaaagcaatcctcccgccttggcatcccaaagtgttgggattacaggcatgaaccacagtgccctgcctgtggcctcttttgatattgctatggcagcccagagtactgtgttgagaaggattcagaagttgaacaagggcaaatgagcagagagggctgccagagagttgcccaattggaccatccacagctcttctagctgtgttatagtcttacaaaatgcttcctttatgtcctgctgataaaagttatagacttattcttagaagcatttttctgcaggcataaattttgcaactgagatcattgtttttaagttagagaatttgaaaggattctagtaatatagcttcatgtgatatccattctcaaaaccaacaaatgtatttattggtcatttgctcacctctcttattataggcagaaatggggctggggaggaggagtgaataaaaaaggccattcacatctctaatacctggaaataactagtcgtcattggatctgctaaaattataactaaatgaatagaactatactaagatacctatttatctccattaaaataaaagctcttctagaccatacacagtatttaaaagttgttctctgtatgttattgactaccaggttagaaaaataaacactgaactcctaatgatggaatttataaatatatggaacagattctgtggtgttaatatagaaatttcaaataaaacctgacaaggtaaacactgtatcacatatcaaaatgacttaaattgtagtccatggaatactagacttaaatttatatgcagattgtattttattaggtttttgaagttccctcggcggcctgtcttgccagggcatttggaaatggtagctattataaccaatgaaaaaaatgcattaaaaaattaaaacaacctaaattacatgtatttgcggtctgtcgagtcaaacctgaagatagtctcagcctcctgcagtgcaattaaaacatctttaaaatttagttacatataaagaatttatgcttttatacaagtggcatgtgttaatatgggtgtgttttcatattaactattgtgattaaagtttcttagaagaaaatatatgggtcgtggcacttgacgtgtccatatcctgatcacgctggagtggtggtgttgggtgccagggctccgaatacagttgctgaatgtcactctgaatattatggaatgaaacaagccagatctgtgtttgccttgaaaggtatccagacctaatattgtactttaaagacattctgaagtattgacttcggaataagagcaagcattctttaagtcctgggcaaacccaaaaggaattactgaaatctcctgtttcaagcatacattttaatagtagtgctcaatgacaagtcattaattccctgcaacctgactcttaggttcaggtctccaaaggctaaaattaggggcatttgtctgcttcccttgctatttgattgggtatcactgtatgtagaagtacaaagctcatctgttaagttggatttactattctctgctggtgtccctatccatgcctaaaggctcatattgagattggtgtaaaatcagctgtcccaacatgaattgttcaattatcagctcaaataagccttactaaaaactacctaacatgaaggaggttgactgtggctctgtgaagatgcatccaaaatgtgtgcattaaaaataaaaattataagaaaaattaatcaccctttttgcataaagtatgtaaggaagcctcattctttaagcaacacatgttttataactttgccttccacaaatttgacctatacccaatccttggcttaatattaagaaactaaatctgcccacaggtatccttgccttttataaggaccattttgaattatttgtatttcttttctttggtggtagtggtgggagggtagtattgaatgccaccaagtcgtaaacctcacagaataagagcactatgaaaaaatcacttggggaaaaggtaatgaattaaggctgggagcaacttgactttgggtttagatggaacttgaagttgatgtgttagtgataattgctatagcatctctctatttttataaatcccggtttggaaaaatttgtttgataatgttatatttgccttcacaggaatcctgtgctctggacagtgttatataacattcctcaaaaattcttctaaactctcaaggccctcttcttggggtcagactcaacggtaccaatgagaaaagcctgaaagcatggaagacttctgttgtttagcaaagctgagagaagacattgtcttaactatctacactagttgttaaattaactaatcagttgatttactacattggatttcagaagggttgtccggtgaatattcagttttccatgctaattggaaatatcattgcatatttaagggtgtacggtgggaagggactaagcaatgatgggtatacagcaagtactcaatacatcctgtggctttattatactctctttttgctggtagaattttctgctacacacatgcattccaggcaaagggaagagactgcgcccatgctcagacccagaaacaagcctggatccataaaacagcttgttcacaatggcaggagcacagcacaggagtggggaaagtagaggaaaagaggtatgagtaatactgaccacgaaaggaaagggagttgcccattcaaactaacagatgagaagggcttcatggacgagatgacaacaaatagtagcattagcattcattgagatttaggacattgcacaacattttagaaatatgtacacttagtctaaaacagggacccgcagtccagatgggaattctgacaataatcacatcatgagaaagctgagcaaataggattcagtgtttttggaaaatgtaatcttagggggaaatatattcttgtagctatgtactactaaattgaaaatctacagaacaaatcatttatgaaatgtgtgggcatgcttttaatttggtggtggtttaaatattttattaactgtatgggcatgcttttaatttggttgtggtataagtgttacaaattaagctttttttaaaaatcagtctaaactcgaaacttgaaaaacaagttttttattttatttaacaagcaccgatacaacacatcgtgagccaggtactcttcctagggcttccatgtatctcctcctctaatcatcttgacagccccatgaggaaactgaggcacagaggttaagaacttgttgaaggtctcagagctaggacttcaaaccaggcagactggcaccaggttctgtgtacttaaccattatgctccttaaattagaatatctacgagtcaaaatgctgtttaattttcttcagattattgtgggttctgtcaagctaagctttctgcccataagtgaaagtgctcttagcatcttgtacagaaagaattcttcctagaggttcattgagtggcatctatttcagacttacacaaaaagtttgggacaaatgttagtgtttaacagaagcagatgtttatcagtggcccagacaatattatcattttgagttttaccttctaggctgggggcgtggcaaacaacagttgtgggtcaaatctcactcaccacttgttttggtaaataaagtttcattgaacacagtcctatccactcgtttacatgttatctatggctgctttcatgctaaaacagcagcagaattgagtcattgtgtccaagaacatatggccaataaagcctgaaatatttactacacgatcttttatagcaagtttgccaccccctgttctagaccagtgaggtagccaccagccagatgtagctcccaagtgtttgaaatggggctggtttgagttgagatgtgtcataagtgtaaaacatatcagattccaaagacttagtaaaaagaaagaacaaaatataaaatatctcatcagttttcaaatattgattgcaggtggaaatgacaattttattaaaattaacttttcttggttctattttttttaatgtgactactagaaaaatttgaaatgtgactcacatttgtggctcacattaggtttctattgatactgctgatctacagcctggaatttggaggatatgtgacctctaggaaaagcagaaagaggaaagatggggaaagagagaaaacctcttgtatttgcaaatgtctttctaaagcaataaaatattttctgatttggctcttcctcacagaaaggcatacgcaaaaatgggttaggtggtctatggagatgatcgtagatgagttctcccagaagcagactctgactcagaatttgaattgggaggtgatccaggaagcacctggagggagaggggatgcaaacagggaagagattgaagaggaaagagggttaatgagcaggttgttgctgtggacccatgtgctgcctcccaattgcgccctgtgggagattttgtagacagaggctcagagtggttccacccaggaggtgaaaaagctgggctgcatatccaccaattgccagtaattgccacttgagggctgctcctaggaacatcagcttcttcttactctccccagcacctgccttgcctgaagccaggtaaggccctggggtgaaaaggcacaggtgcttgcaggaaaaagccatgagcaagctggagaatggtgcctcccagaggcacagggttgggcccttctagtgtctggaactgtgtccaaactaaatgttccatcttctaattcataatttcaacagacattcatgtagttctctggtgaatgtgttcattttctcatttgatcttaacaatagtatagataggtagatttatcattatccatacattatggatgggaaaactgagcccaagacacatccagtcatttgccgaagagagtccagctgggatggtagtcccggtctcctccctcttcatatgtggtcactgactccttggatttctacaaaacttgccttgagtaaggagatgtcaatatattgatgttttcaaggtgagaacaggaaactaaaaccaatttttcttgtgctctgtagaatttttttagatatccatagggcagtatagaaactgatatctacttaatcccatgacttttatatggaaaagtatgatctctgttttgcacaagtcacaatcaaaatcaagagattatggagactgctgaccactaccacacaggatgttagtgatagagttaatttccagaaaatcttcagagaagtccctgtagtggaagcttatgggtgcatggctcattaaggactggattttgttatcttcccattacccaggttcccttcaaaggtgttgtcagcccctttggtaccacttggaaacaagtctctctcccagcttaatttccctttattatgcttctaactgactcggtaattctttgcagacttcagtaacacttgtactatttaaatttgaataaccccaaaggatctggataggtcaatgtgtttaaaccacaggctttagtctatgtattagttgattaaaaacagatttgatgcatgatgtatacttaataaagggagggggaagcaagcagatgtttgtaaaatctcaatgtgttggattgcatttctttggccctcttttgctgactaactttagaaaagtcatacttatgacaattgaactgtaaacagttagatgatgtatttccctagaaatttcctgctgtgaagggtcagccaaaaagaaaagtatcccctagtattaacataccaaaaaagttgacaaatatacgttataatggttatgtctatatcaaggacattgaagaatgggatgcttcaaaatcatcctctagtctctgaccataaagtgattagcagttgcgattcatttaatccaaacaataaaaaaaaaaaactttggcttttgttgttgttgttgttgttgttaaaagcaagtttttctttgatgcaagcataagatcaagttgtacataaatcactgtgtctagttcattctctgactcttcagcctcttgtatcccattctttaagtgaaaaagttattcttcccctttaaaattgtcatatttgaaatgttttgagtgattccaagacagaattgaaggtttcttgttggttttccagtccagatgaaatgtgcacaaagccttcctctgaagtttgaacacatgagaattacagataaaatattttaaaatgtattttagtgaatacataaccaagcataaacatatgtggaaagcctccaaggaccggaaatgaaagaaagtgtagagtggtgagagaagactgacactgggctactcccaagaagtggagatgacatggggcaatggtgacttcagtggacacatagggaagtgaacatcacatgtggcaagagccttgtacacctggaggccaagacccccatgcatagactggactcaaagggaacctgacatcttctctggaattgaagccagacacagaactctcatggaaggaagcagaggcactgagtcaaactaggatctgtgcctctgttgcacacgagtgccttgtgggagcgtcttctttgggaaaagaacctcacgccctaacctcagaatatgcttcttatctggctgggctatgtcaatccccaaatcacagcacagggaacaaagtttacatcgtatgagctgtcagacaaaaattacaagacaaagataaaatcagatccttgagaaatagtcaacaagcacagggaaatacagaattgccttttctcaaaagagcttaagaataagtaagtttagttgttttgagattatggagaagagaatcgtgtttttgtaataggaacagagagaaattcaataagaaaagggagatgtgataaagaacctactagaaatgaaaatgcattcattaaaaaattttaaaatcagtcaataggataaacaccagattaataagtttaacttgttttaaaaataaccagaaagttctgcttttgacatatgcattttaagccttagatgaaagtggttcttttccttaatatacttttctaaataaaaaatttagggaagtagaatgagctaaaattttcataaataaattttacagcataatgaaattaacacctttatgaacttgttagttttcaaaatccctcaaactctttctaaatcctctttcttggatggcattataaatttgaggtctgttttcttttccatgaaatttcctgttgttccgtatctttgccatacttgtggaactgtctatatgctaaaacacagtttccctaatcttttgccctctcaacctctctgatgttggcatacgacattgttctattccctgcccatggaagattcttccacatgctcacttctttctttccaagaagtttccactgttgtgcaacaaaaaacccctggacatccttcaagcctcagctgcaagacttggccctcttggaaacctttaaccagcagccatcaactctttcccttctcttgtttgcagcatctttctcccagtttgtacagtcatccatttccttgtggacagggaatagatattaatatttttatttgatttccccactgtctctttcagagtctggcatattgtagaagcttaataagtacttgttgtatgaacacataagtaaatgaatgaatggtaggaacacataagtaaatgaatgaatggtgtaaatcaagcttgtccaacacgtggcctgcaaggccacctgcagcccagaagcgctttgaatgcagcccaacacaaattcataaactttcttaaaacattatgagattgttttgtgatttttttttttagctcatcagctgtcattagtgttagttattttatgtgtggcccaagacagttcttcttccagcatggcccagggaagccaaaagattggacacccctggcaatcaagagcatgtgaatgagaaggaacagagaaatcttagtgagtcttacccagaacagagagctattgtgtttgaaaataggattaaatagtcattccagagaactttaagtttgatgctctaaaggaatagggaataattctagagtcttatgcaggataatgagtggtaaatacagtgttcaaagaaatttgatctggcattgatggacaaagaatagaagcatgaacaataaaatgtacaattgtttgttggtatccataaaggattaatttcagggtctctcatagatactaaaatcatggatgctcaagtccctgatataaaatggcctgttatttgcatataacctaatcacatcctcctgcataccttaaattctctctagataacttatattacttattacaatgtaaatactatgtaaatagtagttatattctatggtttagggaataatgaggagaaaaaagtctgtacatgttcagtacagatgcagtcatccatttttttccaaatatttttgatctgcagttggttgaatccaggtatgtggaacccagtggatacagagtcaactccactacaactgaccaaatgtgtgtgtgatgaggacttatcataaatgtctataaatgaccttattgtcagcaagagctaaacaattcaaaccttcctccaagggattagcctcagcctgcccataaaaggataaatctgaaaaatccaatggtagttgatttgatgtgggaatatattccttatgttattgccagctctgattcaagtaaagggatagaaatccaattacctcctttcttcctaggtcgtgacctagagataacctataactaattattctgttaagtatccctgagttagtgcaagaagcaggaacaaaaagaataaagtctgagcgtgtctaaaaggttcttttaaatgcaacttttgaaaatccagtttaaatctataaatacttgaaattatgtcgatttcactaaggtttctgaaaaatgtatcagtttttcctgagaatgagtaattttgtgtatctgaagtataaaagtatgcagaataatatttttcctcttttttttttttttttgaacagcaaaacttagagagtaacctcaccaaccttattaagaggaacacagaactggagacccttttggctaaactcatccaaacctgtcaacatgttgaagtgagtatctctgtatttctgtatggtatgtttcatatgaaaactgccagatcaaggttttgatatcctcatgctttataattttaaaacaagaatctttcttaaaattaaatattttgcaaaagccaaaataaaagatggaggaaattaaaaggaattagaacttcagagagtctttcccatccagggctgcttcccattcccattatagctcttcctgatctagcattacatagcagtcctaatgttggagattttaattgcccttacaaagaacagtcaaaaaaggtattgtaggccgggcgtggtggctcacgcctgtaaccccagcactttgggaggccgaggcaggcagatcacgaggtcaggagatcgagaccatcctggctaacacagtgaaaccccgtctctactaaaaatacaaaaaattagctgggcgtggtggcatgcacctgtagtcccagctactccagaggcggaggcaggagaatggcatgaacccgggaggcggagcttgcagtgagctgagatcgcaccactgcactccagtctgggcaacagagggagactccgtctcaaaaaaaaggtattgtattagtgtactatggctaccataacaaattaccacaaactgggaaagtatgaaacaagactaatttattctctcagttttggagactagaagtctgaaatcaagattttggcagggccatgctccctacaaaggttctaggggaggatccttccttgcctcttcccattttctggtagttgcaggcaattcttggagttccttggctttcagctacagcgctctaaacccttcctccgttatcacattctcctggtgtgtctctgaatatgtgtccaaatttccttattgttataaagagcccaccctactccagccttacctcactttaacttgattacatctgcgaagactctattttcaggccaggcatggtggctcacaccctgtaatcccagcactttgggaggctaaggcaggaggatcgcttgagctcaggagaccagcctgggcaacatggcaaaaacccatctctattaaaaaatacaaaaaattagccaggcgtgggagcacacacctgtggtcccagttacttgggaggctgaggtgggaggatcacccaagcctgggaaatcgaggctgcagtgagctgagattgcaccactgcactccagcctaggcgacagagtgagaccttgtctcaaaaaagaaaaaacaaagattctgttttcaaataaggtcccatttacaggtaccaagggttaggacttgaacatacctttttgcggacacagtttaatgcactgcaggtgtatattaatgcatcttagttgtcagatatgtttccatgaaataaaccacaattgcaacaacagcagaacctgcaatgactacactgaataaggaaaaaatagatgccacttcctttatgtgattttcaaattcctcttccatcttctcccaaactgtcttttttaccaccccaccccatgaactgaaactaaacaattatcattcattacacttttaagccttctggcccttaaccaagcagttccctctgactggtaggcccattcctctaacccatgtctatttgtcagaatgcttcttgtgtatcctccaagtcctaagtcaaggggcacttcagttgtgaacgtttctctggttccctggaccagagtcatcgctcctttctctgaatcacgtaacattttatgataccgtgtatgtgattcagagaaaggagagatgtccccgccccaatctcatgtcgaattgtaatccccaatgctggaggtggggcttggtgggaggtgtttgggtcatgggggcagatccctcatggcttggtgctgattccatgataatgagtgagttctcacaagatctggttgtttaaaagtgtatgacactcctcccccaccgcccgcccccctcccatacacactctttctcttgctcctaatttcgccatgtgacgtgccagttctggctttgccttctaccatgtgtaaaagcttcctgaggcctcatcagaagccgagcacatgcctggtgccatgcttcctgtgtagccctgcagcacccgtgaaccaattaaaccccttttctttgtaaattacccagtatcaggtatttctttatagcaatgcaagaatagtaataatcttctcatggctttatcattctttcatgtaccagttccatttttccaaccagaatgtgaggtcttagaggatgggaatcaaatctaattcgtctttgtatctcacagactctgatgcaatgattttcacacagtaggagctcagggaatttgttttagatgaatttgcatgatgactctccaaatggcaaattttgaacactatttgaatgcctgcaagttcagctcccctaaaatatctaaagttggagaagcaaattattttgagcaggcatttaaaaattttgacagtaactccatttttgcaataagaattccttcaagtccctttgatcgtctacgcagtaattataagtttatagcctcctatgtgcctataactgtcagtagatgcacaatgtagcaaataataataaagattacaatatgttagagaacagtgtacacacatataacaacatatttaaagaacagtagagtagccaatcaggtgctcagctagtagaatattgcatttatggattctaagattagcatttttttgaagactaatattgctgaaattgagctgcaacttaaatgaatggtgagacagtttaatgggcaacatttgtttgttcctactggcacacaaaatatagatgagacagttgctggtatcttagattagatggagtatggtttgagaaggggggattaaaagagaaaaaaatgcgaatacaatttttctgaagctttgtggaagagtcaggacttgagccagttcttatagatttcacaactattatttttcagtaccctaagtattgaggtgtcagcttatttatgcaacacaatgatgtttgtcagtgatacattcctcagcatagcagaaattagcaaagattgctttcagaaagatcctatcagtgtaaaagcatgtctactatgcaaatactggtgctttggtggaaggcttaaaatactttgtgtttgtaaagtctgtgcttttacttacaagtgctccccttgtgatcagaaatgtaaaactggttactaagagaaacacatgagttagcaactttttccaactccaaatttgttgtgttttccaaggataatatccagggagacagaaattagggatgttctcatctcctacctaagccatctactccagctgttcatcatttgaggtgctgatggaggttatgataggtggaagagggaaaggcatacaaaaggaaagaaagggaggaatcagagtaaaacataggtgagagagcagattaggattgtccagtgagcttattggttcacttagtagaccctcttgctttaaaagctacatgattgtcagggtagaatcagtgtttcatcatgttgagatgaagttgagagtgtgaaggcagcagtgtgttgcagaatccagaccttttgaaccctctgcttagactggattctcttttggcaagcctcttgccagggaacatgttgagccttgttgattaaacaacattggaaataatagtgaacaagcataatgttttcattattatagggtaaagttaatatgtattatatgaataaatggatgaacaaaatggaataatctgtgtgccatattttatttttatgatgtgatggcatttgatgtttaggatagtaagaaagaattatttctcttcagttaaaaaaaaaattacctgagctttatggtaaatcttataaatgctttatggattgggtgattatgtcattcaatttcagctagttactccttaaagcattaatgtctggtttccattatgacctgttgtgatttcagaacaaatgcattgcttctaatgcaatattattatggcttgaatttacaagacgctattcatcctaacatgatgtaaaattacattctaagatgttcagtaatttcaaatgatagataaattgaagaaatttacagggagattttagttttattttaatagatcagatatgattttagttgcaatacaggcttttcaaataaagctattactgaattgattgtagtggacttgcatttacaaggaataaagaatattcattcttttctctgttgtttttgtataaatccttgggaatggaagcacatgtttatgggtgagtaaatttggtatttgggaaatttattctagataaaaattaaagaaaattatgagtacaaaaataatgatacttacagtacttatttttacgtttgtttttattcctaattattagtattctgaaagtataattttcaaaagttgaacacccaattctcctataatgaatgaattagtccacatcaaagatttttttaacttcttaatgaaggaaccagcaagatgataaagctgcttccaaggaggatgccagaaacggatacatataaatgtggggaagggggtagtagggggaaaagaatgccagactagcatagctaatttggatacaaaactggttagtgacctacagggcaataaacctgaaacatttggacaaaataagttgcatattactgggtttctctaagttaacatctaacttcgcagagtctaagccctaaccactagtaaatagaaagtcagactctgttacatcccagtctggagagtcagatgaccctgacttaggctgacttcatggaatatgctctcgtgggactttggaagggctcacagtcttctctttctcttttttccatgttttggataattttgcttaacatgactttctgttctagagactgttggtctaggagcagtgtttgctaaacaaatatttctgggaggggatgtacatttttgcctgtggacagttactttaatttgttacagtgtcttgctagtttgttcattttggtagtgcggttggagtacccactgtgtgtgtgttgcactgtgttaggtgccaaaggaccctgcccacaggaagtttactatcttcactaagacagaagagcacttataacacaaaataaagtagaaagccataattaccatgaagaaggtgtggattatctacttcaaactttcagagaaacaagaaattatttctagctggggactggggaagcagcgcaagatctgagcctgccttcaagggtaggtaacatttgagtttatggaagcagcactgcttgccaggcaaataaaggcatggggatagaaagacgaggaatgtatgtacacaaagcaagtagttcattctggagaaatggaaagcatggaagaaggaaggatctgtaggaactagtttgggagagttgagagctggaaaggctttcgtgttgcatctgaatttgaactttggttttgaaggtttagtgagggttcaaggaacacatagacctgtgtgagtttcacagtgacaactggcatttccaactcttttcaggaaatgacatttttggttattgagaaaataatatggatattgtcatgcaaaacaatctcatgtccaagggaaaccttcacagcactaggaaactccaaaaaggccatggagtttgttaggcaccagcatgctattcttttaaatcagtgcagtggaaaagaatttcctggtccacatccttggttcctagatggtacttcttccttttcctcttcctgaaggtgtccttgtatttgggtatgagcattccccgggaaaataattcccatgccagctggagctaaaaaaaactcacagcacagaggcacctcctaattgttgtaaattaaatcaatgaattccttcccacgacccatgaggaaatgccacatccttataagtccacatctcttcccagggatttacctctgcttttcttcagaatggaaaacagtttgaaggttccccttcagccacccaactctccccacccctgccacattgttttcataacttgttttttaaatgagggtaagcaaatgaatggctttttgattgtaagtgccaaacatttttaaaacggtggataacagagaatggcatgctgtggctcatgcctgtaatcccagcatactttgggcggccaaggcaggaggattacttgagcccaaggattcaataacagcctgggcaatacagtgagacctcgtctctacaaaaaataaaaaaactagacaggcgtggtggtgtgcgcctgtaatcccagtaacaaaggaggccaagactggaggattgcttgagcctgggaggtcgaggctacagtgacccatggagtgcaactgctctccagcctgggtgacagagtgagaccctgtctcttaaaacacacgcgtgcgcgcgcgcacacacacacacacacacacacacacacacacacacacacacacacacaagagcagagtatgaaggccaagacagtttgggactcaggaggcagagacattgaaagagcaacttcaggccaggtgcggtggctcacgcctgtaatcccagcactttgggaggcccaggtgggtggatcacgaggtcaggagatcgagaccatcctggctaacacggtgaaaccctgtctctactaaaaatacaaaaaattagccgggcatggtggcgggcgcctgtagtcccagctactcgggaggctgaggcaggagaatggcgtgaacccgggaggcagagcttgcagtgagctgagatcacactgctgcactccagcctgggggacagagcgagactccgtctcaaaaaaaaaaaaaaaaaaaaaaaagagcaacttcaggtagactcctaagaaatgtttgtctaggattgtaaaaactaatgggttttcaaccactctattttgttttcttcaggagagaaataaggtagaatggatgagtttgtagttacactagacaagtttggagttaattatatatgtagtgaaagacaagcttatgagaaatgatcaaaatttgggtcacctgtagaacttaacttttctaggtcagataaggactgtatctcttcatcacatttctctttccattttctttgaaaaatcagaagacacagtttattagctaagcaaacacttggaatcactgatatgtaccaaattttctgcacattccaataatcaagttcttttacagcaaatacaacaccttgacacttaatagatgttcgttttggaaatgataggtgccagtgactctaaagatgatggccaagaacaactgggaaagggtggccaattgccataatggtttcaagaggataaaggctcagcagtccttaccattcttgctcaaggtcatcctagaagggcattttctaatccaacatcacttcaaagttccagcattggcccctttggtttatcttgccttgtttgtaatcacttcttaaaattctttttgccattatttttctcactaagtttttaatctatctttgttgttgttttattttaatggaaagtttgctctcatacggctttctctgagtttctccagtgctagttgtcatgtaaagtgacaaggttcttgtggaggaattaaggctgtttaattagatttctgctcagatgatgagttttgtaaattgaaaaggatgagagtgaggtgttacttgggtgatatgtaccttgtaagaaattgtagaaaatcacttggcaaaacagatgggagtctgtagaagacttttccagtaattcaccaagccctaaaagcattcatttgtaaactttgaaataatgaaaaatcactgggttaaaaagaaagatgaaccatttgtttaattttgttgtgcagttttgtaatgccaaagcattctctctccgtagaaaacttggcaatggcttcatccggagtcattggatgaagaccagcatgcaaacaccaaacgagctatttgtgtcttgtgaacgtgtgtctgatcttggatgaagtatatcctgctgggggccgacatgaatgtccaaagttataatccattttcacttgcagatgagggtcagattcccacccgatctgaccccctgtgagaatgctttcaaggtataattagagtcagattctgggcctcattaaaccacatcatacaacccacagtcagctctggctctccatgtaataggctctagaattatgataatgtgatagtgcaaatatggtggctttcagaaactggattatgacgagccactataataatggttgatttcccaagttcacgtcttaggattcccatgacaaaggagaaaagaactgttggtctgcacagaaatttatcatctctggagaagatttgtttttactattgcatttgaataatgtctattcatatgcaatagtaagacagttgaaacagtttactctaccaagtttactaaaattgacaactcatgaagcaaatgtagtttttcttggtagaggttaaatttaattattaaagtatctaacacatacttgaatgtctccctttggattcagtgcccttgacttagaaaaatttgattcataacaggcattggatcctgtttctttcttgggcatattcataaggagtaatgagaagatatcagcaaaaatctttgagtattttggaatgagattaatcttatgaataaatgaatataaggcttagtaagctggtattacttttagaatgacattcccaagtttcagttttgaaactttatataaaacattatccaaacctttcatcgtctgcaaatctttctagtttgggtggtatgacctattgcatcatatacagaatcctacctagtggctcagattggagtatgaacacttgtacgtgcctctgaagacaaaccctctaatgtttgaatttggtagtgcagatttccaaggttaatacttaaatgtgaagcaataggccttaattggaggcccaaaggctgagcattagaaagttagagagaaagtgtgcttttttctgatatatcttattgtgctccctccctccacacaatacaagaattccttatcctgtctccattacagtattccacacacaaccttctttacctggaaatatttacttgcgtgattgactagagcagcagagatgtttctggcatgatataaagaataataggaacaggtagtgatacattttttaaaatagccattgttggccaggcacagtggctcacgcctgtaatcccagcactttgggaggccaaagtgggtggatcacctgaggtcaggagttcgagaccagcccggccaacatggtaaaaccccatctctatttaaaatacaaaaattagctgggtatggtggcaggcgcctgtaatcccagctgctcgagaggctgaggcaggagaattgcttgaacctgggaggcagaggttgcagtgagctgagatcacgccattgcactccagactgggcaatagagccagactctgtctcaaataaagtaaaataaaataaaatggccattgttatttctaactcaacttttatatgagatggtcttagctggatggtttcaggtgaaagagtcagaggggaatggaatgattgcaggtgagaaggtaactctcaagtaaaagctttggttcacttattgctcccattcatgacattcagaaacaagaataatcctaacaatcaatccaccattttgttactgaaccaaccttttacttctgggtctaatatctagtttaaattatttttctcaataaatgaacataaaattgtcttccaatgacaatcaagttgaaattatctctgtgtataaaataattacagattatgaaagaagccagacatatcattttttacctgattcggttgacttctatttttaatttgctaaattaaatgttgtaggaaaaaatgaagagctttgttctaattttgaaattccacagcaaaataattgagtcatgcatataaaatgtccgttaacaagaagacaattgtagtactggttatttttgtttgaaatagaaatatgaaattttaaattcagctatttaaaatgcccgaggctaccatggaatgtacaaggctctcagtgaggagcaacacaaagatttttacaaccaagtgaggtaacttcttggcctaggaatttatgatagagcttttactatgcttttaaaagtattttccctagatataacatcaagttcatatatgtaaagtcgtgaaaactatatagtggtctaattctctgacaaggcaagcttggtattgagatgtcataagttcattcaaggaagccttctgtcaatttccataggattgggaaggtggtgccttgtccatctttgcaggtgttggaaggggagcattattgcatagatctgttccagtttcacagcaacacatagactgtagtgtaaagaaagaaaaagtgataggacttatgtagatatgcactacaagcagttatgaccatgaccagctcttactgtcacttcctgatttaattatcccaacagtcttttgacataaacatcattcaaataaccacagatacgtggcctgaagccagatataacaagaatcagccagtaaagaaataggttgaatttaaccaagtaataagtaactggagttgttactgaacccaaaccaggtgattagaaagttagattcccaggggaattctcattacaagaaccatcttatcagataggtaattggaaaccctgttaaacccaccataacaaaggctcagcaagtgtacatctgcagtgccagtacaatcagtgagtcttcagttcttatgaacgttctgaaatcttttattattaaccattgaccctctaacctcaacttctttgagatgataaatttgtttcctttagtaaataagtaaattcctttttttcctccttcccaggaagtttgagattcatgtataaagatgaagaactaaataatactggctgagccaccctaatttgaaaatccaaaatccgaaatgctctaaaatccaaaactttttcagcactgacatgacgcgagaagaggaaaattccacacacaagtacttaacacaaactttgtttcatgcacaaaattattgaaaatattgcataaaattaccttcaagcttatgtgtataaggtgtatgtggaatgtaagtgaatttagtggtcagacttgggtcctatccccaagatatctcattatgtatgtgcaaatattccaaaatccaaaacacttctggttctaagcatttaggataagggatactcaacctgtagcataaaatcaatattttgggttatgactgggtgcagtgactcacacctgtaatctcagcactttgggaggccaaggtgggaggattgtttgaggccaagagtttagaaccaacctgggcaacatagcaagaccctgtctctactaaataattaattaattaaccaactgtgagtggaggttcttgcctgtagtcctagctactcaggagtctgaagcaggaggatcactagaacccagaagaagttggagattacagtgatctatgattgtaccactggactccagcctgagtgacagagacagagaccctgaacttaaaaatatatatatattacaacttgggactgaaatatttgtttgtatgttaatagttcatagcatttaagataatatgacatattacagaaatttgacagatttgctttgaaatgctaatttgaaacacgtaatttttttttttttttttgagatggagtcttgctctgtcacccaggctggagtgcactggtgtcatctcggctcactgcaacctctacctcctggggttcaagtgattctcctgtctcagcctcctgagtggctgggatcacaggcacccaccaccatgcccagctaatttttgtatctttagtagagatggggtttcaccatgttggccagcctggtcacgaactcctgacctcaagtgatctgcccgccttggcctcccaaagtgctgggattacaggcatgagcgaccacgcccagcctaacatgtaatttcttttagaactgttattttaagttggatctgtaagatagtttaggtttcaaagcaatattgcaatgttcaaaaaaccttaggtttcagcattttcttttttttttttttttttttttttgagacagagtcttgctctgttgccaggctggagtgcggtggcgtgatctcggctcactgcaacctctgcctcctgggttcaagcaattctcctgtctcagcctcccaagtagctgggattacaagtgtgcaccaccatgcccagctagtttttgtatttttagtagagaccgggatttcgccaagttggccaggatggtctcgatctcctgacctcgtgatctgcccaccttggcctcccaaagtgctgggattacaggcgtgagccaccacgcccggcctgggtttcagcatattttttaagtttagtttattagatttataagagctacttaaggacttgggaaggtataacgtgttaggattttaattttatcctgttagcatttgaagtgcttataaagtaaatcaaatgtgttaaattgataaatgcagtttaaagtgttacaggagtaatctgaacagtgattcctcataggggtgaggattgacctgaagagcggctcgagggtactttctagggtgatagaaatgttttatgtcttgattgagctgtcggttatcaaaatccattaaactgtcccttaagatctatgcatttccttgcatgtaaattttaccgcaatttaaaaatatgtgtgtaggaacttaatcagctaatgtatagacagaattgattgtttaatggagttgagtctattcaacttgagttaatcaaacattgattcaaggactcccgagagtgattattcttggtttcataaaatttattagatgtatgaatagaataatgagatcataatttgaacttaaaagcttaagggaaactacatagtgaattgttgacatagatgcagttcttgaacaaaaatcttgatggtctgtaagtctgtgtctattccttctcctagttggttggactcctgggtaaataggacagtcttcctagtatgctgcgtttagcatgcagcacttgactattgatgagtgaatggaacacctctagaggccaactacatcatccttctgtcctccttgtagcactagctcatttgcatagatcagcatgtccgataagctcacaccttgaagggcagaaaggacccttcttgagaagactgtacacagcactgtgtttttatgacagcaaacctcagtagccacaaatccctggaggatcagtaatgctagtgcacacaaggagctccctcccagcctgagggctctgccacccaggtagggctaagaggatggagttgacaaagggaagtcaaaaatgagagagctgtccatcaggagtgttgctgagccctgaatagagatcgatcgaggtgggtctttccttcccccttattataaacctgtacctttccttttattctctaggataccttctctatcttttctggtttgcaaaagaaaaaaatagttagatagtcactttgaatcaggcttgggaaaacacttataaataataattccacacatgtaagatggctaatcaacctaggtctgaaaatgacttaacaggaaaacattttcaatatcagtctctcatgattcccaaacacacacacacactcacaaactcaccacaacttcaaaattagcaaccaaaagacatctaaatgctgtgatctttccttttctcttccagatcagattagctttgctcttcactgtccttttgtcaaagcccctattgtacagctctccagtgtccttcctgcctgcccttctactgccattgtaacttttaccagccccactaccatttcagaagaaaactccaggaaagcaagtaagcatggatagctttaaagatcaatgctgaaggcccactaagaccaggatacaaagggagtcaattagaaaaaggtgggggtcaaggaagaactccccactcccaagttaaactcctcaatttgctgttttgttttagccagactctatggagctcagtcatggctagctctctgcaaatggcccccaaaaggcttttcacaaggggcagtaagatataactggcttcggtatttctgtctccccattcccagataaccaattcaagatgcatgcccactgtaccctgcatgttgttgaaacagaattttaatttcctctgtcttgcaaaaatgttcttttgcctctcttccctggtgccttttctcatcttcctcacccctgggtttcctaactctgtcttgcctactctgatctccaaagaccagtctctccttcatatttggcatgaaaccttcctcagctactcacacagtaattgcctcatttctcaaactctccagagtcacatcatccaatcaaagtactgtgtaatgtgagccacatatgtaattgaaaaattttcaagtaatcacattttttaagtaaaaataatcaggtaaaattaattgtactaatacattttatttgaccccgatatatttaaaatgttatcatgtcaacatgtaatcaatgtaaaaatgattaatgtatgcatttcatattcacagcacatctcaattcagactaaccatatttcaagtgctcaaaaccacaagtggctagtggtggccatattggaccacacagctctagaacttctgtagcccatggtttagcagttaattatgtgtgcacttggcatgttcgctgcttgttctctagtgaagtcattctttctagcaggccaagttctgtttctaccacaggtcctagcatggtgctttgcacattgtgggcactcaacaaatccctaagatttgcttcatagatgatccctgtacattgatagcatcttcctcattcatggaataacaagaatgacctcatctcctctcactttcattccttagctactaacactgttgcaaagatctctggaaaccggaaactttggtcacctatactttaaatggagagagaagtaaaacttgctgctgagaagcaaggactgcatagaaggtttagtttgctggtagaatcaaaataagcactgaatgaagatgtgtgtggttcccagttttataaataggttttgcaagaggagagtgtttgcttctttgtttttggtgcgaaacatttcttcttttagcatgttatctgaaagtattgctgccaaagggatgatttgccagagaaagatggtttctgtccagttccttcatatgtcaggcataacctccaattaatctgaatgaaagagtgggtgcccatgcagacaatgccaacaaatgcccctgtagagaggacacatacagatgccaacctgaaatcagacactggctactgaaacaaaggattgctttaatttttgcagaataaactatttttttcttctgcttttcacgaagtggccctaaagaattcctcttgtttgtggtctcgaaaaaattagaactatgccaatgaggcctgcctttaagggttctattaaacaataagaaggctttgttcttggcaataaaattaaagcaagcagtgtttccattacctggcaggctgccctctcccttcccacaaccctgaccccgatcctgacaaacctcaacagaccattctgtttcccaggtaggaaggttagatggtaacatctgtcaggtttgtttatagaaatatagttgaccttaatgataatgtataaagagggagagatgggggcggaggggggaggaaaaaaagggggtagggagagagagggacacttctccaaataatccttaactcaagctttaaaaaagtcaagtttactgcagaggcttcaagttctcaaaccattgttccagaaagacaataataatttcacaatgagttgaaatgatggaagttaggagtcactagatgaggaaatatacattttggtctgacacgctagatgtcacgtgttttctttttcagggaactttgcctaccattgctcaaacttagacccacttacagtcagttgcaaatgagtgcttgtaggtagattgtgaccctgaagtcaggaatgaccaaggccagtacagaaagcactgtccgatgcaaattctgtttagccccacagttagtcacaagtcattggaactgaaaaattggatgactgtgatgccagctctctctgtcctccatgagagctcaaaatggttatattgtagtctcctctagtgtaagagctcctgcctacagctgtcaaggccatacccatattgcactcacaggtcctatctccctggcctgggaactttttctgcccctcccaggaccaactaattccaaagggaagttaatgcctaccttcccccaacagctttcaaccagctcctgatgggagatgttacataaatactctgcttcttccctattagctggaatgttctgtactgtttcccagagttgcccaatggggttaatctccagttgcccaaggtggtcttggtaagtcacactttactggcttcgtagttgtccctgtttcacttcctacccagtactggtgttttctggcaacaatttgaccatccattcttgtctcatatccttcttggggaggatacaactgccaaccatgtctaaaatgaaatgatagcacaagtctctttttctagtcatggctatagctcacatgttcaatttctctaaactcaagtctctttcattgtgtttgaataaacgtacatgtgaatcactggacatcaaagatatttaaaaatcaatctactcacttctcctgatattctagaatgacaacaacagggcaagatatttcatagatatcacttgtgggtgcgtcatgaaggcagaacaaagcttaacattttccagttgtacctcccagttaagttctatcagtgacgtaatcacgtgtatttcactcactgtacggaataccaaagagcagaaacccaatgttcattttccagaactttgcagaagcagatggcttctatacctgagtaactgaaacccaaaaaggggtccaactcagtatttttccagtacatcacttttcaggaatcatggcacaacaactaaaaggaatgtcacttaatgagaaataacatgtaagattgaaagtgattaaggtaaagtcatagagtagaggtttcctctttccattagaaataacttcccttcccttaaacacgtcacctccatctttcctggcactccattaatggtcatctgctaaaagttattgtttaccctctgaccacaacatcaaatgccaaacacatttgttgaaaattatttaatagaaatcgctacttttcagaaactttatgaaaaagacgtgatagagacaaacacccatggcaggttaagtagatttcttttcattcagtgtgcccagcccaaacggaagggtgtgaagcatttgttttataaagtgtgtaattaataagagaaaggaagggaggagtttattgtttttcaatgaattatgagcaaccccttccattctgcttcttcattttggaactgcttctaacaaagttaccattaaacacaaaaagaaaaggctgtgatattgatgccaagaatataagattgaagtcagttgagtgtagcctaggaaaaacattacagaaggagtaacatttattataattgtgacagaagtcagcaggacatcatggggaaagtgaaaaccataccgcaagtatgttgtcattttcaaattgaaattccattaattcagtacttgtagctattcatgccttaaaagaagaaaactaatatttattgagcatctactatgtaccagattgtttacagatattttcatcaaaagtatgcaaatgaggaaacattctcacagaaattcaaatatttttcatacctgcagtcctctgaatataaagtccatgatttttcctttatgccagaggtcagcaaactgtgacgctcatgctaaatctgactgtttttgtaagtaaagttttatttgaacacagccacgtccatttgcatccgtattgtctatggctgctttcacactacaatagcagagttgagaagctgcagcagagaccgtctggcccacaatgctaaaataattactatctaggcctttacaaaaaaaaaaagtcccccaactcctgctctgtaccacggaagaatgttctctacccttcttcttcccccatccaaaattgcatcaggaggcagccttcaaggaacccagttaggatttaaaagtagcttcaaaaattctggagttaagcctcatgttatagcttccaaagctattattttgatgatgtagatgcatcaaagttttgattcatgctagaaagtcctcaggtaaccagcacaggctgactggtcctagaacctctagttttaattatctatggacattccagataaaaagagtttgttagcaatagtgatcgttcacatttatgtagtaattattacatgccaagcatttgtcaagggcttttcatgttttcactcatttagttctcaccacagtctaacccaggggttctcaatcttgacactagtgggatttggggatggacctttcactgttgtgggggctgtctaatgtgttgtaggatgtttagcagcatcgcacctggtctgccaggtaacaaatgttattttcctcattatgcaggtagggaacttgagatgtagatagttgaagtaaatgcccaataacatacaactagtaagcaataaaaacctggtgtttcaatcccgggaagacttcctcaagtccctgaaccccaaaccactgcctccattagcccttgctccctctaaattattttacctgtttgaagattttgctttactgaaaaactaacagcgacatcaacaacatcgtgaatggccatgttctgtatgctactattggaagtaaaactcctttatgtgaagtttcaaagttttaggcattagcaatggcattttttgctaggcagttttattgccttattacagttgtatttcattcataagaaagaatttaattgctctactcaccacagtgtgttgccatttttgatagtgtcttgcttccttgtccagcactcaagcttcataatcttagaaacctcaagaaaagaggatttatcatgaggttcctcggagctatttttttagtcccatagcaaattcccatctggataatcaatatgtagaattgatctcctctggtccaaataattttccactacgtcactatgctaaagcaggattacatgtagcttctagttgtatcactatatcactgctattacttcccaccaaaagcactttatgaaaggattccatttttaatttttctgaaaagcctttcttggagtttaaaaagatttgatcaaaaatgttaaatattaaattaacacattaaacattaaaaatattgtcccgtactctggtttgtcctccaaagacagagacctcaggagccaggccattctctctctctctcattcacttgagccaggtccacaagtatttgactttggtgtgaaagagtttcagagtgaagattacatataaacatatcagatgaattacggtaatattgtctgctgttcctcaattctccttggctcagttttatatacagactgaagtattagaatccctttcattgttcctctggcagctctgtctaacttttgccccagagtctggaatgttcatcacagctgtctttggcaataaaacccaaagcaccctcatatcatcatatttctttttgcacctggtcagtggtacacagcggggtgtagagcccacttgcatacagttttctccctgtaccctcatccacaggccaaatatcagcttatataaagctctgttttgtttcagttacttcagccttgggcaaattggaattaactcctccaatgtttttcctttggagtgagatgggatggttatgccacattatgtagtaccactaaccccttcgaatttggatgcagactcaaaattacatattcttagttatagagaaaagtccttttgagtctaaacaataacaagaacatcaacctagcatcatgtataaaaatgtttcagcctttctcaagatcaccttaatttgtgaccttggaatggaaggtcacatttattcaccgtggcatgaaacagcttttgtttttgccatgaggccgaatctaggcaaacttgtaaagtagacatttgtcttttaaactcccaactccttggtaatggtttcaaagatggcaaggttcagaatcttaaactaaagggttcacagtttgatggtgcaatttcaagagtgcagtaatggtgggccggggtgagagaggcacaactcaaggggtctaccattcttgcggaattcaaagtgaatagtagcctccggatttgtgcagtgcagcaaccctcttctcaacacccagaaatagaatatcctgtctccaacacgttggggttatcctgtcccaagcttacttcagtgtttccgtctgtgtacgaataagaagtgatatatcaagtcagtgtgtcattttcacaagaggaattataaggctgtattctgaaagtctatggatggctaacttatttcaataaagcactgcaaagtgagaaaatgagagtttctaaaatgcatgctagatcaatttcacctgtgaaaactggccagatattttttttccttcactcatgctccatcctaagagttccaaatatttctaaagattttaagcccacacatgtctgaaatctaatgatgtttatactctgcactgaacatctcattttgcagttgaatacaagtcaaattaaaagagccaggttttagaaataatacttaaaaaccacttacagactgctaaagaacatttcacagacacctagtccaatttctagtatatgtatgtaactaaatccctttaatgtttatacatatatgacaaggaaaaaatatttgtcctctttaccccacccattcctcaaaacactgtaacactattacaccataaaacttagcagggagactttgggcgttgctaaccaagtgccctcgagaaaatagctaatccatttatgtcatcattaactaatctggggaatgattacgcgtaactgcatttctagaaagggaaggtaaaccgtgcacccagtagcaacttacatgggactgcaactgattattggtggcagatatgagcattaatgaagccgagtgaccctcaatgctgaattccatctcaggactaggcaggccagatatgattgttgtgcttctacattcacatcattattcaattttgtaatatctctttcatcagactgtaaaggatcagaaagtcattggcagagagaagcagcagtattaccctaggaataggagaaagtgggtcagcaactccctacaggcaagactgatggggagaagatgcatttcaagacgcgaaagaaaactgactctagatgtagagaaggtatgtgctgagcagatgggtgaggtcaaaaatgagatgaggtgaaagtgactgagtttctcatactggtgggctaatgtgatatttgctcatgagtgtacttgaggtgagaaaaaaccatagtattgaggagcctagcctgagatctcggctcactgtaacctccgactcctgggttcaagcgattctcctgcctctgcctcccgattagctgggattataggcatgcgccaccacacccagctaatttctgtatttttagtagagacagggtttcatcatgttggccaggatggtttcaatctcctgacctcgtgacccgcctgcctcggcctcccaaagtgctgggattacaggcgtgagccaccgcgcccggccaggaaggcctaattttaagctgtatttcatcctgagaagtcaagtgccccatttccagtgtggtccaaaggcaggagacagtaattacccaccactggacatcattcctaattatcttcatctcactcttgccgttagtttaggggccaaggaggagactgatggcacaaaagtggaaagaagagtttgaacttgttttctgcatccttagattggccctcctcagagcacttccatcagccacaatgatttctgaatcaaaagatgtgaatcagaaatgaaagcaaaaatcataaccaggagctgctagcttccaaaccaaacctgggaactagaaacaccagaacataactgcaagtaaccaataaaccctgccatatttgaactaatagaaattaatgagaaagtccaatcaaatcgttaattctttgtttaagtgacacatgaaacagcaaaactgtggaaaacttctttgtagtagaaaaaattctgaaatatagaatagtatttaacttgttttattgtatcttttggaatataagaatactagagttacaagaatttggaaattcatcaaagtagaaaacaagattcaacttccctggtttcaaaaggaaagctaaatctgtattctctgaaagatctaggaaaaatacttggcctaaaatgaatagatcctgttcccaaatttctaggaatttacatattggggtgatggtgattgtgataccagttttctcaaaacacatttgcctcaacaaggaagatttcagcccacttttttggtaaagcaaacatatccattctgtaaatcaaatagtcaaaatttggattaaattgagccccatattacaatggcaactgggatactttttctaccatgcagtaactcaactcccaatgattgtgagagtgaatggaccctaaactaaatcataatctgtttacaaaatcccttctcaatgcagacaacagtacctcagatttgtcaatggcttcataagtttaggtgtttcttcatatattatttcatgtattcaccacaataattccacacggctaagagagcagatattattcagctcattttacaaaataggaaaactcataaatggagatagcctaagattttcctaatgtcaccatgtgggtatattacacaccacatttcatttcacagcccgtactctagaattagcagtgggttctcactggacttagtcaaagccagaagagcttgaagtgtggaatatgttagtgacaacattaaaacttgaggacctcacaatgtggtcaattgatttttgacaaaggttctcagacacttcagtgaaagaaagaatagtctttcaaaaaattgtgctgagacaactggctatccatataaagttagaagcctaccctcacaccatacacaaaactgacctcaaaatggctcatagacctaaatataaaatataaaacttatagaggaaaacagaacagtaagtctccatgaccttgggataggcaatggtttcttaggtacgacaacaaaagcacaagtaacaatagaaaagtagataaattaacttcattaaaatttaaaaatgttttgtgctttaaagggtatcataaagaaaatgcaaagataacccacaaaacaggaggcaatatttgcaaatcacatatttgataagggacttgtattctgaatatgtaaagaaataatacattctattaattaaaagacaatgacccaattacaaaaggagcaaaagatccgaatagtcatatctccaacatagatacacagatgtccagtaagttcacgaaaaagatggtcaacatcattagccatcaggaaaatgtaagtcaaaaccacaatgaaataccacttcacacccactaaaaataaaataaaattaaaaagacatacgataacaagcattaacaaggatgtggagaaattggaaccctcatgtatttctgatgggaatataaaataatgcagccactttgaacaatagcttggcagttccttaaaacattaaacacagttatgtgacccagcaattccacccctatatcaaagaaaaatgaatatatatgggcacacaaaaacttgtacatgaatgttcatatcaatattatttatagtgaacaaaaactagaaacatcagtgtgcatctattaaagaagagataaaaagtggcctgttcatacaatgaaatattatttggcatagaaaggaatgaagtactgataaatgctaccacacagatgaaccttgaaaacattatgctaagtgaaagaagccaaacaaaagattatgtattatttgattccatttatatgaaacgtccagaacaggcaaatccataaagagacagaaagtagactagtggttgcctcgggctggagctagggcaggtagggaaaatgtggagtgactgcacacattatgggtttcttttctgggcactgaaaatgttctaggcttagattgtgatgacgattgcacatgaaatcatctgtgaatacacgaaaacccacaaaactgcacattttaaatggacaaattttatgatatgtgaaatatattccaataaggcagttttaaaaaatcaattcctggccaggtgcagtggcacactcttgtaatcccagcagttttaagaggccaaggtaggaggaccacttgagcccgggagtttgagactagcctgggcaacatagcaagacctcgtctctacaaaaaaatacattttaaaaaaatttagccgggagtcatggcatatgcctgtagtcccagctactcaggagactgaagggggaggattgcttgagcctgagaggtcgaggatgcagtgagccgttatggcaccagtgcactccagcctgagtgatagagcaagagcaagaccctgtctcaaaaaaaatcaactcccttcctccctccccctcaaataaaacaatccttaggtcataattttgtgtctacacagtccttggaaaccaatccattacctgcatgttgagtgattactagtgataactacttgctccattacatttttgccctgtctcttcttggaaggtcattttccctatttatttattcaacaaatattttttgaatgcctattttgtgccagacatggcaccaggtgcttggaatagataccttatttaatacaacagctgaagatccctgcccatatggagcttacattctatcagatttaactcgtattctcaagtacaacttagctcttcgggtttattctagtagatacttttcaagtgtggggtctgtcaaagaaaaactagagctggacagtagttaaagctgtaaaaacattttattcaggactattgtaataaggggaaagagacctcagtatagaatgggactcaactcccaatgtcacgtggaccagtggggatttacagccaaggagcagggtgatgataagtggatggaaaattactaagaggaaacatcaggggtaagggagattctggttaaactgacctaaaaggattcttgctgaaggtaggccaagttgatcagacatcctctggggcatggtgaaggatgaagaacccaatcagatactgagagtgatcagatatggagatggaggattctggctaaaccaactcagcagggttcttgctaaaactggtttacaagaaagtgcgcagaagggcccaggagaaagttcaacactaaagtttggtcgagcaaagaagcttcgtcagtgctactttctagaaattttacttcctccatcataatgtgctcatgttatcaatatggtcccatccttttcataactcagttgtagtcagttattaaattcagtttgaggtcaaaaggaaacagaagaaatttactgagtgtaagtttcaagtaaatatgtcaatagctaaatttatttgagaaacctcaaggggagctagaaatgatgacataaaaataacaataagagaaatgaagcctaatgattatcctccttgaaatattagcctgagttccacatttgtacttctcagtcaatgcatttttaatttttctctttgttcattaaacaaatacttagcaaataactctgtctgctaaactgatgtaggacataatctcatggtttactgcaaatggccaatgactatcatcttctcaataagatgtcttgagtagtctctatgttatgtctgaacaatgatcaggaataaaattcaaggaatcctgggcctctggaaacaggacatggtttctgtgaacagccatcagtggatttttatcttgaactcatgaccctacttccagtttatctcattcatagagaatgaaattactccaattaaagccttccaaatcaaaaaggctagggactgggccatgtctcctccctgagatatgctagaataatcaatgccattgtcattctttgtaacattgcaacttctcctgtggctgtgttaaaataataaacctcatgcctgctatctccatctctcacagctgtggtttctgggtttctgtttgtgaataagcatttcagaattgccatgagatggaggaaatagcatgtgcagagtatttcccaggcctagttgccaagaatgagctaattgtaagcctcccttgaatgcaagtcacaaaaacttcaaatacaagccactctaatgatccacctttccacatgaatgttatgctttcgttgtagaaccttgatctttcagaagtatactaggagtataattttaaattatgtcataagattaataaactattgaaccatctttttgtgctttttatgttttatagtgattagatacaaaattgatgtttgtatttaagagaaatgtcaaatgtgatacaggcttgctacattgcttacggaaaatttgtctaaaagagattgatagtaatctgtcctccataaaagaataatattgattttttttaacttactttttttatgtttaacagggcaaatttgatactttttaaaaatataaaagtaggaattgcaaatatatttcacatgacacatcattttccaactaattggtaatggctatgtacatgttatgttaaagattctgcagctgagtctggcttagtagaaaagactgctgtcattggataataatgttttccaaggatgcaaattaggaagtggccatgtaagtcctatatttgcaatccttgcgtaatcggacaaagagttaacatttaaaatatcttttcagagattactagaaacatcctagtatacattaaaaatagcacttaactgaaaaacaaaggccaaattaacacttaccattgtacttatcctgtaggtcaatgcatcacgtcaagaagccaaattgacagaggagtgtgatcttctcattgagatcattcagcaaagacgacagattattggaaccaagatcaaagaagggaaggtatgatttctagggcagaagatttcatattctctacctggagaaaataaatcctaatacactccagggactttggaaatgttgagaaccctctttttctatacattctataattccctcttaagtctttaagacttagttaaaaggcctttgcttggcagttttttctccatccttttctttgtactatggtctcctgtgaagacctgtgatacaagggctgctccattgcccagcgccaggaggtagcataaaggtcttgtctatcatggccattgttttctatctcacttgtctatgagaaggtgggttctgtggaggcagagtttattttgtattcattgtgatatcctagaaactagcatagcattacataaattaaaaatgaatctgactttatttatagaaattatgaagtactttcccatgtttttgaggaaatgtatacaggtataacttcatggtcccaaaacccctggggtttcactatatcatatactcctttgtggatatagtaataatacttcttttctaatgttctaatgtttctatgttttaatttcctattgttttacagcaaactatatttttaagataaattgacatacattctttatagctgctttcttatttattcaaaattcattcacaaactgttggtcactttataatccatcagtttattctattttaaaattagtcatgtttttattgaaatacttatgatccttttaattttacccaattctctgccacattcagggataatttttctttcttttttcttcttctttttttttttttttttttttgagacagtctttatctgtcacccaggctggagtgcagtggcacgatcatggctcactgcaactgccgcctcccgggctcagacaatcctcctgccttagcctcctgagtagctgggactacaggcatgggccaccacacctggctaatttttatattttttgtagagacagggtttcaccatgttgtctaggctggtctcgaagtcctgggctcaagcaagtcacctgcctctgcctctgcctcctaaaatgctgggatgacaggcacgagctactatgcctggccaaggataatttttctatggatttttaaaaatagaagcgtttatttatgatccaataaattcatccatttctattattattgttcatagttgtactttaaaacaaaatatatataattaaaacatactagcaagttttaagtgaaacacagagataaccgtggctaatgtatgtggttttctgtgttttccacaaaatttaacaggtaccttctaatattgtacaatgttttagattactctgtctatatagattacaaaatatttatacacataaattattaaaatgatctaaaaaatagtgaaatcaaatagttattgatgctggtatagtagattaacagattaacatgaaattattccctggccaaggactcacatgtgccgaaaagctacttttccccacatacgaattgtccaatttagaagagcactgagtgtccatctggaatccttacaggatatatttcatcttccatcatcatcgtgcatcataggtgcacatctcttaattctggaagtattccaggttctcagacacatggccacctgaagtacagtcacaattaattattcatatgcatacagaaggtaatttgctatctttacatggttgcatgcagagattagctctcagtacacatattagtttattttcatttttaattttaaattgacaaacatttatatttatggagtgcaaagtgatgttataatttatggatgaaatatggaataactaaatcaagctaattaacatatccatcatctcaaagccttttcttgtggtgagaacatttgaaatttacttgcttagtgattttgaactgtataatacgttattatttatttgctgttttcaccatgccatgcaatagatctcaaagtaaaaaataaataaataaataatttttttgaaaaagcacttcctcttcctctctaattgaggttttgcaccttactcttactagtttcttattgctgcaataacaaattaccttaaacttggtggcttgagacaacatagatttattatctcagtgtgctgaaattcggaaatccaaaaatcgatctcactgggttaaacaaaatcgacagtcaaggttttggcagtgctgtttctttctggaagctttaggggaaaatccattttttcttgccttttctagctcttacaggtagcctgcattctttggctcatggtctctttgcatcaatctgacctctcttcccatcctcacgtcttctctgacacaggccttcctgcctttctcttataacgacccttgtgactacattgggattacctggataattcagggtaacatccccatctcgtgatccttaatcatgtctgtaaagtcccttttgccatgtgagtaacatattcaaagattcctgagattaggatgtgggcagcattgagagcccttattcagcctgcaagggcactccaccacaacttcctggctagcttgccttcccttctcttacttagcttggacttcccaccaccagggtttctctcatgagctagatcagagtagtgcaggtgtccccaagttccagccatagtgatgcatggagtttatgcttcggtgcactcgttctaccccaaatacatgtcagtaataaagaacttaataaaatgcaaaagcaaagacatatagctgaaccaaaaacaagataaacatctccacaggccagaaatgagacaaaactgaaaagccatgactgtggctgaggatacaggctactgggatttggtctggaagaggccaaagtagctttggctttagctcctgtggataaatagttcttgaagctttggggaaaggacctagaagtgctccagatgggatggggaatggaaatcaggctcattatttaatgccatgggctatagaaggcttcatgcttcagtcaaaaattattgccaacctttccctcatatcatagcttttagcaaagtcacattgttagcttgaagcctgtgttcacactgtttctgatacccacacagaacaggagcacagagataaggatgggattcctgaataatgacctcaagggccaggtgaaggcaactggaaaactatcagagcagggtaggctgagcaaggagggtgagagaggaaagaattataaattacttccctttaaaactgaaactctaagtttaatttcaaagtatataaagaaatcttaaatttctaaacatacagccagcaaaatcagcagacaacattatcttaccccagataaaattaattttataggaaaataagaaaaagactttaaaagaagtagtcttaagatgttcaaagaaagaaatgaaggaataacttctctttcaaaagagcaaaaaaagtgaagccacaaaagaaggaaatgaaataaaaaaatagataggaaagcaacaaattagcagttttggagggaaaaatatagatattgaaattagaaagaaaactcagctgcagtggaaatttggaaactgagttttggtcaccaccttgggaatgccataaaacgcattcttttacgtctgagtgacattaaagtttgacaaatgccgactgagtttgaactcaaaagataggaaagtatataggaaaacctacacatggggcatttttaaaataataatcatgcacttggttgaaagcaagtatttcagcaaatttcaaaaactgaataccatagaaccctgcctctaagaccacacactgtatctcattagatattatcaacaataaaataatagtttctatagttttttgacactaaaatctattcatatataaatatatcttcacagtaatattttttaaatgtagaagtaaaccacagtaaaagaactataatatatcataagtagtaagcagcaaaaaagtatctgaaggcaaacttacaggctttaattcttttgaaaaagaggctgggcatggtagctcacacctgtagtcccaacgctttgggaggccgaggcaggaggattgcttgagtccaggagttcaagaccagcctgggcaacacggcaagaccctgtccccccacccccaaaaaaggtaatactaaaagtaaaaaattagctttcaaataaagctagaaaaagcacaacaggataaacccagtgaaagcagaggaaagaaataaaggaagaaaagtaaatgaaagaaaaacaggaaacaaacaagaacagctgtcagcaaagaacaactcgcagcctaattttgaaacatctgtgaataaaaaaagtgccttttcccccatttttaaaaggttgttaaaaaaaataaagaaaaacaatatatgtgtgacagagacagtatgtggtcttcaaagcctaaaatattgactatctggtcctctacaggaaaagtttgccagcccttaatcaggaggagttttacttgtaaaaaataatttaaaagaccaatctgtagttaaggttgatgaaggaaaaaagagtgtggggccccataaacaaatataccataaatacagtagagacttttttaaacataagaaaattgtgtaaatgtcttcatgccaataatttgaaaacttacataaagaagtagcggaaaacctgaataaaccaaaaatttaaaagcagaagacatttaataagtcattgaaaatgtccatcaacttgcatttctgccccaaaatggcaccagcctcccacagttctatagcttactttaacagaagttccaggaactaataatctcattctcatataaactacttcagaaaatagaaaaaagacattttatgtagagtgtatgatcttgataccaaatacatacaacattaaaaaatctagagtgagagaatatcacccatgaatatagacacaaaaattttttttaatatgagaaaatgtaatccatcagtgttttattaaacacatcaaaatagcctttattcttataatacaaggatggctcaactacagaatatctgttaacagaaccacattaacagaaaacatacatatgatcccagagtaggagggatttttctttttagaccaaacaattttaaaaaaacaaccataaagcaaagactgaaacatctgacatagaataagatcacaatacaaaagccaatttcatttcaatatattagtaacaattgaaaattgaaatttaaaaaaagaaattccatttaaaacagcctcacaaatatgaaatacttagtgataaatctaacaaaagatgggtgagacttgaaagaccttgaaaactacaaaatattgctgagagaaattaaagacgactaaaaaatgaagccatgtatcatgttatggggtaaagactcagaaaagttatgatttctgttctttccacatcaacctgtagattcaacataatctcaatgaaaattccagcaggttattttgcagaaattgacaagccgattctaaagttcatattagaatgcaaaggatatagcataatcatttaaaactttgaaaaatagaccgggtgcggtggctcacacctataatcccagcactttgggaagccgaggcgggcggatcacgaggtcaggagatcgagaccatcctggctaacacggtgaaaccccgtctctactaaaaatacaaaaaataagccagacatggtggcaggagcctgtagtcccagctactcaggaggctgaggcaggagaatggcgtgaatccgggaggcggagtttgcagtgagccgagattgcgccactgcactccggcccgggcgacagagagagactctgtctcaaaaaaaaaaaaaaaaactttgaaaataataacaaagttggagaactaacatcagctgatttcaagatttattataaggcttcagaaatcaatataaggtggtatttgtataaagatagacaaatagatcaaaggatcagcaaaaagacttgagaagtagattcatacatatatggacaagtgattttcaacaaagatgcaaaggcaatttcagtggagaaaggattgtctttttagtaactggtgctggagcaattggatatctgtatgtaagaatatgaagtttgatccatacttcacattatatacaagactttactcaaaattgattatatatctaaatgtaaaaggtaaaagctgtaaaactcctagaagaaaacgtggaggagatcttgaccttgggttaggcaaagattctttacatacagatgacaaaagcattatccataaaagaaaatatttatatgttgggtttcatcaaaattaaaaacctcttcagaatgcactgttaagagactgaaaagaccaaccacaaactaggcgaaaatatttacaaattatttattttaataaaggattgtatccagaatatataacaaattctcaaaactcattaataagaaaacaagcctttcaccaaaatgcataaaagatttgaaaactttaccaaagaagaggtgtggatgatgtattacttagggttctctagagcgacagaactaataggatatatatatatagagagagaggagtttattaagtattaacttacacaatcacaaagtcccacaataggccgtctgcaagctagcagggagagccagtccgactctcaaaactgaagaacttggagtccgatgttcgagggcaggaagcatccagcatgggagaaagatgtagacggggaggctaagccagtcttgccttttcatgtttttctgcctgcttatattcgctggcagctgattagatggtgcccacccaattaagggtgggtctgccttccccagcccactgactcaagtgttaatgtcctttggcaacaccctcacagacacacccaggatcaatacttgcatccttcaatccaatcaagttggcactcagtattaaccatcacagatggtaaataagcacgtgaaaagatggttcagtatcattagtcattaatgaaatgcaaaataaatttcaatgagatactgcttcctacctactagaataattaaaattcaaaagatggcgcataccaagtgttggcaaaaatgtgaaggaaccagagcctctcacaaactgctggaggtgggaattaaagtagtacatgctggaaagctggcagtttcttaagtaagcatacacttaccatatgatccagccatttaggtatttaccaagagaaaggaaagctatgtccatacaaaacttgtaggtgagactggtcacggtggctcacacctgtaatcccagcactttgggaggccgaggcaggtggattgctttgagctcaggagtttgagaccagcctaggcaacatggtgaaaccctgtctctacaaaaaacacaaaaattagccaggtgttggtggctcactcctgtaatcccagctacacaggaggctgaggctggagaatcgcttgagcccaagaagcagaggttgcagtgagctgaaatgatgccactacactccagcccgggtgatagagtgagaccctatccaaaaaaaaaaaaaaaaaagacttgtaggtgaaatttcatgttaattttacttgtaatagccccaaactagaaatggcccaaagtccatcaacagatgaatgggtaaacaatttgtgtcataatcacacaatgaaatactctttggcaataaaaaggaataaactagttacactagttataatgcaacaacatggatggatctcagtataattaaggtgcgtgaaaggagtcagacagaaagtagtatattctgtatgagtagattcatatgaaattcgagaaacggcactttctactaatctacagtgacaaaaagcaaatcaatgattgcttttagggatgggatgacaggaaaggatgggcacagttaattacaaaggggcaggagtaaattgtggggcatgatatatatgtttattatcttgactgtggtgactgtttcatgggtgcatacatatttgaaaaagtgtcaaatttgcactttaagtatgtactgtttatgatatgtaaattctatctcaattcagctgtttattagacatataaattgtgtattatataatgaaaaagtcttcagaaattaaaattaatgaactagggtgatatgtattagcacggacaaatcacaaaaacagaagaaagttatataattatttgtacaagcattatataaaatttaataaactaccaaaaaatcccatacattgtttaggtatgtgtacataaacatgtttgggagtgatcagctctaaatttgagagggtcttttcttctggagagagacatgagtgagattataaagtgccacacagaggctttaatgctatcaataatattttaccaccaggtgtggtggctcatgcctataatcccagcactttgggaggccaaggcgagaggatcacttgagcccaggagtttgagaccagcctgggcaacatagtggttccccatcactacaaaaaataaaaataaaaataaaaattagccgggtgtagtggcatgtgcctgtgatctcagctagtcaggtggctgaggcaggaggattgcttgagcctggaaggtcaaagctgcagtgatccgtaatcatgctactacactccagcctgggtgacagagcaagaccctgtctcaaaaaaaaatcttttttacttccttttgaaaactctgaagctcatatgatgaaaatactgagatttagtaaacctggtactatgtacaggacagttcattatattcttaaattttttgtatgtatggaatgcttcactttttaaaaagtatacatttgctcagcaacattatctcagaaggcaatcttagaaagcagatgttacttgggaaagatgagggccgcactccttttctcttgagctagtactttggcacatgaccaaggactagttcattccaaaccctgaaactcacagtgactcaagtccctagccagggcatattgtgtcagaggcctgtttttaagaggaagggtgtgaatgccaacccgtggaaatctgaggtgccagacagggagggcaagtgtggacttggggttcactgggggacttgggtccctgcaccccaggatggcagtggcaactgagggcattgagtctaaagaacggatggtggggccttctgacaagcaattggaagtgggcaggtggagcaagaaccaggcagaattgtggagatcacaaaagtgagtttcatcaactgccttattttgcccctgtctatctctgacactagtcactcagctgtcaaactcacctcaaattctgcaattgacgaggtcaccaagcaggtgatattattacacgttagtacctactgatgattcctgctcttggaccattgtacattctctgaaacaaattaactcgacagcctttataggtgggcggactggagagtcttaagccatgaggctccctggaaaagaattttcttctttttttcagtagtcggggataagtttcatgtcaacacacaaagagctaaattcagattgagttcattcatttaatgttcagacacagagatctatggtagacttctgaaggccaaagctcaacaaaataagggtcccttttcttcactgccttttatgtacactaaatcttaaaagtttaagaaaattaacttggactaaatgttgagctctccatggccttaaagagatggtgagaacaggcctcattttcagttcagatacttgtgtgaattgaggatgcattgtttggacctaattgttttgggttgtgtatcctacatacatataaaaagatttatataaaaataagtgtttaaaacgcatttcaagcaaaataaagcggcttttaaaagaatgtgtaaggtataataaacagcaaataaaatgatataaacagccctgtgtccctgctaaaaggagattccagcaggcaaactatttccatgactagtagagagtaaattccaaaagttgcaatgtggtaatctcacttcccaaaggaaaaatgaagagttgactggaaaatatttcccttgcagcattaaggcagacacatacagaatctttttatgtgtcagtatctaatttttttaaacatcaaattttattcaccttgtcaacttttaaaaataatacattaaaaagtgttgtctaatagaaaactaagtacttcgctccatgctgggtgtctgagtttgaagtgctgtgacaagtaggacagtgtttcagagtgtgctgcaaatcagggccatctgactgtaatcatttaagccaggggttagccgacttttctgtcaagggccagataacaaatattttaggctttgccatacggtctctgttgcagcaactcacttctgcacaacattgtagcaagaaagcagccatagattatgtgtaaccaatgagtgtggtagtatgccaataaagctttatttacacaaacaggctgtatgctgatttggcccacagatcacagcctaggaacacctaacttagagcagtgtttttcttttttctttttttttttactgtaacccgcagtaagaaatatatatgacatcacaatacagcgtgcacgcatgcacacacacaaaaggttttacaaaacccaacttgccttttctaccaggaatgcactctgctatttgcttttctcctcttctatttggttttttaaaggctagtcctgactgtcctaatgattcatcacctgcaggcttaaaaacatttgttgcttgttgaaatggaaattcctcctgctctgcgaattacaactccttaactcaaatattggagcgtagacccaaacatctactgtttttctttcaaaatgatgcccagctgattcttttacactaggtttgcaaagctcaaatcagatgtatcagatgaaattgtacactaacctataactaaaattatgcccaaaattgttctctgtagaacattccgatattttcacaggcgactctcattttgtcttgctttaatttttgcatgatttagggctcttttattctttttcctgttatgtcacttttaatgttcaatatcatgatagaaaaagaaaagaagaaactggagttcaagcatcatcgcatttgaaatgtgtgtggtctttaataggcatatctaaaggataagtagttgtcatgaagttattctaaaggaatattttgaccttattttcttttgctggaattgtattaaacatctgcaattcggccatgtaatttaaatgattctttatgctgtgtgattaaatattccattcacttggtttgtcctgtggactgtaaattagttttccttctggaattttccttcctctgacagtttcttatgaacatgttctaatatcctgcgcgtactggatgccttccttagctttgcctccagatagaatgatgccagaggctaaattctatttggtgtaaaataagtgttattttattccactaatgaatacaattaatccactggggacagtaactataattataatgcattaagtcttttaccaggctcacgatcctatattatttgccctaaagttttgacacttcattctctgactctttcaggaatttttttcacccttgcctgaaatcttgtgcctgctgcttctaattcagtatgaatttcctttgtttgcttatagtacatacttggaattggatgttccttagaggcctcaagttctgacatctctttccttccttttcttagattagagttatacagggatggtaatgacgacttggagaaagaaagaatttcttggaattagcaggaattctggagagagccttgggccagccttgtctgtaagacagattgactggtctcctccgtaccctttcacccagggctattttccattccagaattatcataaagccggttgaaacctgtccctgggtgtgtggttgggggcagtaggcacacagcaattccaattagctgtctaattttaacttggcttctggctagaggacttcatctcacagcacatttcaaacacaagagcgaacggtcaagtgggttaccttggacttatcttggcctgccccggaggttatggtcaattatgtttgagggacattttcaagcgagacagaatcaggaattggaatggaggttgtgaagcaatcatgcgtttttatcccaactgggaaatgcttatcaaaatagttcctagttatcaagtaagcacaaagtgcctggaaatgacgttcccagtgaggggaaatggcccagctgtgctttttttggctttctctcatctgctcaacaggaaaaatattaatcaatgggaaaaatgctccctttctgttaatttaacacatgagttttaggtagtgtgggaaatagtaacacttaatgctttccattctcgattttattacatgaattacaaaaaacactttttagaaaatggttttcatttaaaccatagattcaccacctataaagatgttttatcttcttgatgaaaagaagataaacctgagatagagaaagttccagggttccctacagtcttgcagtcattgtgtggaatagtccagggaagacgtctggtgaccctttgtaagttgccactgggcaacacctttttttcccatcaacagggaagcaattcacaattcagtgtttcctcgtaaaacgaattagcaatgcttctccaatgagataaggaatatctaaaccagagtcccataacggagctttccatattttgatatatctctatgcctactttttgaacttttatggaaggataacacaacaaaatgaaggatccagcctgatgccttttcattaagcaagaccacccatgtaaccatctctctccatgcctcttttgttcaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagaggtgagtgcaggggcccctgggaatttctcggctgctgggctcttgtatctgcgctgtgattggttggtcttgccctcgccttgcttttattttcattttcaaggctcagtaccagagagaatagaggctttgagctgttttgttccagctaaagatgcttccttttgacatgtgaaagccctttcagtaacagcctggagtctggagttcaaggcctttgaaacaagagtccaccagttagaaagaataaaatcaacctgcttttggacgaggggggagcttatgatggcacaaaaacagcatttattgtgactctcagatgtgatgttatcgtacacttgataacaaagagtcaaaatgaaggcaaaaacattaaagggaatattttcttccatcacagggctcatctatttttttttaaaatcacacaggtgttgttctctgttaggcccattttcatttggttgaggagcttggcctcacctgaaaaggtcaaggccaactcacgcaggagagaaaggaccaaactgtcaacctcatacgggcttcttttaaaatactctttattctcaggtagggagctttaatgtgatgttatctgaatggttggctcagcagtaaaactggcaaagataagtattttttcggcacacatacttggttggtataaaaattgctcatcttcactgacacaaacacctatagcaattctagtggatccaaagaaaagcactagccgggcacggtggctcacgcctgtaatcccagcactttgggaggccaaggcgggtggatcacctgaggtcaggagttcgagaccagcctgactaacatggtgaaacctggtccctgctaaaaaaaaaaatacaaaaattagctaggcgtggtggcaggcgcctgtaatcccagctacttgggaggctgaggcaggagaattgcttgaacctgggaggcggaggttgcagtgagccgagatcgtgccactgcacttcagcctgggcaacagagcgagactctttctccaaaaaaaataaataaatgaaaaaacaaagagaagcactaggctgggccaggtacagccaatgccacataaatgacatctctaactcaggctaatggccttgacttcattcattctaattttcagagtcaactgccctttatccaaagcaataatagaatcctatctctagaagaccccagagagctcatgcatgctgatcttcatcctagagcagagatcagcagactttttctataaaggatcatcaagtaaatatttttccgctttgcaggttgtaaggtcttggtcacagctactcaactctgccattgtagctagctctaaagcggccatagataatatagaaacaaatgggtgtggctgtgtgccaataaaaccattacaaaaacaggcagtagaccatactttgccaacccctggcctaggaaaaaaaatactcgccatcttatgactcaaatttattcaaagaaagagaaaggaaactaacatttattgagtgcttgcttgtttcggaaacttgtgctaattctcaaaatatcgcatagaggaggagtgattgacatctccattttcactcttcttaaagagtaatgtatcgtgtttttacaactctggtctactgtccaatcggcttgactgtattatttcttatatttgaggaaaattccttttgtagctgattagatacttatctcttctaaaaggcatggataacagctggctatcatccctgttatgtacttaagatgctctcctccttactctgagaggcccatttctttcctcctgattccttggttccaaatgtttattttccctgggccatatccagttgctcaatattcaccctaaagttaaaaactgcaaatagcactaatactccagtgtacctaggacactaatagatagcgtttacacttaggtcacggtttccaaccggaatccaggagtacttttctccatctatgaactttgagatgtccagatgaaatggctattatgaactgcattcctcatcaatccctgaagattcaaccaagtgtcacatgaataaattcttacctagtgaccagggatgatgtgaccccataacagttattgctgaaagaagatatgcatctgaagtatagcacaggtgtgggaatgcccacatacaatctccctcagttccagtgggacgtatctgctcccattcagctctctctataacaagcccaactcatcaagagcaggaacatgactttgatttctctttctacaaagaatgtgcttctgtcaagtttgaattcacagagcctgtaaaaatttgccaagagccttgtctctgtttctgcagtcccctctcctcccatcactatttgtcaatcctcttggctaattcctgagcctttctatccttccagcagctaggatatagaaaaaggacactgggcttagactagaagttggcagacctgggttccagtcctagcactgccactttttaactatgggtctttgagctattttctacttagaaaattgggttcaggaacagtttggaggttcctcaaaaatccaaaaattaagctatcatataatccagcaatcctactgctaggtacatacccaaaagaaacgaaatcagtatatagaagagatatcctcactcctgtgtttgctgcagcacttttacaatagctaagatttggaagcaacctaagtgtccatcaacagatgaatgaataaagaaaatgtggtacatatatacaatggagtactagtcaaccataaaaaaggatgagatctagttatttgcaacaacatggatggaactgcagatcattaagtgaactaagccaggcacagaaagacaaacattgcatgctgtcacttatttgtggaatctaaaaatcaaaacgattgaactcacggacatagagagtagaaggatggttaccagaggctgggaagtatagtagggagttgtgggagtgggggtgggtagggatggttaatgggaaaaaagaaagaatgaataagacctactatttggtagcacaatagggtgactatagtcaataataacttaatcgtatgtttaaaaaaaaacttaaaaatgtaactggattgtttgtaacccaaaggataaatgcttgaggggattgataacttattctctgtgatgtgcttatttcacattgcatgcctgtatcaaaatatctcatgtactccataaatataaacacctactatatacccacaaaagaattgtttttactaataaaaaaattatttaaaaaaattggtttcagaatagctgtcactgttgtgatgacattgctttaagttcctaagaacaggtcattagcattatagctactccatgagtgttagttggatctctgttttcacgtttcaacatgtcagtctagcccgccttgtgtgtcttttttccaatgctactctctgtctacctgcccctattcatcaacctgtcacttaacattcttctctaggacatgacttcttttttctgtctcctattgtgcctgccttgggctttggctcctgtatacttccaaacaatctttattcttcaattcaggtgtggagcccagaacaaacttttaatcccgcaggcattcttgaagtgagacttagatgagattttctgcatcgttaagcgacttaaagtggatatgtcctcctacaagctgaatcaaaactgtaaatttttctttcatttcagaaacatcaaacaactccaaaaggggagagagcctcaagctttacattgtaggagatgcttttgctttggaaccggttgtttggctctgtgctaattgcttagtaattatagatagcattgaggctgctcattaacattggctaattttgctcatatactccaagtaggcaggtaccctagccaccttgtttttaccattatagccccagcacattgcgagctgcctgacatgagtgaatgagtgaatgaatgaatggatccataaatctgtaagacgggactaattattcctacctaagatggttattgtggggataaaatgcaataatgtagtaaaaacattagcctagtttctgtcacaagatgaacatgcaacaaatactagttctcttccttcccactcactagatgaatgcaaatgtataatgtactatattctcaagctacactagtagataggtctttggtgtgattgtatatgcacctttatagcattattttaaataagcaaagctattcactaagtccaggcataagaaagttggtctgcttatgaagaatctagaattaaaatcccttatagcagtaacttatctgtatcaagaaggtgataaaaagaaacttccctctgaatagtacctattgttcaaagcacctaggaggttctcagactcctcaaggtgatccttctgttcctcactacaataggcagttcaaggatcttttccagaatacaaagccaagaactccagttgtcaattctgaaaagatgttgcttggttcaaagaattagagcatatctgatcagtggttttggaagtgtgtctgcagggtgttcataggcattaagataactgcacgttttcaaggccaaatgtgtttgggaattcctgggctgaccaaagtaaacctatcttgttactgtgaggcctcactgggttttactttggtgatgcacattgtttggcagaagccttgtgagcagcatagctccagacacgtccaccttctggaaaactggccccatgtgtcccagacatggctgtaaagcaagaagttgagaaagtggcatagcgctaacagccctagtggatttggcaacttatccaaaaggccagaagatgggcaataaggatttgggaaataaaaacatggcctaaaatgttgaatttggcagatttccccttgcctgtcactccaattaggaatttgaagttgtagccaaagataagtatctttccttccatcaaaaaacaaatgtgtaggtgttaaaagctgcagtaatctccactgattcttgctgtcagcctttacctcccaggctaggaactttgatccttttggttcccatgtaacaaagttcctaccatcaagatggtagacattattaacagtgtcactcaatttaaaatgttttatttaattgtttgtagaccatggaaccaggagaaacttgggaacaaaatctattttggatgagactgaataaagaggtttctgccagtgggcagggaaactgctaaagccagggaaatgcaattgcaagtttggtgcttgtttcccagtagctcagaacagttctccctgccagacattatgatggagaattaattggcgtttcactttgcgatatcttttaagggttcaaatggcaccttagcatttcttttaacttttctgcatcgaatgcatatattctgggctctttggtgtgtagcatagtttaagggcttcataaatatttgttgagaataatcctaggacctctatgaagtttaaggactttttgtgttcatgggtcataaggaaagcatttttaaagtataacttgaccatcaatcaaaaatgcctagcaaccatctccgtatccatcagtctaaattagcagctgttggtaacaataattagcccaattccccagggtgcaatatttagtcaacaaaagcactcaactctgctattcactacttcttggtgaaagggtcaggagatgcagttagattctctaccctcattcagacacttgaaactcgtttccagagcttagacctcttcacttgcatctctcaatcccagtatcattacatttatgacattgttgattaggctctctccttccctcctgtacaacactgaaaatctgccagaaatacaactatagaaactgtatttctatgaattttgagcattttacaggtatattcttttttagatgggtgaaatttacacaacataaaattaaccattttaaggctgggtgtggtggctcatacctgtaatcccagcactttgggaggccaaggcctcccaaagggtgatcgcttgggcccaggagttcaagaccaacctgggcaacatagtgagactctgcttctgaatgcacgattcagtggcatttaggacattcacattgttgtgtagccaccacctctatcaagttccaaaacacttccatcataccaaaagtaagccttatactcattaagcagttactccccatctcccctcccctcttagcccctagcaaccaccaatctactccctgtctttatgaatttttgccttttttggacatttcatacaaatggatcatacaatatgtggcctttttgatggcttctttcacagagcataatgtttttaggctttatccacatcgtagcgtgtgtcagtgtttcatccctttttatggctgaataatatcctgttgtatagatatatacccacagatgtaatttttagagccaagatatattacatttgtaaatccaaagctttaagagccattaagagactcaaaaggacatataacccttggagtaactggcctgaaatttttctagatgaaacagaagagtacagatctgaaattctcctccttgctgctgccagctagctttgtggccttgtataaatgagcatcaattttcttaattagaaaataagtaactagatttagtactaaattgtttcaaggttgtttctttgctcaaaaattcccagcatcctacgcaatactccgcatataatagctcttaagagtgttgtttatggaacttaacaaaataccaaactcaacaagattactagtccagcatcatttgatatgctcagaaatggtatgcttcatgccacaattctcttgtttttaagagaagcacttgcatttttgaatcaaagtgttcattattaataactgaaccttccaaatgaacctgagagtacatagaaggagattgagacacaccagtgccttgctttttagtttatacatgagaactctaaccagaaaacctaaatgaagaagagaaatagtgcatccactggggggatttgtgagaaagctcatgaatattttccacagcatctgctgggaatatggtgcaagaaaatgaatacaaagagaaagaaaatgagccagacaaaaaactccctttttaatgtttattttagagagaggctagtaattgattaaactaatccaatatctggaaacattcttttttaatattcactttgccttttatgcagtttgaaattttggagactctcctttgaagtggatcagggttgcgtctgaaaggaacaaacagtttcccagacagatgtgtgaagaaatgcctagagctacgcgcttcttgctggggttagacgtgaccgggccagactgttaaatacacagcaacatgaaatatgaatattcttttgctttcgcagggaattttttttcctgatagtaaaaaggaagagggcaagccattttgttgttttctccaattccttcacttttttttaaagcttgcattcatttgttttatgttactgtgttgtgacattttgagatgcctcttaaaactcatgtgtaaaaaagcactttttaagagatatttattttccttttctttttcatttctatgcagtgatgttgaaagtcatcttgacatttctgaaacattgttttgtttgcattacagagtctccatggcaactgcatcctcccaggttctaattcctgaaatcaacctcaatgacacatttgacacctttgccttagatttttcccgagagaagaaactgctagaatgtctggattaccttacaggtattgtcttttatgttctctttaatattgtgcacacttagtgatataaacactttgccaccagatcagttattccccaataaccagaggaatgggcttttgacctaggaatggcactgatatttccataaacaatttctgtgcattgccctttgttttttcatcaaaacaacacagcccattactaaactggggacaggagaaaaaggagaatctcaaccattaaaagcatacttaccactgtttccctcactctcaaggtgtgggtgctaaaaatagtatctctctgtggtatttttcatatcatagtagtaagcaactcacaatacattggcagagaaaaaattggcagctaactgattggttgtctgtactgcttcatctccttgtatttgtgatcttgttttaatttgcacaacatcgagttgaggtaaagcattataatccccattttgcaaatgacagagatcagccgtcttgctggaaatcaggtaactagggaatgacagaattagaatttggctgggacctgtacaaactccaaaaacttctgctctttctagtaaaagactgaattttatcttggcaaatgtcaccatggcaaaggtcacaaatttacattggaattcctagtgctgtgtttcagtgtgcttcctggttggtgttttgttttgttttgtttctcccttggttgagcttaaaaaacaaaaacaacaacaaaacaacaaaaacctcaggccactcctattcctaagcatgcttctaaacttttctttgctgtcaacttctaaagtaggaactgagaatattcactggtagaacctggactgtttagacaaccttattcgtgttagccaaagccaccagtgcctgcgacttcaggaaagcacaatgtacacagtgaagccagatgtgcgctgcacttaagacatacagccttcaagagaccacgtctctaacttagcgtgacatgagcttctcaattccaattctgtgtgtacatgtttgtgagaaagcgattgaacaaggtggagcaggagaaagggaacattgtgtgatgtttgtttttacagtctgtggatagaaggccaggggttctatattcagggagcattgtacccagaagatgagcattttttctttgcgaggacccaatgtgccgtttttagcctttctgcattgtcaagcaaggcaggcaggcattccacaaacttcttatcttatgtaactctctctttcaaacataccactcctattaaggaagaaagaaattgactaaaaaagcatttaccgtatggaactaaacttggtttcaaatatttgtgtacataatgccctcctatttaagcttttaactctgagatttatttaaactgacactatccaataaaactttctatgatgatagatatgttctatatctgtactatccagcgttagctgcctcccacatggggctattgaaaacttgaaatgtggctagtgaatttttacttttatttaacttcaactaaatttaattgaaatttaaaccaccacatgtagctcgtggctattgtattgaacagtgcaggtctagactttctccagctaagctgtttttcacagtggcatcctgttaaaaatctcctttttcttatatcatttgcgaatgagtttagttgcaagcaacaaaaaatccaactagcagtgaataaaaccatcaaggagtgtttgtattacagtcacagaagagaagcctgtgttccagggctgggcagtggttcagtgacgacctcagaccccaggctctttcttttttcctcctctgccgccttcattgtgttgcctttttgccacatgatcacaacatgactactccacctccaagtgttgtgctcaagctctaggcaaaaagaaaggggtggaggggaaacgatggacaaaatgctctgccagtgaagtttgtttatcagaaaaacaaaaagcttgatcagaagacccgcctagcaaacttccacttatgtctggtgggctgtatctgtgttacaaggtcatgtccagggacagaaaagactggaaaattaagtatttgcctaggcacatggccattctgcccagaatcagtcttattgacaagaatgtgcccttgccatttcccaataattatttcatagtatttcaacaacatatacccattttaatctctataggaatgcaaaagtattgattaaaggggaaattgtgaaagtagtttagactgaattgtaacatacaccatatttcatcccgatggctgtttatttcaaactaaaggccatatggggtacctgctattatgtcttctgagctgtcaaccccaaatacaaattcagtccatttctagacataacatcgatcctgaccataacatatgatgcttggctgatactgccaagtccaaatagtttatgacatttgtaagcaggaaatgaagtctttgtggagtattagcccaccattccttgggtggtgtttgtgacagagacaagaaaataacacttctggtactgattccatgagtattgaaattggcagcatgctgctgttctcatttacactaaattgagtattgacttctcaggacaaactcattgggtttacagtcaaaataaggttagcctgtctcattgtaaaaacaagattttttttttcctatgacatgcctctaagtggtatatcaagttaataacccatagaggtgacatttccttcctgattatggctactaccatgtgtctcacagctacttgcctattttgaacatacgttttctttctatttaattgtatattgcaatacagaacaaaatttttctacaatggttgatggagaaataattcaatgaactgtttaaattgtgagagagtaagtatttcttcactggtccatgcaggagtgatcccacaccaacagggaccacacagacaataataagcacattttacgatgcagctggacctcctccgtggaatgcatatcctgattggtgtcactgattcatgcacatccaagtcataccacatgacactaaatctcacatgtgaatacttcaggagacagatgtacaaatacatattccagaaagaatgctttaaaggttatgtagaacccttctgtcttaatgcacaatttaatgccatgcctgtcacgttggaggtgctcaacaatgtttctggaattcagaaccaatagataaagctaagctaattgacttaataccgtagacttgcttctgtgatacttgtcctagaggtatattcaaaaagcaaagtgaagactactaacgcagagtttaaatttacagtttttataaacttttcttcctctttgggtttgcttaggactcatcaattctaatcataatttagagcaggaaataactctgaaatagtacaagcaaaggttgctcctagtttgtagagtgcaggtatgtttctccttttgaagtgagattctagtgggtagaagagtggaagtaaaggccctggatcaattctctaaaccagaggtcagcaaactttgactgcaaaccaccagatagtagacactttaggctttgcagtccatatggccacaactactcaactttgctgttgctccaaagcagccatagacaatacataaatgaatgaatctggctgtgttccaataaaactttatttacaaaaacaggcagtgggccagacttggcccacagtcacagtttgccaacccctccctctaaaatattatttacaatgcaaagcactcattttctcatattttccttgctcacatactcttctcataaaaccagttactgaaatcaattcagtagaagtcattttaaactcattattttggtaggacttagacttctctgctccagaatgtgttaaagaaataaaacagcagccttctacaatgataaattaaccaaatgccaaaaaaaagttttttccttggggaaggaaaatgtaccttttagatatgattgactatgaatcatggtcttctgaatttgaaatatcgcatgagttgagaaatgagaagaaaatagggctggactagtaagttcttttttttatgtaagtcatcgaaacatctaatgaaagaaaaattcaaacaattatgtggctgattttttgtaggataacaaacataagtattttttcaattgggtgcctaaagatataagtatctggcaccacgtattaataggtcaggggttggtgaactttgggttacagcccaaatctgaccctctacctatatttgtaaataaagttttattggaacctggccatgcccacatgtataagttgtgactgttttcatgctacaatggcagagttgactagttgcaacagagactgtatggcccacaaagctggaaacatttaccatcaaggcctttactgaaaaagttagccaacctcccaaagtgaatgcagctatgaaactttatcttgtttactttttatttgacaagttttccttcatgcacaagaaagtattatttgtttaacctcccaaacatattctcatgatctcatgataaacacagaaagtccatactggctgactctagtcacactccttattaaaaacaaaagcaataaccagccaatcagatattctttagattggggtcaccatctctaggatagtagtcctgatggacctattgagaaggacctgcttaactgtcaaacatctcctctgaaatggtatcccagttgtgtgtgcttttccactgataagcattcttgacccccacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtgagtatctcatggcctatttatttctgtctttggtggctttcttcagattgattgcattcctgaatttaaacttcaaaggaagacaaggaaggaaagaacacacaatatttattgacttgtctttcttgaacaaaaaagtgatagcactcacttgtactacattagtaaaaacagctggctaaatattgatgaaaattaatgacctctagcaaaccacatggatgttaagggaaagaagccagaaacaaatatatagagagaaacaaatatatagagagatacatagagagagaaacaaatatatatatatagtattaatccacatataggttcataacttaaagatcaaaataaactattttgcttaaagaaacattcataggtgttaaaactataaaccctgggcaacctggtgaaaccccatctctacaaaaaatacaaaaaaaatacaaaaattagcggggtgtggtgacacacacctgtagtcccaactactcaggaggctgaggcaggaggatggcttgagcccaagaagcagaggttgcagtgggcagagatcacactacagtactccagccggggcaacagtgagaatgctgtctcaaaaaaataaaaataaaaagtcaggatgatggctacctccaggattaaagggcaagtggcaccactggaaagaaatatacaggggttcttggggttaatggcaatttctaggtgaaagttacatgctttagtcattttatcatacatttagttttatgtactttcctgagtgttacttcacatattttaaaagaaaggatttaataaaataaatagccaaagaaagttaaatacctggtcccattcagaggagagagctgggcccatcacttaaaatgttagtaactggccccacccgggaagaatttccaaccttacctgaaacattagaggtgccccctctcactgaggcctatttgatatctggcatcagagataacttggtgatttcaaatagcagtagtagcaggccacagagatgataacagaggaagcagtcctccaacccacagagttatttaaattgaactgggcaaatggcaatggaccagaagacatggcttttcacgggagcaagcttgaaacttctttaacaaagaaaaatacaatatgtcaaaatagaacagaatagaatagcagtcatgtttcaacaaagagatgttttgaataaattcatatcaatttaatgtgcttttattatataaaccttttctctcttaactacaaactgctctttcctagcacaagtaattctgagtcatacgatgcttaacatagaaatttgatttaggattaattaaaagagtgatgcagaaatacaccaagttctaagggactaaagtataaatgacccataccaacaaatggctccccctaccttccttatatccactctccccaacttctccaacttcctctcctcaactccctcaccttctaccctataattggcctgccgtggaagcttttattaaaatcttgccatttaccaagaatgtgtaatttttaaatgaaagtggagaaagtcatgcaatgtcaagaacagctctggcaagctgcctgagtcagtagggaatatagaaaggtcagaaatggtgagtgggacaaaaatgtcttgggggaagttgtggttaaactaagtcttgaaaaaaagcgggtgcattttagcaagttaaggctgtaccggacagctatgtcatcataagcaaatctatcaagatgtaacgtagcagggcatagtgggaggtcttgcctaattaagcctggctggtaagtgaggaaagggagacagtgagaaatgaagatagagaaatagaaccagggctcaaacctatattggcctagctccaaaaagcacatgttcttaatccttaatcctcagtcacctaatcctaattcacaggcaagagctagattgcagagggctacccaggccataccatgtttggattttaccctgtgggcttgagagtcatgcaggacagtaatgtaatcagaggtataactagaaggtgactcaggagcactgtggagagtggagaggaacagggcaggaccagaagcagagacatcagctgggaagtttcgtagtaattcactgaggcagaaatagccaggacctgcaaatggcaccagcatcagagatggaaaggaaaagataattccaggaagacttctctgcgtctggcccattttcctgggaaaaaatcatcagtgtcctcagatatttgaagtgctttttggggcaagtcgcagaaggcctgtatagcaatggtttagtaacattttgctcaccttctaggattttgaattcttctggtatcattcctcatttctgactctatatgccctactgcaaatcataaagaaatactaattctctaaaatatttttctacatgtgcatatcatacacaatgctttaccttgtttttttcaataaatattatgtctgagatatcattccatttcagcacaaataaagaactgcctcattcctttttgaggcagtatcatatcctattttaaagatatgctctaatttatttatcccatcttctatagatgtttatttagcttgtttccaatctttggcccttacaaacaatgccccagtatccccaaggatgttcaagatatccttgaatatctctccttccacacacggggaattatatctgtagtataatctcttgaggtgcaatttctaggaaaagattatttgcatttaattttacttgacattgccaaattgcccttcagagagatgacatgatttttaaatgcatttttccagctgtatgagcttattgtatttcactgatcttggctacatataccataaacttaacgtggaattaaagtctagtaaaattttaaaccttgattgtgcttcaccataaacctgaaacacaagttaatctatgatcactaatatcatactaaatagtcactccttcatataagcagtgattctcaacaagggcagttttgccccctaagggacatttgacaatgtctctagagacttttggttctcaaaacctaggaggagggtgctattggcatctagtgggtagaagtgaggaaagatgggaaatctcccacaatgcacaagaaatcccccaacaacagagaactatctggcccaaaatgtcagtaatgtcgaagttgagaaaccctaatttaaaacaaggtaaatgtataatatctacatgattacatgctaaatactgagaccataacacactgatccacacacactactatactatgtagcatggaaggaaaaacacaacaaaaaggggggaatataattaatgtattttgtcttcacttaaggaattgttttctcaatattttgtgattaatatcactagcatatttgggataaactgaaccagggattgtatcaaacttgaagaagatgaaattcaaaagatgatcagaaattccaaggtaagagaaaagaagcacgtgaaggtctgagaagagcaggtagaaaatggagagatgattcattgtaaaacaccaaggaaggttctctgaaaatacatagaggactgatagaaccaacgtctgttgatgagtgaatagtctaaccggaaaaagaaaacatttggagtcattttataccaaaagagtggttcttggcccatgtgagaaatgctatatttctctcaaatcattttcgtctgattcaggaaaagtgctaacagttttctattgctgtgaaacaaatttccaaaaacttagcagtttaaaacaatacccacttattatttcagtttccatgggttaggattctggcatagttgagctgggtcttcttcttagggtgtcacagtctgaaattaaggtgttggctgggctgcattcatctggagactcaactaaggaagaatctacttcttagctccctccatttgttgacaaatttgtttcattgtggttgtggaattcatggcagcttgcttcgtcaaggccagcaagggagagagtctgctacttcaaatctgtcacctccaaacctgtctttaaaggactcacttgactaggtcagactcacccagaataatctgccatttgattagctccaaatcaaataattagggaccttaattatatctgtaaactcccttcgccttcgcctttgtcatataatgtaatataaaaacaggagtaataaaagtgatagacctttgtcctttgccatattctgttggttagaagcagatgacaggtcctgtttacactaaggagataatattacacagttatgaataccagggagttggaatcctggggaccatcctagggcatgtcttcctcagatggttatgtctctcctgaaatttcttttggttttcttttattctttcatatatgtatgtgtgtgtgtgtgtgtgtgtgtgtgtgtgtgtgtgtgtgtgtgtgtatatatatatatatatatatatatataaaatttcagacagtcttgctctgctgcccaggctggagtgcagtgtcatgatctcggctcactacaacctccacccccagagttcaaatgattctcctgcctcagcctcctgagtagctgggattacaaacatgtgctaccacgcctggctaatttttgtatttttagtagagatgggatttcgccatgttggccaggctggtctcaactcctggcctcaagtgatccacccaccttggcctcccaaagtgttgggattacaggcatgagccactgcacccagccctctcctgaaatttcttaaatcaaatcgtcatggacactttgggagtacatgtagccttggccttgactgatgggctctgtatccgttggcttttgctgaatagccaacaaccacagggcctaagtagaattcatattgcttatgcatctggagtcaactgagtgtcaactaggaagccctgctgatcttggctccctcacatggcagactgataactgtggcaacccgactgctgcacatctgtctcatcctcctacaatccagctcaagtctgctctcaccctgattgcagagatgaaggagtaaaggcaggaccaattacacacattctttttaagcccctgtctgtgtcacattagctaacatgaggtttgtcaaagacgtcccctgggtgagcccagagtgagaatgcaaagacctgcaaaattacaaggaaggagcaaggaattggggccaaaaggccctaactcaataccagagcttcacctcatccccaaaatgaaaggaagatatttattgcttgaaacttagggtttctcacttggctaaactgtgaccaacttgatttctgtgctatttgcatcgaaaataataccaaacatgatgcattaatagaatagatgatgcaaaaaggtcatgcataaaaaaactcaacaagagcaaaaccactcagtataatgaactcagaactttatgttgggtgattccagagatgttttgttcccagaaaccagttgccataagaaaagaaatgcaaatggcttagtgaagattatcagcctttaacgcatagatgccagaaaggcccattctcccaggatggaagaaaaacagtgaaactgctggtgctgaccaaactgggatactctcaccgggttgtttgtatcaggatgtgttcctcccttgatgcccattaaaccagaatagtgaagtcctaatgcctacaggatccatttgcgacaaagaaagaattcattcagataaaaagctaaccgataggcaaagattttcaaattattttcttcttaaatatttttcacatttgtagtgaccaaaggagacctggatttcaatcttgactttggacctcactagctctgcagtcttgagcaaattatttaatgtcctccgaatccgtttcctcatctgtaagaagggatagtgttttaacttcacatggttgagataataatagtaaacaccttagtcttgtgtttgccacagtggtagcacatagatattcaaagttattattcctacaaaaatacggactgtactcaccccataattgcattttaaaagaaagaccagttttgcaattttccaggattatctacatgatagctttttacacaatcagtatgtgaaaggctttccttgaatgatgttaaataatctgtcctattatttggagaagtatcctttgcagatgttgtattgcgtgacaaggtctaatggtaaaactctactgaaaatgagaagatataatgctcaaaacctggctgtagctccttatatcactagaaaatcttttactgtctctaggtcatggttccttcactcatcctaataaattgtagttaattgccttcaactggcgttagtgaaggagacttagataatatctatggagctttttcaatcttacgaaaaggccctcactaatgaaatacatacattcaaatgcaaaagtaatgacattaatttttattttttatttttgttaatagagttatgactatagatgttaatgaattgcttatcaataactagatatttatttaattttacaacgtttgccacgttttctctaaaactacttttgatgcttcattttaagtcttaaattgggtcctttccccagcagcctattcttattcttagcagaaatcaaaagctgcatttttttcaagccttaatggctaagtagttatctgtttttaatttattgtagtcacttagaaaacattcatgaaaattattaaacatatactatttttacagaggagaaggaaaggaatgttcacttctgtccagtctgttggaagagacaaaggatgttagaaaccagtgtgcagcctctcctaagactgtccacatcatgtgacatttttacacataattttttgtggcaagatgacagttgccatacaaggctctgaaatcccagatgtaattaagatcttataatgagccacattatgtagggaaatgcttctaacccattgtgaatgaaaaaaaaaatgtataaaatcaaaaaactcaattaattaggtttcattgtggacaaattattttccaagctccgttgttattttaaactgagtcggaggaggtgaatgttggaacaccctcaaagatgactgaaaatgagtttggagaaaagtgaagtttcaatcaggatggttgtgtgggtgtttcataaagagatgaataaagcctggtcaagagtcctaacacagtggggtgtcaaggcagagaagtcttgcttaagcaaactcagtgccatatgcaagaagttaggtggtgctggcgtaagaccaacaccggtaatggtgcactccaagtcaccccacttactccagcccccagaagaaaattgtcaatgttgctttcctggcatttttaatcaacttctcaattattatcttggcaataataataacataaaggtaaacctaaacagtaatagtgtttgttagtattcatgaaagtagattgtcccagtataaagctaaccaatgaaattttactacttcataaacattttgttcttttaattttcaaggaaaaaatagggacctcttcaaaataatcaggatagtcagagtccctttttgtttggaaaaggtttctgaaacataaaatctttgttgggttaagactttggattttaggccaagttacagttttcagcaatttcagacatctgctttatgatgttactgaaagcgttcccccaccacattaaacccagcttttgggttgtacagtgatgtaaagtttattgaaacatttttacacttgctttctttgaccacaatagtcatttttttgtaacatattcaattaaacaggaacagtataaaggcagtgaaattgatacgattctcatttgaatctactgaatgccttaattgttctcattcgtggctgactgccattgacaaagatctaggaatatgagtacactatcctacataatagaaaagctaattttttgttttattactactgtaataatattaagtacctaaagagagttataggcctcttggggcccagaactcagagttcaaaatgacccttctttgattggatcaaaatctaatatttggctgtggcattatccagaagtatggagtttattatagctatgttcaaggaaaaggtaaggtgaaggaagatcagaagggatatatagtaaggagattcccatgttactaaactatttgtggatgttttcctgcatcatatgcaaatgagaattggtaggaaaacagagggctaagaattagagaaaataaatttggggaggagggatggattgtgcctcttattgctctgctgaatctccaaatataaacacacacacactcaaacccttctatgagtcctaaattacattcttgcttcaagctggctttttcaaatctggcagtccactggcgaaaatgtttgcaggttagagaaaaaaaaaaaaaaaggcaacagaaaattcacaagaccaaatatgtgtgtgtgtgtgtgtgtgtgtgtgtgtatctttagatatctttagatgatatatacatacatacatatatatatatatatatttaattcactgatgtgtacttgaaaatattatgcacccaagatggaaatcatataaggtgaatttttcaactgtgacaataccatgaataatttttaactcaaaagatggagtaagtaagtattcagtaagattcaaagacaggcttcgggagcctgtgactaccttgaaattctatgcatatatttgtggtttggtgtgtatatgcatttgtgaatttcttactacagaaaggttttattagattatcaaagaggtgagaccaaaaaaagattaagggactgcttcttgagaatctggtaaagtataagttgcctcaagatcaaaggaactaaccctttgacttgcaaatcaattgaaagaggagtggggtggtggctttggagtcctctggaagtggagggggcccagccctctcccagggatcagtgaaggaaattcaacagagtcaggaaacttcttgacagcctggtcaccaagggtttggaaaaaggttctattggagtggagattgatgggtggaaaaaggagagaggggagttggacctgataccaaagagatgttttcagccatcaaccagctgcaaaacaagatgggcttccttttcctacatattcttccaagcatcataaatactcggtctgctccccaacccacatcctgcaggatgcagccagagcaacagccccactccactctgaaaccagtcatcctagggatgatgatcatttcttagcttccctgttggaggtcggttggggttggctgatcgctgcttggttcactcctgcactggctgggcgttggctgcatggtaaagctgttccctgtctcatcctgttgggataaacagagtatcctaggcatattttctccagagcagtggcagacacaaagggtcaacagaaaccctcaaggttttgtcatgcctactcttgcaactagcacattgtcatttcagcctcatgctattgaccaaagcaagtcacttgaccaaattcaaagccacatgacagggaaatatattgcacctctttagaaggagcacctgcaaagttatttgggcctggatatacagggcagggagaattttggaggcaaaaatgcaatctgccacatctacgttagtgaagtcagtttttcgtacatgactaccaagacaaagcacttcacttaccaactctattcaaataaatggaaattattcaacctaaaattatgcaaacattgctccccttgtgccaaagaactgcaccatgtctgattggctttgcaggtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagtaagtgctgtgaactcaacagagctgtcatgtcttatctgctcttctttcagctgactctgtccccctttcttttccttttctctgtcttgggtatcattgacagccccccaaaacaagtaaaaagccagtgtggaataatggaatttgcatcagatacctctaggttccaaaactgattctattccttcacagccgtgaggccattactctctctgcattactcaattttaaaaaattgagtcttctcattttttaaataaatattcctggaggcattcttgtgagaagtagatgatgtatatgtaagacctgacacacagtaggggctctgtaaatggtggatagtgttatttttcatagcagagtagccaactaatcactcttcagaaattcttttattctagaaaacagtcggagtctgtggttctcaatcagggacacttcttcctccccctccaccccaccctaccaggacatttagtaatatctggaagaggtttttagttgtcacatctgaggtggatgctaccggcatgtagtgagtagaggccagggatgatgggaaacatccccaatccacaggacagtgcgcatcacagagaatggtctggcctatatgtgtgtctcatgatactgtcatctccctctctctgtccacatgtgttttgttttatcctctcttctttctttacatccttttgatctaggaatattatgttatgtaacatggtgtttatttgcataagacctcccaagagaaagcaaattggagtgtgtcggtatggcgccatgttgtgaggttgccaggcagtcaacaggaacaattaagtgcttttcaaggggaaccctcatttaacctatatccttgtttctcagtacaagtgttgtatcctagaggaatgtgttggatcctagaggaagaacaagggatgtaaagagagcactgaattacgaatgagaagactgtggctttcccacttggtacccatatagctatatggctagtttcttcatatttttaaatagattttttattttggaatagctgtagatttacaggaaatccatagataatacagagagttctgtacacccttaacccagtttgcccaaatattaacatcttatgtaaccttggtacagttatcataactaagaaattaacattgatgaattactcataactaaactccagactttattcagattttaccagctttccactaatgttcctttcctattccgggacccaatccaggatcccacaatgcatttagtgttccttcagttttaaaatgggaatattttaacaacttgagggttgttatgagttgtcaaaaagaccctctcaaagtaattctaaaagtacataagagaatataacatgatgatatatttctttacagtcatacaacaaatggcacaatacctatgcacacttagatcagcattatttgatttgcatttgaacatgtaaatatttgttccttcaaaagatatgtttgagcaccaagtgtgtttgggatgctgtgcaagatgctaaggatattatgagtatcttcaactccctaaggtgtgcttctctctcaaaaaggtcctagactattggggaataaagcacattaatcctaattaacattcaatatgtgaaatctctgactggaataaccatgagaggttctaagttgacaaagccagggtgccccagcacaaccttgagaggctttccaaggtaggttaggagcaggggatgtgaggacacagtgttccatgcagaaggaacagcatgggcaaaagcccagagacaaggagaatatatttatggaacagaaaattgatccatgtggttaaagtgtgtcttaggttgggaggataggtgagccaggaggctggagacaagaacagatcgcgaaagcctcctgggccacaccagggagtttctttgtataccaatgattggtggagagattgaagagtttaaatcaaacaggcaggatgaaaatttccatgaaataaagctctcttgcactatgatgtggtgagtggattacaaggaaggaagactggctgctgggcacagtatcaaaagattattgaaagagttgtccatgtaagtaaacaacggcctgaataagagtcgtgtcccatacaaatattataatgaattgaattatttagtaaagtaagctattaatctctttcttgaactaatttgtcttcactgaagcaaaagccttgaatttgggcagagtaggtagtggtttatttgggaaacatatctgaggcatgggcagaatttgctcaccaagattgcatgattctgctccacacatgcgtgggtgagggtgtgagccaaggcaggcaggatgtttgaggcagtatgtcaccatcacaaggccggtctttccaatggctctgacattctgatatatctcaccggaaggaggccgagcagaacttggccttcattgtaaatgatgggcgccattaaggaatttcttcctgctctgcccattagtatcctatcaatcatttttaatccatattctaccttccacctttaaaaattgaaatattttaagcaaaactgtcttcatactcttcttgtcttagttcatagtttatctctgatagttgctagcatgatcattcctaaggacttctttttacaagtcaaaatttaaactacacatgtaatccaatagatcttacggcctctgagaatgtccaatccctgctcagcccttgagggttttctctgctccccctttaaagcttttcttttcttttttattgttatttttttgagacagtgcctcactctgttgcccaggctggagcgcagcggcatggtcttggctcattgcaacctccgcctcccgggttcaagtgatactcgtggctcagcctcccaagtagctggaattacaggtgtccgccaccacacccagctaatttttgtatttttagtagagatggggttttaccatgttggccaagctggtcttgaactcctgacctcaggcaatcgagctgccttggcctctcaaagtgcaggcattacaggcatgagccaccagcccagcctaagcttttctttgatatgtacagaaatagatttctaaaacaaaagccagctaactatagctcaagggccaaatctggctgcctgattttgtaaataaagttttattagcatatagccacacccattcatttacctattgtcctgtccgtggctgccccctcactatagcagaagagttgaatagtcacaaaagagaccacatggcctggcctgcatagccaaaaatatttactgtcaggccctttgcagaaaaagtatgctggtccgtgacctaaaaagaaaggattttagaggtgctggtgttgtgttgtgtttgtatccaaaaggcaactggaaatcctttggcctacccacatgtgacaacacacactgtcctatactcactgggtcagtttctcgcccagcatcgtgtattgccacagttgaatttactagaccttttcctgtgattgagagctgtatactgggcagaaggaacctgccaactgcaacagtgactgtggagtttggacaccatggcatttgtatcaggttgcaatgcatttcctgcctttaaacgccttgtacccaatgcagtgttgaatgacaggcagtactccaaaccaatattgaattgtcaaagaagaagtaacaactatgacaaaatgtccaggtgtgactctgccaagatttttttaatacttaaatctttaagacacaaatgtgagtaatgaaatagagaaggccttattatatataaataatttcatgagtagaaaacccaggcattgctatcacattttttcctaattttgtggcctgaaaattgtattctcatcctaaattcctaagagtaatgctttaatttttaataatctcagaataatataaacctctagaatattctatatgttaagacccaagatcttgatttgtttggtttctggtctgaagtctattgagcatgaatgcatcttatgctggatagaacactgcagtggttgaaaatggagtcttcattcattcctccttttcaggatgctatccagccagtatgtacctgtgctgcttgtatacacctggaatccgtgaagctagctcaccctatgttttctggctaagccttatccatgctgttgttgaatagttggcatgccaccactggatccctatcttagaactggtagactgaaagcttatgaagacaggaacatgttctttttcactcttactgtgtactgtactatacacagagttgctgctctctattgtcttttgaatattatgaaaactttgcaagcaaatgtctttgaaagttgcttataatgtttaaattactattaaaatataagataccactttgtgataggaggcatgactcagggagggctggcttgttcctgtcttttaaacctgattttgaaaatatgctattggttatgataaaataaacaatcctcttcctcttcctttttctgttttgtgaatttgttttcaggccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtaagcaacttatttctattgtcctgcagttataaaaaggcacatctcattctgtacttagagagtcaacccatactgtaatgcatcttaaagaataaaatgcagaaaagttgtattagtcagctcttgctaggataatactgcataacaaacacccccaaactcagcagattcaaacaacaaccatatattactaatacccacacctgtgggttctctgttcaagattatagagctctgatcattggatgagctataccatgttaacactgctctttcatgccatgaaacatgggttggcaaaccacagcccatgagccaaacctggcctgctacctggttttgtaaataaagttttatgggaatacagccaggtccatttttttacatatagtccatggctgcctttcagccacaacagcagaatcgagtagttaagagagaatcatatggtctacgaagccaaaaatatttacttactttctggtcctttccagaaaaagtttgccattccctacttttaaacatcactcttcatcattacacaaaactaatttctgttgccttgtatgttttatggttctagactggaccaattagtgcaaatagctaagggttgaatggtgggggtgaagcagtgatcataggctgggaataatttcaaaaggcctgttagatccagcccagtgactttagcccactgagttctctaagaataagggcaaaggtcaggacacaattacattggaattagttaacctcacaaagttaaccttgcctaatccacagccacaactgcacccctttgaccgtctgtctcacaaatgcctgcttgctattgatcaaaaagggagctattttatttttatttaacaagccctcatatggtacaagtatgtgccaggcactggtctaagcattttacagatgtcaactcatttattcagccttacagccctacaaaggtaggtgctaatattatccactttactgatgaggtgactgaggtatatgctgaagatcacagggttacaaagctcacaggtggcagagtcagtaagtctgcagtcaagggtcaggctcttaaccagcagtccacaaacattatctgtaaagggccagagattcaatatttctggttttgcatgccaaatgatttttgtcactaatactcgactcttctgttgtagtgggaaagcagccacagacaacacctacacaaatggacatggctgcgttccaataaaacttcatttataaaaacaggcagagggccagagttggcccctgggtagtagtttgctgttccccgctcttaaccaccatggtatgctgctattcacaaaagggtggtatatttttgaaatgctataattactctctagggtttatgacagtgtacgtaatgagtgatagctgaatccttgctttaaaaaataaaatcaacattcaaaattgcatagcctgaagatggtgagtataacagtgtttctttcaatataagcatgataaaacacttatttatatataaaaaaacctttcaattcaaacctatgcaaataatgtgacatggctgagtcctttatattgtaggtagaaattagccaaaaatctaagaagtgaattgtaagcttcccatctctcccaataatggtacatactatattggctgagcgagtaggttttcctttgttgctatcctcataattctctttgcctagaagagttttctgttccaacatcctgccagaggatggaggacaaatccttcaccccactaggctctgggctagattggcatttgcaatttttagctgcagtggggcaaaattaaagcacaaaggaaaacacaatggatgcaggtacaaaaaaagcaaatgtttctagttaattaatgtgctgtattaatctgggatagaatccagggtctaaatgattattactctattaataattaattatgataaatgaaacctgatcattatgatctcattgccattgatgaatagtttgcaaaattccatcagaccacttcagttatataaacacacatcagcattaccttgaaaacaccctccagatgtcaaaactaactcatgagggggaaaagaaattctaaaattaattgctacacaattaatctttacaaacctgacggtgtcaatttcagaaaaatcttcatgtagaaagtcactttacatttccttggggggtattagcaaggaaggggcaccccctacgattaaatgcctgtgacatcttgacttgcaacagctaatgacatatttgcttatgaaatatagtcctgactttaaattgatgtgtacattatgatctgtgcaatggggcacgttaacattgctccgagagacataatttttatactttgaattctccgtgtctcactgcgtaacttaatggaacattacattctgcctgcacatttcaagctcaatggaaatatgtacctagtttcacagattaatgatactataatggtattttcctttgcttaatggactatacacttagtattttcttactctctaatgctaatgtgcacttggtgttttatgaaatggtgttaactaaatgagtaataacgggttcatgcaaagattattagaccagaaggggtgggggcagcatacaactctggattttgctcccaattttaatcttctgtttctacttgctacatgtagtcagccatacctgccacagctatttcatagggttcagttaaggttcaaatgggaaataaacatcaaagtaataaaaaataaaaatgctgtgccacaacaagaaggaaacaatacagatgtggtgattttgtgatgcaggttccaaattgtctgaaaagcggaaatagtattcactggggtatacagaacatttttggggggtgggagatactgacaattgcaaaatgaaaacctttccaaaatgtatgtattagtctgttttcatgctgctggtaaagacataaccaagaccaggcaatttgcaaaagaggtttataatggacttacttacttacagttctatgtggctgggaaagcccacaatcatggcagaaggcaaggaggaacaagtcccgtcttacatggatggcagcaggcaaaaagagagcttgtgcagggaaactcccccgttttaaaaccatcagatctcatgagacttattcactatcacgagaacaacactgaaaggacctgcccccatgattcaatttccttccaccgggtccctcccacaacatgtgggaattcaagatgagatttgggtggggacacagccaaaccatatcagtgtatcaaataaacagatgacatttgagaccctcgatgcatgccacagaagggagccagaagcttacaggaccctggaagggctggggcatgaagtcagggagtctgctgctctagttcatggagtcatgatgagctgtagctgctgcaaagttgcccacagcacaaggcaggtgtactcaggcgctcatctagaagcttccaccaaccgcacgtctactgtctgccatcaggaaagcgtgtttcccctcctctaagcacttctggatcttgtgcaaaggcatcacaatagcagagcctgacccagactcctacaggaaaggggattctgggaaatgcaacttggattctcctcataagcaggagaggatggacgggagggaagagaggatgcaacattgatgacagacaggcctgcacactgggcttggcagattatcaattccatccttcttttggatttagtgatggcatgttgtgttaattttctttttaaacaaacacaccactcttaaagtgattgtattttaagtccagtgtgattttttttaaagaatgtcattttattaaagacccatgaaatttttctctctgcattgggtaaggtaccatatgttaatatccaattagactggtttctgctataacatattaaaagttcaactgtgagtcatttactctttataaagagtgatgggttttgtttatcttaataactgaaatacgatgaatattacagaggcatgactcagaggggtaaaaagagattaagatgcttagaacattgtagaaagcattctttggatttttttgagcagcaagagaacatttagaataaccagaagatccgtctgctcaaacacgttcagaattttttttccagtataatcagaaaggctcttggcagtgatgaactgcacaatttctggttacggatggcattgtagaatgtagttcgtgtttgtgggttttgagtcatcctgagttcaaattctgattctggtacttattgttaatatgtgccatcaggcaataataataaaataaatagcagttactgaatattacatgccaggtcctgtgcctgggacttaacatgtattctctcctttactccttaaaataacactgtatatttctcaatatacatgagaaaattggggctgagtaatgacaaaggatttatccctgcaaatgggaatcatcttctgtgcttgcccttggcaaagtgcattcagaatcagaaaatgacagacatggtgttaaatgaaaaattataagaaggtcaaaaggagaagtctagggttgtgctgtccagtatggtagctatgagccacaggcagctatttaaatcatttaacttaatgaaaattaaataaatttaaagttcagttcctcagtctcaccagccgcagctaaagtgcccagtagccatatgtggcttgtggttaccatatcgaggagagcagaacatttcagtcattgaagaaagttcttttggtcagcactggtctagcgaattcattgtgtagatttttataagagtgaaaaaaagcagcaaaactcaaagttcaaattctccgtagtgtttgagctgaaaacagaaatgtgggtaaatacgacgcttctttccacccactactttccacccactttccatgtttgggagggaaggagatgaggaacacagatgttggggttcttgccaagctttcacttaaagaaaatgaacagggacaacaaatgatcatgtttttataacccctgaggaccacagaacggatttaacgtgcatgtgcaacatggctcattgtttttgttgttgctgttttgtttccgcaggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaag

SEQ ID NO: 2995 - DNA, 438166 bp, human
  misc_feature (63089)..(113088): n is a, c, g, or t
cccagcctgcttgaaggacctacaggtttgtctcttccagatcagaactgaggaacaaaaacccccatcctgggaaaaatggggaagctggtgagtcttaccactctctctctgcttgcttctgctaagtggcacgcctgtctgctctcacccaggaagcaaagtaagaggcgttgctcagcctctaaccccacagctccttcctgaacaaatacaatgctttgcgaatacctccagacaactttttctgcctgttttgcacaccgaaaatccacagaggcaatgatttttagcactttagacattccagagagtgtttttcctaggcaagcgtttctatactgtcgtgatgagcaaactttctcatctttgttacactctaaaacagtggaaattagccttggggtgctttgtgaggaaggctgagtccccaaggaagtgatagtaaatctaaatggggtttttaaaaccacaggcagtgtgatattctgcaaaagcgtaatttgtcactaaaaaggcagtctgaaggtatcatttttcattcacgcagcagcaaaatccttgcatcctgcatatgtaataaaggacaccttctgagacactgaggaaaaatagaagccgagctggcctctttgttctagacaatgtaaagaaactcgctcttgcgttttgacaaggagcgtatgtctatttatatatatggcgagaacggtgaataaaggctttatgtcaaaggtattgtggtcaattgagttaaaatctggctatattctatatgtgtacaaaaatctcaatctgaatgtaattaaacatggaaatgtgaaagtgtttaacagacttgcagggaaattttaattatacttgggaacagccaattgtaagagacaactgggaaaggaaaaaaaatgtttcagctgagttctggggcataggtaaaacttttgcaaagaaagtcaattttttatagctgtcaaaagtgatttggaatcaggtaaaaaaatttatttttattttttcatggtgatgtggttttttgagttgaattaacttggataattgtgttgaatgatttgactgctcgtctttcaaaggaatactgttgttttctgtcatatacagactttatcctgagttttgggagcaggtttgtgctactgactgcaacaagtggcacaaagactcaatttcagatttctgatattatgaaattaattgcttaagttaatttaaagaaaagtaatcagtgcaaacaaggagatttgagaaaatgaccacgtttttaaaaaatgcaagtcatagtccattccctagtgagactattgatttcaaacaggcattggcaactgcctagtcataaggacaaaagctatggccaattttctctaggatctttgactctagaaagcataactttcgcaaggacacagtttaaatgaaacttgttcacctctgtgagaatgaaacatagaaaagcaccgtgtataatacaatagacactttagtaaataaaattcttaatagcacaagccgcagaacagaagggacaatgcaaatgttttaaagtttatcttttcagtgctgctcagaaaaatatgagtcttgacattctgttgctgtcgatgggagtcagcaacccaggagacacaaaacactgttttagaatatacagttaataacagatggtttaataccaggttttctcaccctgctgatgagatggccccaagccaaatcagccagcacgtctgccgtttttcctgtgagttgatatgtacatagttattatacactaattacactaacagccaagggaatatataaccagaaagacagataagtctcctggggtaaggagggcaagggggcggtgtatgcatagggtttttggatctcatgtttagaattatccttgccagtggcatatgaattactgcagattactgggagtctcacggctagaatctactcatccccggctcctcagcagcctgtttgggggtaataatattgtttatggtatttaacactttagtattaacaaagttccaggaggattccttcttaaagattaaagtttttccagtgtctgaactaatcctccaattaaagacagttaggacctatattgttgcattgacccttttcaagtcacagtactgcgtgcttgcatggagggtttaaccaatcggcagcctccgtagatctgcaagatgttagtaggtgccctggttaaaagaggttggaaaatactggacaaaaacaaacaaacaatgggaaataggtcttctcagagccttaatatgttcatttattaatacgtgttttgactccctgagagaagtatagtgtgcaccatatgaagtatggtttgctgcaaacttacttgatggctcatttctaggctgatcattttgagaaacattctttaaaacaaagcttctcaatggatggacctcagagcactggtaaatgatgagtgggttgcagacatacccagctgttaacccctcttggcacatgggccatcaggctgtggctggcctgagctgatccctggaaggttatttctggatcacatagcttcatcagtttacctccatatatggtgcagattgcatcaatttctctgtcatgatgtgctaaagttaggaaactgcctttgacaatctaggcccagaatattgatcaaaccagtcaaaataccccaacactgtattaacttgggcctgggggctcatgcaatcatgagagtgttaaggccctctacatgttatccagtttgtcctctttattttataaagaatttaatgatgtgttctataatgtgtgtatgtgtgtgtgctattctattcttagaagtttcctgaacaactgatggcaaagtgcttcatggaatcctttctaacatttggttattgcttatacttccctttctcaaactgctatcagggtttgtttggctgggattctcccaccactaatatggcttagtccaggggcgatggacataaaagaacctggctttaaaggttatttgttaaattcaaatccttttcttgggcactgtaccaaatttgtacacagcatttctatcactggtgaactttctctggcttcctctgcctaccatttgacatcgattatctttcaaaaacattttttgcattattaattcctgttacattcattcagcaaatatttattgagtgccttttgaagtcctatgctaagtactctggaggaaaaatgggtatataagagacagatgaatttaaaccaagtcttcatgcaatggatagcatttctgcaaagagaaatctcattacctgaatggtgcaagatgtgaaacatgatttgctgcaaacttacttgatcactcactcttttgctaatcgttctctaaatcagagcttcccaactggtggccacaaaacactggtgggcaatgaacaagtaactgatacgtcaagatattcatgctttcactgaccagatgatctccatgtcagataatgccaggtagatgccaataaacttggtgtgcttatagaggaaggaccacttgattctccctgcagagcatctataaataactgagagttggatgatgccagtttatattttgttaatgtaattttcaaaaccactctctttggggttgtcaagtattcctggggtgccacatggagaagagctatttccatagtactaggtaacttgagagcttttataatggcttgtaatcactggaaattattagcgtacaagtttcggtaacaattcttataaagtaggcaagagcagctgccattacttctaaggtcatacctgtaaggcttagaattggggactatgaattaataatgagtttgcaccagtaggattttccaagtacctagggcattagtaaaaccaatttaaaatatatttatatttgaggaaaggttagctggtgaggtgatagtcaggactatgacttctagttaaatgtaaaagtacatttccgtttttaaattaattgcttgcaatcacatataagggaatcttctgtgaatgaacctttcaaagacattgagttactataaatattaatgtcaatggttcatttaatgttatttttattttaaaagaaaataaaaatggattgctgtgctttggggaatatagcattttcagaaatgcatggtacataatagctgaagctgcataaagaatggttctaactgtgtgtgagttgagtatactcacactctcttgtgagttgctcttcacttgtctaaacttgagacaaaaatgaaattaagcagagcctcctcaaattgacagtttgagttttaacacgtgacagaattggaattttggtcaaagagcctgagccagaaaaggctgaattatttatagctattgttctgcaacagaggccttgattattttaaccaaaattatttctccccctgagtatctaattgtgcagttatttatatctgtactgacacactcatcatgtattgccttgggggaacaaaacagcatataaactaccagagaacagataacaagtttactcgaactgatatccttggctcaatgttaagaaacaaaagaatggtagtgtttcccaagtttcttccagagcaatgaatggtgggtttggccaagacattttaaacttctcagggattcaatttcctcatctatcgatggagacataaatacacacttcattggacggttatgagtattgaaaatggtcatgtctgtgaacgtacctggcacaatgctgggcatgaggccaatcagtaaatattggctggatctgaaatgggtggggataagttaggcacatcgtcaagtaaacaattcaggggttgaagaagtagaagcagatgcacactggtggcccttatgtaattttgcccactcaatgatttaaaatttgtgtttcagtgaagcatgatataccttctaatgtcttacaccatgtcctctgtttattggtgttacctgtttgtcccttgtaggtttttgtgtttgacacccttgctctaaagacttctttcttctctagcaatctacgtcttctcaatgtagatttcccccttttaaggtgttttctcaaaagtaccgtattttataaagcaaaaaaatactcacttcatacttattaatttaacagcttgaaatctttttcaccagcaatggcgggaggagctgggctagcaaattcattggtaaaagccacttgcccccctagattaccctcagaccccagtctctttctctaattccccatccaccaacaccctaccccagcagaatgtaacatttaatctgatgtggcgtccaagatgtggagagaatgtatcccatgcgctaacatatcttggcaagagttcactctttgctaaggcaagtgggggccatatggtgtttgtgtaatgaggaagcagggcagctttatcaaagcgtagatcaaatggctccctacttctgacttatttttattgaatctcatatatgatcgattataagattcaacgctaagaaagaaaaaattcttccaattaatctataacacaatgttttcttagcatttaaatattttatgctaaatttattgaaataactctctaacagagagttattctcttttagatagaaataactctctaacagagagttattggctgactattatttagactgattatttaaaaatcatatgtctccccctgtgcataaataaaatggaagatataggtgagataaacttttaagaagccttaacttttcaactgagtcgttgtatctgtgcttttctgcaccgtgccgacatactttgggccaaaatgcagcatttttaaataaagagcttctttctctgcatttctactagaaggtgatgatcaagactatattctttccacaaatgggcctacaagagaatgcagttgtccattcataacccaaggaatgcccatcaagtcactacacatctcagtgagctaattatttaacactttaaacatatgcctacaaatgcattaagaaccagcgcgcttggtggggtccatagtctcctgggtatctgtccggacaactttctgccccagtaccacctgagccttgagaggatctctctctcaatctctctctctctctctctctctctggctggtgggcggggtgggggggacggggggagcaggaatctttcctccttcctttttctttgagtggttttaccaggtgtgcaacttctcttctcctaacaggcaaggcttgttttaaaataatgcctgtagctcaaatgaactgacaacagtaagaactactatgatcaagagagttcatgggcaggcattgacaattatatcacaactgcagcctgagcagcaacaaatgtaagatacctcccaatatcggctgggttaaactgggaaagaatttccccagagaactcatgaaatagggtgtatcttccccatctcatgagaatgactaaaacatcagcattagagaatgattttgttgtcttttaaggcatcaagagtctcctagttgaaatcaaatgactttagggagaacaacatttgtagttgccatatttactgctttgtcatggatttctttccaattaagactaagtaagagagcaaagtcccatgaagatgggacaaggaaagggataaggatgagagtagaggaatggagagagggcaggaaaaagagaaaaagaagaaagagaagctttacatttgttcaataatatttgtcaaatgctttctctgaaccaggcatcatcctgtgtgctaaggctaaagtggaacctgcattcaagtaaataacagtcaagtgtaggagacaaacattgatgaaatatcacacagacatgagtaaaggttcacctggaataaaagctataaaatggaggtatatgttgccatgtgattgtactaagaggatgtagctgatctgctacagagaaaggcagagaaaatttccctgagaaaggattgcttgagctgagagctggacagaaaggacttgaggcagtgtgttttcaggggtaggaaatggccagactctatgagggagttttcagcaagggatgacattggtcttttgaaaagttcacattggcagcaacctggaaaatattaggttgttgcaaaagtaatcgcggtttttgcagttaaaagtaattacaaaaaccatgattacttttgcatcaaaatagtagagcagattggagggccatcagagtcaacgtaggtgaaccaaacaggagccttggaaagcaaaaataatatctgcttgtactaatatcgtggtggtagagatgaagagaagtggatggatttcatttctattttagagaggtgaaatcgaaaggagtggatgatgcatggggcaagggagatcatgagggactaggtgtaaaaacagactctcaggaatttgattcacatatctagaaggatagtggtgtaggggacaatgaaagttggcctggtttggtggaagggagtaacctgattgagtggaaaaatgcatgagctttgaggtggaaagtcatggtgtgggttcaagtcttagctcatccatttagtagctgtgtgatgctaagtttctctgaatctcatcttccccatctttaaaaattaggtcataaacactcacctcaagaatttttggaacaatcaaatgaggtctacgtgaatgaaaatcacttcatacatggtcaaatgccctacatgtgagttaccattataacccacaaattcatcagcagtaaagcctggagggagaagagctattttcaataacttcctggggtgggatatgagggtcttgacagccaagatctctgtaagtttacctaagtgaagttttctccttgttgataatgtacaggacagctattaacttcagttgtctggcgaattctttctatttcattccaacccccttaccccctcccctcaacctggattaagggatcccaaataggaataagctacattgcttttctcagctgagatcccttatcatttctaagaggactataggatttagaaaattgtaacccgagagtttgcactaacagatgagcacactccattaacttcacgttcccagtagggtttgggtgaaggttttgccattccgtttttctagcatcaatttagcaagagcattttatatgacatgtgtaattccactacccttgagtgacctcagcgaattcctttctggcttccaaatattctcccattaaggggagtcattaggcagtgaaagctgcagccatagggttaggaaaaccttggaatgggcaggtgagggggaggaggaggttaaaccttgtggaatcaaggtattagcttccctttgtgcaggtgttgcattataggatctaagtcattaccaaaatttatatcttcttgccttgttccttgtctttccctttgttcttggcacacattatgtaagtctctttattttagaactgaactgtatgtctacggtttgggcgtatgtatgtattaataaaaccacatttatctttcactgaattcttaagaagcttaaatttcccatcaagatcctattcagttatctaaacacttatgttcctatagaaaaacgtgtgggagagagtgggaggcaacccattttgtcatttcacttgtgtaatgtttgggtggaagattgagaagcgtttgtatgaactttcagataactagattgcacttgcttctcagtgtgcatatttaagattttactgtatgcacccagattgggatttgggtgtatgggagggatgaggatggaagtggagtggaagctgttatctgaaaaaaaaaagtcctagccatgtaaagacctttctctttccactactttccctgccttcgtaatttttcctctacatgacccatgttagcacaaatggatttcaagacagaagtgcaattttttaaaagtccattttaaatcggaatagtatgtcccaaagggactgccattttcatttcataaggacccacttggctgtggctttgctgagttcaaagcaggagcacttcatagaaacttctgattagtatgtgcagtagtaattgctgcaagcctgggtgtttttggagtcacagtgcaatagaaggaagggagggctacagtgtcaagccagaaaatgagttcaccttgtccatgaatatagttactgccaataaatcatttgccaatagtttgaagataatgaaggaacctggcagaatgatccagagtgaaggtcccagcaaagagaaaacatatcaaacattacaatcaatgaaaaatggtgagaatttctgtttccagacccccaaataaagctcttgcagagataaagatgtgagctttgcacaccatcaagccttctggtctgtttttcctgttcagaaagactgaaattagggagaaggaaggcttctgccaacagactgtaagtcataaattagttaataaaatctgtcctgtgttatctctaaaacagcctattttatatatatttgtctatttggtttatttgtttctctgcttacccaggctgtattttggtagcataaatcaatatatgagttttagactatgcaaaagtttatttataaatgacctgccttctgtgaataaaataatatgttgtgtatatgtgtgtgtgttgtatataatttattgctattgatcaatgttaaatttaaatttaaatacataatactaatgagtccaatgaaatgtgcatattgctatattccaaaataaaagaattaatctgtattgtcgcttccaagaccatttcatggcttgtgtagttctagtagattatttccatgtattggtgttagtacaaccagttcttgttttatttactggggtcactatcaatgataaagcaacactgttcatatttatatacatttctatgtacattttatttatatatattatatatgtattatacacacgcacacatacacacacacatgcaactgtatgtgtccatttgaacgtttttctattttaaggagggtaagctttaattattttttactttttttgaagttagatgaaagatataagaaaataaaatgtcatacttctttttaatctttaacttttatttgaagttcaggggtacatgtgcaggatgtgcagatttgttacataggtaaacatgtgccgtgatggtttgctacacagatcaacccatcacctaggtattaagcccagcatgcattagctattcttcttgatgctctccatccccccacctccccaacaggccccagtgtgtgtcgttcccccataatgtgtccatgtgttctcatcattcagttagcatgtataagcgagaacatgcagtgtttggttttctgttcctgaattagtttgctgaggataatggcttccagctccatccatgtccctgcaaaggacatgatctcattcctttttatggctgcatagtattccatggtgtatatgcaccacattttctttatccagtctatcattgatgggcatttgggttgattccatgtctttgctattgtgaatagtgctgcaatgaacataagtgtgcatgtatctttataacagaattatttatattcctttggttatatacccagtaatggaattgctgactcaaatggtatttctgcctctagatctttgaggaattgccacactgtcttccacgatggttgaactaatttacactcctaccaacagtgtaaaagtcttcctttttctctacaacctcgccagcatctgttgttctttgactgtttaatagttgccattctgactggcatgagatgatatctcattatggttttaatatgcatttctctcttgatcagtgatgttgagctttttttcatatgtttgttggctgcatgtatgtcttcttttgagaagtgtccattcatgtcctttgcttactttgtttttttcttgtaaatttgtttaagttccttgtagactctagatattagacctttgtaggatggacagagtgaaaaaattttatcttattctgtaggctgtctattcactctgatgatagtttctttttctgtgcagaagctctttaattagatgtcatttgtcaatttttgcttttgttgcaattgcttttgtcatcttcatcatgaaatctttgcctgtgcctatttcctgaatggtattgcctagattttcttctagagtttttatagttttgggatttacatttaagtctttaatccatcttgagttgatttttgtataaggtataaggaaggggtccagtttcagttctctgcatatggctagccagttctcccagcaccatttattaaatagaaaatcctttccgcattgtttgtttttgtcaggtttgtcaaagatcagatgattgcaggtgtgtggccttacttctgagttctctattctgttccattgctctatgtgtctgtttttgtacaagtaccatgctgttttggttactgcgaaaatgccataattttttaagatcaagtataataatttacaagataagtggaagaccagagaggtcaggggagaaaagaaaagaaaaaaaaatgagaaaaaaaagatcagcaagagatgttagaggaagggaggtcccaaagcaacaaaaacctactgctttctccagccaagcccatctcccatatataaacaaaagcccagcaaacaaacaggtgcaggactaagggatcaagaagaggcaagccacaaattgctagaaaatattggagactgaaagagaaagagagagaaaggaagaaaacaaaagaaagggtgagaaatatgtttatggggaaatgcttgcaagttaaagaaatcagcaaaaaggataaataaagaagaaagtaagaaatgaaaagtaaacattaacaaatcaaaaaataagaaatgagacaaacacgggcattgtgtttgagctggtggatgctaaaaatatattgttctttaggtatctttacgaaaggaggagcaaacagcacaaaagtgaaagtgggcaattagaagaaagcaagaataagacaaagggagtgttgttagtccacatgccaaaacagccagccaacgggtgagtgacttagtactagtgtcctagtagggtttttcccagtgaaactaacccctgaagatgacaaggctgttttaatctttgtaattagtcctattccacaatagtagtgcaagtgcaattttctttttaaatgtccccacttgaaaaggcttgagtggcaagaatctgggccttctaagctgtgaggtgttccagaaaaggttggctctccctaccttaaaaaagattattcttaggcagtgaatgatagcttggtggcctaaagagttaatccccacaaatgtcttctatacttccaggagtcatttattgaatgagcagtatctggcttaatatttataaaaatgctttaaatttctccagaagaaaggtaaaaggccatagtatctggatccattcctactgtcaagctttacagagtacccaacgcttgagttggtaactgccaggcttacagcttgcatgtgaaatttcaaatccagtctcttgtgagtttggtcttgctcatttatttttactgtgattttgctcataataacttatgtttacaattcagcaacccaaggaattgtttttatgacaaattttcatgttatagtcaatcacacatttcaggcctgtttcagaaaatgagtttgacacggtgtgttagtgatgaattattaattcttacctgcagcaaagaatgatgctcagagtggtcggggaatgcttacaagttgttgactcaaagttatacagctgtatttaaaactccagtgggcaattctgaagatggcaaactttactttgatacaatgccacagcacctccattagtgccctggttagaatgcaaacatctgcttgcttttatgtccatgtgttacttaagatggtctgtttctttatgacgtaaatcactggaatctactgactatttttaaagtctcttttagtgtttccctgaaatgatcactctatatgattgtttaatagataattggccctgtaggtacacaaacattataaagatcatattttctgctttcctgatcttttccatagatgacattataacaaaagttcctcggcctgctgcaaaatgtgttgtctttcgggactgtgtgaatcatagattcacattaacacattaggtcaaaagaaacttcacatttccagtgactgaatataagactgctgttgtttgctcactggctgtagctttatggatttgcccagttcggtttgccctgccagggtctgctctttccttcactgcttatttatctctccctggcaagctgctgaacaatccatttgccctccaggctgtgcatgtgtccagcacagataagctttaggacagcaaagactatcactttaatgtcaatggactgcattttaggactccttgatgggtgatattatctaactgttagggtaagtgagggcttgaggccaatggggctgctcaagaacatgagagccatgaaacaaaagcttggcctatggaaaaaagaaaacccatcaattatgatcccagatttgagaagggattggcatatggtataatgaatagaacaatgtctctccttagcccactgattagaaaggcttggggagacatgcctatacgtactgagtcctatagcttgcggaatgttacaaaataagccatctggaagattactctcatagtcaataaaatatggctcttactcaggtcctaggattgcatattggcaggaagtttccagggaattcccaagagaagaatattggaagatgatagtttgaagattgtgagggttcctgaaatttgccagaaaattaagacaagaactaattgggagactccaagagaccagaaagaacaaatatggaggtgtcaggaagtaatggttttattccacatagcatctatttgtttcttgctctctctgggtcctgactattgaatttatgaaaattgaaggaaggaaagagtgtgtaccaaagggaaacaattagggggaggtgaggataaaggacatccactgtctcatgactggggagataaaaatatgcaatagagaaatgtgatgtcttcggttgcaataaatttaacaattgcaatgcaacaattaagaatatagtctttctcaagttacaaatagatgggtatgcataagggagataagttacaatacaaattaatttcatttaattagttgaagagactagatgagaggtcttcaaactttcaatacttctaagtattatttctctctctctctctctctctctctcactgtctctgtctttctcacgcatgtgcacagagagaaagagagacacacacagaaagagggagggagggagagagagagaatgtgtacacatgtacacacaatacaaattatcccctcataaataaaccaaaataaaatcaatgtatatatgtgttgcttcccatcccagctaaggaaaggtgtagaaaataactctggttttcacacccctcaatttgccatggccaccatcactagctattgaatgccctgtgatgacctgcagaatggcacagaggttaggaggataaacttttgagctacacagacctaacttagaatctctactgtgtcacttgttagctggacttcctactcctaacacttaacttcctaaccttggtttctttcaccacctgcctctcagagtcatttgataagactaaattagaagaagtatgtgtagtattctgaacagaggaagcactcaataaatgctggctaatatcatcccctcccagctctttgagggttatggcttagtatttgataaacctgtgaaccatggaactgtcactctgaaggacaaatctggcaaaacacaccacctctaggggagagggtgcccaccaaaaggcttttgaatttgttgcttagtactgcttccactccaaatcactcaaagttgtttagacttccttcagaggcctgtggacttaggcaggacttaagatgtctttgttaatacagctaatgaaaaacactgatagcatgtagaaacaatgacctgccagagttgaaggtagacatttactttctatcaccttgtccatttaattcataattgacagctttatgccttcaaagaatcattctgagactggatgagtctgaagctttgcatgtgaaatactgctcaaatgaatttgaattaacagtactaaaatagttagtgatttcaggcaaccattgtaacgtgttgactcaaaactaacttttaagagttttgtctggagacaaattctgtgaaaaatgcttaaacaaattaaacacaaagttaaaatttatttggaagataatgttatactcagtccagttttgtatgtactcttggatcagaaacatgttagtcatttaagaaatatatatgtcctgaagatgttatttcgatagagcaaaaaccctaatcaacaacaaaatcttattcttataaatatacaaaaatggcagcaatatagaatgaaagaaattaatatttgtagccattttctcttcttgtcattctcaaggaaatgtcattttgatggaaaagaaaatcatgttggccaggtgcggtgactcatgcctgttaccccagcactttgggaggccaaggcaggcggatcacctgaggtcaggagttcgagaccagcctggccaacatggcaaaaccccgtctctactaaaagtacaaaaattgccaggcgtggtggcgcacgcctgtattcccagctactcaggcggctgaagcacgagaatcacgttaacccaggaggcagaggtagcagtgagccaagatcacaccactgcactccaacctggatgacaaagcaagactctgtcaaaaaaaaaaaaaaaagaagaaagaaagaaaaaagaaaagaaagagagagagaaagaaagaaagagagaaagaaagaaagaaagaaagaaagaaagaaagaaagaaagaaagaaagaaagaaagagaaaaaaagaaaagaaagaaaatcatgttgaagtcatccattgaagtcatcctagggttgactgtaggagttttccaaactcctacttcattgctgaagtctacctatcataaacatatctaattttgctttatgttcctcttagattccaaagcacagacaaatgatttgtttgttttgctgaaaggtggattataaaacttgaatccctctgtaatgttttataactaagaccactgaggaaaacacttagcatttcccatccttcatatgggatatgtaaaaattaaagagcacagatcatccttgctaagttatcttagattcttgagcacagatactgtgtttttccttcacacatatctgatccttcaaaggtgcttatttgtcatttccacctttctgtggaagtgccagatactctcattcatagagaataactaacaaggcagatacacctaaaagttcaacatcaaagggcttgaaatatcctacctgaatgtcggaatttggatcatctaatgagcctgtgtaatttggtttcttaactagaaaatttcagtaaaaatgctggggcccactggctcacctggctgagtatcattgcctctttttgccttcattgttccatgacaaacccttttgaaaggaggtacatctgtcacaggtacctttgttcacccacgaacctccccaaacatgctctcaagttccattttataggtaatgatgtttcttaaacaatattcaaaatggcaatactaaattactttttcccacatgtacatggaaataatgtccatggtaaaattatttggactctatgcagtaacactaaaggtgcaatttagttggttgttgttgtgcatccaacaacttttgtgaacctattgtattcagagaagtcagctgcatacttagggatagtgagaaaatcttcgggaacccagcacaaacaaaaccctcatcttctccaacctgtaagtgcactgtttagtggagggcaaagcaactgtaatataaaacacaatccattcatttgttaaacaaccatttattagacacctatttattaggctatggagacacacgtttcctgcctccgaggaaattacagtttgataaagaattttaaataggtgctaagtagaagcacaaactgagcattttcattagaaacaaacagtgaatgcgtgaagaaagttacaatctgctgaatgtcagaaataacaactctggtttatgtttatatcaatattggcctcataaagactgtgtaattgacagaaaggggctggaactattttgttggttgagcttttattattattattattaatttatttaaaaactatgacttacttttctgttatatacttgaaattaattctaaagtggcttagtgagcttcagaatctccgagtgagagctaggaaagaagcagattggtgggcctcagtcacagaaattcattcaaccattctgagaatgaagcctgagagtctgcacatctaacaagttagcaggtgatgctgatgctgttggtccacagacctccctctgcagcactggttaaaggtagggacggattgttgtaatggctcctagattctgaggagggagtgaaagatggtaggattcctgcacttcttggtcatggccagtagactgaagaaaccaattgctaagtctaatgtagaaatgaaacaaactcttctttggaccatttagaaaacgtgtcaggaaaggctttagatttgaggaattgtaatttatcaatactagttcaaccctctctgatcagtatagtcaacttgttaaccacacagctgcataacccccaggggactgatgaaaagtgtcacagagctttagggtttccagttcccatagtcacactggagaaatattaaacattgtttgcatgtttgcactttgctattccttgtcacttgcccatgctgtgaggcagtctcaagttttgagtgaagaagccacgtaagactccattgaggaaggctgtagctaggacatgtgagctcatgacatccctaagagccaagtaaaccattttctttcttccataatgagaaacaccatgtcgttggctgcttctgtctgtaatttcactggtgcagcatgtttagatgtgagcactaatggaagacaaggaagaagtgatttcttgttctggctcagcttgcactgaccattctgtgacttatgactgaccctttggggtcagttaagttctctagtgtagagttgctatgtctataaaatgagaatgcaagatggcagggaatttttaaagagctgttaccacggtgtcatttgttatagggtgtgtttttgtggtaatgttaaaaaggcatattttaaaatatgtgcaaagggaatatttaaaaagtaataaatatgaaatgaaattaccatatagaccagaaattgcacttttgggcatttatcccagggacatgaaatgttcacaaaaaacctgcacacaaacattcagagatgctttattcatgttagcctgaaactagaaacaatccaaatgtccttcagcaaatgaaggattaaaccaacaatggtaatctttaccatggaatgctatgcaggaataaaaaggaattaactactgatacatgcaacaacctggatgaatctccaggggaatattctgaatgaaaagtcagtgtcaaaaaattacatactatatgattccatttgtgtagcattcttgaaatgaccaaattttagaaataaagaacagattagtagttgccaggagctaaggataggggggcaggagggaggtggacatagttatgaaaggacaacacagggatctttgcagtgatataactaaatatgtgcatgcatgcgcacacacacacttatgcacacacgcacacacacacacacacacacacaccagtacaagcaaaactgaagaaatctggacaaaattggtagattattttgcaaaatgttaccatagggggaacctgggtgaagggtgcaaggggtctctatatattatttctcacaagtgtgtatgaatctacaattatttcaattgaaatttcaattaaaagaaagtttttttaaaaaaagtaataaggaattttgtttactgtgagtcattctggtggccaaaaattgttgttaataggatttaaaatgtcaagctatattcagtagtttttcactaattaattatcaacagatcttcttgtctacttttgtaaaccttctgagagtaaaccatctaacatatggggaaaaataaaataaaatatgatcctctggagcagggattggcaaactatggcctgcgggctaaatccacactgcccacctcttttgtatggcctgtgagctaagaatggtttttacatgtttaaatttgaaaaaaattttagaaggaaataacattttgtgacaagtgaaaattatacaaaattcaagcttgagtgaccttaaaggtttattggaacacagccacactcattcatttatgaattattgtctgcagcagcttttgagctacaacagcagagttgagtagttgcgacagagatttttctgactcatgaagcggaaaacattgactacctgacactttagagaaaaagtttgccaacctctgcatgagagggataatttcccagaattttctaggttaagagggtcccccattgccacttgggtttcctaaagtagttctgatgagcaattatcttggtttccaggcattccctgagaaaaatgaggaaaatgatgctagtaggtccagcataaactccacaggaaaatgccctgagtacaactgcctgaatcaatagcatgtgtcttgggttgttctgcttgtatactctgcacttctagcagaggcatccatcacactttacaaactcagcctttggagcacaggaaaggatgtggtctaagagtaaggcagacttgggttcaggttcaaattatcacttgggtatttgccagctatgtgacctgggccaagttacccatctttctggactttgttacccatctttctggactttgtttactcttctttagaaaaatagagataattacacccatttgcagtggcattgagaggatgtaatgaactcctatgtcaagtgcctggcatgtagtaggcaggacccagcaaatgcaagttccaggatgggaggccaatcattacactgtttttgtgtctgggctctccatgcttcacatccctcaatctaactcgggaatctacaaagaggcattggaattctttcataaacatcactcaggctccatttttgcactttctccataagtgtctatggagcattttttttttcaaaactagaccatcttcctgctgcctagacctctcctccaagagacctgagtgaaggctctgacacaatggaatataaatcaaattattttccaattataggatgaactatgtcttcagtgctgggaaaaacctgcagattgatgttatcccagtagactcagcactagtctccgagaataggccaattcaggtttgaaaatgtttctgggttttcaggttctaagacaacctttgcactgaaatcatacagtctgaagggaaaacacacagggagagtggcttgccagttcatcatagatgaacgttcaatccaaagtgccctaacttgtgattaactctccacattggttcagtggagacttgggcatgcttctcgcccaatttctctcaggccaagtcagactggcagccggaaggacagtatttcatgctgtacactctctggaacggacataaagtccagtctcagatgtcttcctcaatctgggccaggcagagcaagaatggaatgactcgcatgctggtgaagacatgtgtccctgaacatgactttgatccctcatagagatgcttagatttttaggatgctgatgttcatctagtttctgatctaggaagatattggcatcactgaaagagagagagggaccaagggagagagaaagagagagaggaaaagtgatgaatacttttttcatcaggttgagtgggtaattttagagtctgtcaatctttttgcttaacaaccttcgcttaaattagtttctttgtcatttctctttcctttccacctgtcttaaatatgtggcagcctatcaaccagaagaacataagcacatacatgtaatgagccaatacatattttttctgtgtgaccacccaagttttgtcgcctagagataaatgagacttatgcattcccaccatagcctgcctcccaccgcatcaccctgtcaaaactgcccccaaataatgtggctgatgacttcctcatggccaaatctattcagcactttagcttttactgtacttgacctctcactgatattttgtattgctttgttccgatatttcttatggcattgattcccagattttcaaatttcagggactaatgttattttttaatggcagaagttaatatgggttgccaactttaaattaaccattaatgacataacaaaaaaaccttcttacctccaaaatatcaaaagaatggacattttgccatcaaaaaatataagaaagatgtaatcttgggaaaaaggacggccttttatagtaaattaatttagctttatgaaaaaatgtattaaattgcctacattttcttcatttcactacaccttgttggaaatttcatcacagatcagtcctagtctgatcttacatgattctaaagtccaatcctggcaaggctctccttctccatctagctcttgtctaccttctcagccatatttctcaccactcaccttcatgaatcctgggcatcagaatcactatcaatgaacatttctctcttcctctggacctgactccttaataagcacaagaactgtatctttgtctagtacccagcatatggtcaatcttcaaaaaacatttgttgacctttcaactcagtgcttgagagccagacaacctgagtttgaatcccagcttctccacttacacactgtgttagcagacagaagtgtctcaacttctctggtttcaattcctcatccgtaaaacaggaattaaatggagtcaatgtgttagtatttatgcaatgcttacaacagtctttggctcatagcaactactatacaaagtgatggttaaaaaagcagaaatgagtgtaaaaccaaattacgcagtcaaaggcagcaacccgaactgcactcagtaattttttcatggactatgccactggccatggagaaggacagatacagaaggtgtctgaatgagtcagtacaaatacatctcagatgctggaagaacagctcaaagccacactgaaaagatgatgacattgttgtcataagctagagtcataagtgacctcagaaatctctttaacagcaaccctgactgctggccatcttgcctttgtttgaatgcccccaggaaaaggagatcatccccagaaggatagctcattctactgatagggggaccatacaggaggaaaaaatgcaaagggcacaaggggaattgtagagaggggcatcatacagaggagcaccacagacagggacactatagagagggtcggtattataaaaaataataatagagagggatatcaaagaggggtgtcagagaggagtacatcatagacaggaacgtcatagaaaaaagcattttaaagggtggcttccaaacaagcccacaatgagctaccacttcacacccaatggcatggctactatcaaacacacacacacacacacacacacacacagagaaaacaacaagcgttggtgaggacatggagaaattggaactctatgcattgatggtgggaatataaaattgtacagccactgtggaaaacagttttgtggttcttcaaaatttaaatataaaattaccagataatccagcaattccactcctaggtatacacccaaaagaatagaaagcagggagcagggactcaaacatacacttgtacaccagtgttcacagcagcattattcacaatagccaaaaagtgaaagcaacccaagtgtccattgacatataaatggataaataaaatgtgatatacccatacaatggaattttattcaggacctttaaaagaaatgaaagtctgacacatgctacaacatgctataaaacttgaagacattatgctaagtgaaagaagccaggcagaaaaggacaaatactgtacgattccacttacaaaaggtctctagaataggcaaattcatagagataaaaagtagaacagagattaccaggagctgggggaaggaagagtgggaagttcttgtctaatgaacacagtttctgtttgggatgacgagaaacttccagaagtacctaatgatggttatacaacattgtgaatgtacttaatgtcattgaattgtacactttaaaagggctaaatggtaaattttacgttatgaatattttaccacaactttaaaaatacttaaaaaaaagagtggcttctcagagaggagcttcttttttattttattttattttatttttattatttttttattattatactttaagttctagggtacatgtgcacaacgtgcaggtttgttccatatgtatacatgtgccatgttggtgtgctgcacccattaacattatattaggtatatctcctaatgctatccctcccccctccccctaccccacaacaggccccagtgtgtgatgttccccttcctgtgtccaagtgttctcattgttcagttcccacctatgagtgaatggtgtttggttttctgtccttgcgacagtttgctcagaaggatggtctccagcttcatccatgtccctacaaaggacatgaactcatccttttttatggctgcatagtattccatggtgtgtatgtgccacattttcttaatccagtctatcgttgatggacatttgggttggttccaagtctttgctattgtgaatagtgccgcaataaacatatgtgtgcatgtgtctttatagcagcatgatttataatcctttgggtatatacccagtaatgggatggctgggtcaaatggtatttctagccctaggtccttgaggaatcgccacactgtcttccacaatggttgaactagtttacagtcccaccaacagtgtaaaagtgttcctatttctccacatcctctctagcacctgttgtttcctgacttttgaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatccatcgcccactttttgatggggttgtttgtttttttcttgtaagtttgtttgagttcgttgtagattctggatattagccctttgtcagatgagtagattgcaaaatttttcccccattctgtaggttgcctgttcactctgatgatagtttcttttgctgtgcggaagctctttagtttaattagatcccatttgtcaattttggcttttgttgccattgcttttggtgttttagacatgaagtccttgcccatgcctatgtcctgaatagtattgcctaggttttcttctagggtttttatggttttaggtcttacatttaagtctttaatccatcttgaattaatttttgtataaggtgtaaggaagggatccagtttcagctttctacatatggctagccagttttcccagcaccgtttattaaatagggaatcctttccccattgcttgtttttgtcagtcagagtggagcttcttaaagccagcctcttagaggatggtttcctagaaatagatataatgaaaaggagcaccatagggaggtgtaccatagggaggtgtaccatagagaggggtccatagagaggagcaccatagagagaggcaccagagagagaagctccatagagaggggttgccatagaaaggagtgccataatgaagagcaccacagagaggggtgctagagagacaagtgtcatagagagggacagcatagatagagtcatcacagattaaatgcatcatcggctcatcacagataagggcatcgtacaaagggacatcatagaggaccattacagagagggacatcataggaggagattcaatggttatcagatatcatttaatcacagagaaggacagcataggatcattctagagaagtctatcagacaaggacatcttagaggctttcacctcagcctctcctgtctggacatgagattgtgagctccctgagaacagaaatgggtcttattcatctttgtatttccaacatctgacacatgtgttggcacctgacaggaacccaatcttgtttgtggagtgaatgcgtgtataagcatttcttctacatgcagtctttgaagaatgtagaacctgttacccctttcttctgttctgcagactgaagtagcctagttcttgttaaagtgtccaatgtgctgaatgtttctggcctcccctatcctaggagacctggatacccactggtagtaggcagaagttctaggatgtgcctccaaaaatgttccacctgaatccctggaacctttgaatgttatgaggtagtactcccatgattatgttaaggtatacagcacagttgaccttaaaatagggagattatctgggtagacaccatctggtctcatgagcccataaaagcagagaacattttctggctgatggcagaaggggaagtcatagagattcaaagtgtgagaaagatttgatgtaccatttctggctttgaaaatggaagaggtcatgtgcaaggatggaaaagcagcctgtaggagctgagcaaccctccacaaacagaagcaaggaaatgaagacctcagtcctacaactcaaggagctaaattcagtcaacaacctgagtgatcttggaagtggattctttcccagagcctccaggtaagagcccaggatggccaatattttaatttcagccttatgaaaccctcggcatagaacccagttgagcctatccagacttcaagcctacagaactgtgagctaatagaaagtgttttattttgctaaatttgttgtaatttgttgtgcagcaacagaaaaccaatatgctatttgtcattgtctttatttaagagttcccagaactaattttttttttttgaaacagagccttgctctgtcacccaggctggagtgcaatggcatgatctccactcactgcaacctccgcctcccaagttcaagcaattctcctgcctcagcctcccgagtagctgggattacaggtgcctgccaccacgcccagctaattttttgtatttttaatagagacggggtttcaccatgttggccaggttagtcttgaactcctgacctcaggtgatccactcaccttggcctccaaaagtgctgggattacaggcgtgagctactgcacccagccttcagaactaatgttttaaatgagtattctaattaaatgttttttttaattctgaataggaaaataattccctccccatcttccctttaatttgaggaaattttactttcttattttagctcattagttgccattcaattagttgaaaggaatatttgcaaatgaactgtagtaatgttcgtagttaccagaaaggagcagttgtttatatgtttctaaattgtttcatacaataatatctgactgataatgtgaaaaacttaagtgccctgatagaaacacatttggacaactggagctgtataactctagatttatagatctttctagttgagaagagtgtaacttattcataaatttaaaatatagtaacatcagaaacatctggttttcattccaaaatgtaaagagcatgtcagtcatcaatcccgccctcttaacaagaaaaaggcagaacaaactgaaaaccaatgacttgtcttagatccttcagagaattgaggtcatagtacaaactgccaccccagaaactgcacaggcaagcaaatccagagaatatagatcagtttacctgaagcagaagccattgggcctaatagcagtaggaacacttaaatagtaacttcgatgaatttctggtcactaagtatggactagctttagtaagtagttaaaaactactgctgaaactggatcgcttccttacaccttatacaaaaattaattcaagatggattaaagacttaaacgatagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaaacaaatttacaagaaaaaaacaaacaaccccatcaaaaagtgggtgaaggacatgaacagacacttgtcaaaagaagacatttatgcagccaaaaaacacatgaaaaaatgctcaccatcactggccatcagagaaatgcaaatcaaaaccacaatgagataccatctcacaccagttacaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccctcccattactgggtatatacccaaaggactataaatcatgctgctataaagacacatgcacacatatgtttattgcggcactattcccaatagcaaagacttggaaccaacccagatgtccaacaatgatagactggattaagaaaatgtggcacatatacaccatggaatactatgcagccataaaaaaggatgagttcatgtcctttatagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggagcgatagcattaggagatatacctaatgctaaatgacaagttagtgggtgcagcgcaccagcatggcacatgtatacatatgtaactaaccagcacattgtgcacatgtaccctaaaacttaaagtataataataataataaaattaacaacaacaacaacaaaaaaaaactactgggagcctaatttcagtgggatcccaacattttcatgggttttacctctaggattccccccacaaggttctcatggtgaagattagaaaaaatttacttagtgcttggccagagcaagaaggaaaagtaacactttggacatatgaaagtaaccattttgaaataagcccagagcattgtttacaaaagaaagaatcagtaacaagggaaaagaatttaccagagccttatctgacttggtagaagaaaaattaccttattccagccctctgtagctttcctgtctcacctaagaggaaaaataaaagctgagagtcacttgtgaaggtcacagcccaggggcacaagcataataaaagattaagacccaatcataggattatagaatgcttcccctccccctacatcctataaccacatcaacagtgctcctgtataatgacagtgaattacaagcaaaataacggaaatactcaaactcgatttaagaaggagtttctagggaaacgtaaagatacaatgggtgagggaggacaaagataattgaggaaatctaagcctatgacacctacagctacagcaaacagtaaacatgcataacccctagccagatcaacataaaacttcacactaaaggtttatttatgtacctcagtttctattacccaatacatcatgcccagctttcaacaaaaaaattacaaggcattctaaaaggcaagaaaaactacaatctgaagagataaagcaagcattagaaccagattcagatatggtagacatttttgaaattatcagactgagaatttaaactaactatgattaatatgctaaaggttctgttagaaaaaaatagacaatgtgcaagaacagatggataatgtaaacagagaaatggatattctaagaaagaatcaaaaggaaatgctattatagaagccacaaacactgtaacagaaatgaagaatgtctttgatgggttcatccacagactgtacatggccaagaaaagaatctgtgaggtgaaagacatgccaatagaaacttcccaaatggaaatgcaaaccaaaaaaagagaattaaaaaaaggaacagaatattgaagaacagtgagaccattacaaacacaaaaggtataacatacacataatgggaatactagaagaagaataaagaagggagtagaaaaaaatacttgaatatttgaatatttgaaataataatgactgagaattttccaaaactaataacaggaaccaaaccacaaatccaggaagttccgagaacatgaagcagaataaatacccagagtctacacctagccatatcatattcaaactacagaaaactaaagacaataccaaaatcttgaaaatatagtaacagctggccgggcatggtggctcacgcctgtaatcccagcactttgggaggccgaagcgggcagatcacaaggtcaggagttcaacaccagcctgaccaacatgatgaaaccccgtctctactaaaaatacaaaaattagccgggcgtggtggtgcatgccggaaatcccagctacttgggaggctgaggcaggagaatcgcttgaacctgggaggtggaggttgcagtgagctgagatcaggcctctgcactccagcctgggcgacagatcaagactctgtctcaaaaaaaaaaaaaaaaaagaaaatatagtaacagctatttattatgtatgaagcataatataagcatcttacttatgtcacttaatttatgtataaatctctctctcaagaactttatatttatttatatttttgctttctaaaatatctctatggttgttttatttttattttttatttttataatttcaacttttagattcagggagtatgtgtgcaggttcgttgcatgggtttattgtgtgacactgagatttggggtacaaatgatcccatcattcagatagtgagcatagtatccagcagggatattttcagcccttgcccccatccctctctctcccctataatagtacccggtgtctattgttcccatatttatgtatatgtgaacccaatgtttagctcccatttataagtgagaacatgtggtatttggttttctgttcctatgttaattgacttagggtgatggcctccagctgcatccatgttgctgcaaaggacataattccattctttttatggctgcatagtatttcatggtgtaaatgtaccacattttctttatccagtccaccattgataggcacctaggtttatactatgtctttgctattgtgaataatgttgtaatgaacatacatatccacgtgtcttttttgtaggatggtttcctttccctgggatatataaccagtaatgggattgctgggtcaaatggtagttctctgttaaatactttgaaaaatctctaaactgctttccacagtggctgaactaatttacactcccaacaacaatcaacagtttataaacatccccttttctctgcagccttgccagtatctgttgttttttgactttttaataatagccattctgactggtgtgagatgatatcttattgtggttttgatttgcatttctctgatggagcatttttttcacgtttgttggccgcttgtatgtctcttttcagaagtgtctgttcatgtcctttgtccattttttgatgggttatttgtttttttacatgttcagttgtttaagttccttatggattctggatattaggcctttgtcagatgcatagtttgtgaatattttctccaattttgtaagtttgtttactcggttgatagtttttgtttgtttgtttttgttttgtttttagttttttattttttgagatggagtcttgctctttcgccaggctggagtgcaatggcgtgatctcggctcactgtcacctccatctcccaggttcaagcaatttccctgcctcagcctcccaagtagctgggactacaggcgtgcaccaccatgcctggctaattttttgtgttttagtagagatggggtttcaccatgttggccaggatggtctcaatctcctgaccttgtgatctgaaacacctcagcctcccaaagtgctgggattacaagcatgagccaccgtgctggcctcggttgatagtttcttttgctgtacagaagctctttagtttaattaagtcccacttgtcaatttttgtttttgttgcaattgcttttgaagacttagccataaattatttgccaaagctgatgtcagaaagggtatttcctacgttttcttatataatttgtagagtttgaggtcttacatttaaatctttattccatcttgagttaatttttgtgtatgatgaaaggtgggggtccagtttcattcttttgcatatggctagccagctatcccagcaccatttattgactatggagtccttttcccatttttttcatttttgaaggacattatatttatccccatttatagattataaaacagagagtcaggaaggttaaggctacctggtgagtaagtgaattgaccagaattcccaaactcagggctacttaaccccaaaggctgcattgtgattactgagaaatagtgctgatgagacctcacttagtatagtgaataagttatggaccttggaacagaaagttataaatctctgtattttgtttatgaagtttaaagctgtgatttctattagtatggaaattgtcaaacagtgtcatttctatctaatatttatataatgaaattgatattgaacacaaaggtcaatccgtaaatgaagaaagaaataaaatcaaacaaatagaagtatttttttttacttccacataagctttgactactttttaaagccaagggaaataacataatttcttgtactactaatgtaattgggccagaattttttttttttgaatctgagtcctgactatccattcatcaaaaaataaaagctctgtaaaaatagaaactttctaactcaaagaactattcctgatgatgtagctgagtcaaatagagctcccctaaccagccagaataccaaaatggttcctgagggaataactcagtcatcttctagttttacatctctatttaggctggaattctctctaaccccagcctggctaaatcaaattatttctaaaactcctgtcactcagtatgtacttgctctttgttcatttatattaatttattatatctacatattagctcactgtttctctgcctggtggttgcactctctctgttttatgcatctaacacagaaattagcaaaggaattaggcccagggaacagtgtgttcacgtgtattgtttttagccaattttctacgtataatgtagtaggagagttgaggtatctgtcacctcaaaaactagcatcattatcttccatgggtctcacactggtggctacatgtggcaagccaattgcctttttgtggggtccttttattagttgtctactgctgcaaaatgaattgtcccagaacttagaggcttaaaatatcacacatttattatctctcaggttttgtgggtaaggaatctggtcacagcttaactgcatcttctgatcagggtctcactaggctgtgatccggatatccactaaacctgggatctcatctggagacctgactggggaataacgtgcttacgagcttactcatgtaattgttggcagactcagttcattgggggctgttgggctgagggctctatttcctcactgactgttgcccagagaccaccctcaattccttgccatgtgggcctctccaacatgccagcttgctttatcacagccagctagggtgagagtctgctagtaagatgaatgtcacaatgtcttttgatgaattatggaaataaattcccctcaatgttgccatgtcctataagttagaagcaagttacttaaggggagggaaataccaagttgtgaatactagggaggcagggaccatttggtgccatcttggagatatctaccacagcatttatagtggtctgaagggtagtagaattagggaattttgcgtcttgttaataaaaaaaaaaaagactaggaaatcaaaaatatttctagagccagaaatgagtttaaatccctgcttggctacttctaataagtctagttttgggtaagtttcttgacttctttaggtctcctttgggaaatttcttctttgggaaatatgggaataaaaatattggctttgcctagcagttgtaagtatataggaaaagtacctgttggtctcccacatagtgggtgtgagtgtctactgcatgttaatatcccttcacctcccttaaggctacattgagatcagcctgttaggtatctcaaccttgccataaatctcctggaagttctagaaatatgttaagttgtcatgatttttgtaatatcacaccagaaccacacattgattagcccagcattcattacatgattcatggtttccaatcatgatattttcataaaataaaccaaaggactcggatctggccttatagtgtcataagatttttctgctatcctcatgccatggcctatgtgcacaaatagaaatctaagttgccttccaactctaaagtatttgttgtccctcattacattctgtgtactacacagtaattgattactttgtctaaactcagtactacttcctttaaaacaatttttgaggaccattatgtgattaaaagacattctagcctgcttgtcaattatttgcttgaggtgaaaaaaacggaaaaaggacaagtgaaattcatatttgagctgtctgcagaaaccaaagtagcatcagccacgtaccagtaatattagcactggtggcctgccaggtgaggggggatgaaaaaggttgtgcctgaaatgagtgttgatctgatgccctcaactccatgctgctttctaatattagacattttagaaggttgattataacaccaataagaactagacataataagaatttactctatacataaaaattccaatgacagtcaacatgaagaagaaaaaaaattcacccacaaataccatcatggtgacaaagaatcaaagatccatcttctcttaccccaatatgtggtgtgtcttctatttggccccaggatagactgagaaacacaaaaatggatagctgtcatctaataaatgcctgttaaatgatggtgcttacaaaagacagtctctaaaattcctacaacaaccatacaatacagacgctcttgctttctttttctccttccttcccttcttttctttcctactttctcttcccttctcttctcctcccactccctctccttagaaatataaataaggggactgatgagctcagagtgggtaaagatgtccattgccacacagctggctagtgacttcacagcccagaatttttcttcttcatctttccgacttgaagtagaaattcatggaaaaataaatttaataacagaagcaaaatggggtgagagatcaaagtgctaaattgctgtcacaaaactgggtagagacttgaatcaataacagttaaaggattctgatgagacatttcataggatataaagcaaactaggagagaggaggggagcatcaatacatgccagacgcagttgccagacccttaggcaatccaaaataatgagcaacatatctgcttttgataggctcccagtcacgtggacaaggcagagtagtcaaaagatgttttaatgcaatgtgacaagtactatagcaaagatatgaacctagtgaggaacagagcagagagaggaatcctgcagggacacattttggggagtggagctttggagaataattgctctgaaaagagaacatgagaaaccctacaggtcacagacacagtttgcaaggccccatcagcaatgccccactgcaaatgcagcaacctgccatgcccgctttggtctaagcattgataacaaaatggaataactgtttcagaacagcagcagctgagtttgcagctctgtgactgtacttgaagtcactttcaaagccagccccctactcaatgcctgctctctgttcatttaaataacagagataataaagaacagctgatgggcaaagtctggagaagaaaacaggattgactggactgcactggggagatttttaaggagtaacaatgcatcgaacgtgggtttttgcatgtttgcttgtctcatggagacagcttgttaccaactatatttggtaacaagcactactgttgactcatgatttccttaatgccttagtatctatcatgtatatgtttactttgacatcagggcatggaaagttctattcaacaattcctgggtctaatttcagtagttccattctctgtgacctcacaatgggagccagcagccttccatcttgtgatggtgacttgctcttctaggtggagtgggaggagcaccgactatgtgctgggacagggctggcttcaaggtctgcttcagccccttgctggctgcatgactccggcaaatcacttactggcatttgttgtaatgcacatactggcattcattgtagaatttctattctggtggtgatagtcaattggttctttatgcaaacggaggtgatatcaacactgaaaattctgagtgaattgttaaactctggtgaattgctctgtgagtggttaggcaaaattgaagaggactgctctgctggacaggcccaatttattaggccccgctctaaatatgacttttatccccatactttttaaataattagcttttgaactattttacatctgaaaataaaagacagaatatggtaaatatctggctttcccagatattcaatatgtagtactttgaatggattaatttatattaggtcactttaaaatcagcacccaaatttttgcaaaaaaaatatgttgatagatgtatctttgtttaaatgggggcccagggtcagggggtagagacaacaccacactttattcaagaagttttcaaatcattaatcttcctgacttataactataagatactcattatttatgatcaattattttagaaatcacatgaaagttatttggaagcatttagacaccttctcctaaactaagttcgtaatgtcaacctgccccccaagcaattgttgaattcattgatgggagatatatagaaaagaagtgtgttcaaattgtcattaataaaacctcaaaaggccccttcaagcatagaaaggggaacccagactttccacacactccaccctccacacttgtggtgaaccatattgttcttagagaagaatgctaggtacgcacctaccatctcggatgaagcatattctttctggccaatcaccctgaacaaggcctagtttgggttttattaataagaaaggcaagatattaaatagatcacaaggtgcaagctactagtagagggtataaagcaaaatcacaaatcagattgatggactgtggtgactgtttttctctttggcccaaacaaaaatgcggggcctacacaaagcactttattaacctatcaaaaaaaaaatcattaaaaaaaaaactgaaaaaaaaaaactgaattttcttctttctgtaaacagcccttaaaaaaattatgccattcatgtcaaatacgtatctggtgtaaaatcaataaccgtaaaataccatacaagaaaattttgaaagcaaacaaaatcacattatactgtgactatgccatacaagtgtgtcacattggccagcttcctgtacaatgtcaaaaatccatgcacaattgttgacagcttttaaaatgcactttttcaattagaataaaattattcctgggcaaataataaagtttatgaagaacaaactttttctaaatccatgtcagctttacacaagaaggctgatgaagatttatggcagatttcttgcttattctttcttcccaccaagtgcctcttggtgagcaaacttacagcctcattcttccatgggaaaaacagtgtatagagatttggttgctggcctgtaccaagtaaaggcagataagaagttttatgggtcacgagatttagacttggaggatttgctcttggattataaccaaggcaagggaatgaggcagttggaacacatttttttaggttgtctttatagattgtttgctgattaatggccttttcagagttgtaaaatcttctaaggccaatgccagggctagttctgctcttgcttttgctattctaaatacattgtcattaaagttagttattttagcaaaaggcagagacaaacgacttgttttttcattggtttccaactaaaaccagctctcttctttctctttaaagaactcttcatacaaatattatgatctttaaatgtctggtttgaaaccagttttaagattgctccaccaactgaaaataatgccgagtctcagaggcaattatttgtaggccctggttgttttttaaagaagtgtaatcttggcatgcaatgctggatgaaagcataaaattctatgatgaatgtcagggagtcgtcctataagagcaatcctggccttgtggcattttagcaagacactgagcaacatccaccactcaaacacagcaacaaatgctaaaaggacaataagtgtccattctgggttgacaagtttatagtgtccaagaaataaaacgtggcagaatatgttgaaatacaaaaataattagagtataacctgatcttttttcttagcttttcatatcacaatgttttgaacagtggttttcaaccttgaggtggtttttctttccaagggacattttgcaatgtctgcaggcatttttgaatgtcacattttggggggagaaggtgcgatgctcctggcatccagtgtgggtggaggccagggataatactgctcaacatcctacaatgcacaggacagcccagacacagagaattatctgatccaatatgagaatagtgcctaggctgagaaatcctgctctggagtcatcactgagtccacagaaagtactaattatggggagatggggtgtggatatgttttcattggctcagtatatgtgtaaattaagaaaaggtcagaagcttgacatttttcaccttccagtctcttaatggatcaactgttattttagagattaaaaaggaaaaaaaacaccctaggtaagtaatgaatttataatgcagtcatgtcctttcttgttccttgatctgcttccaaagagaaaagaaaggaaatcgtccacaaactgaagttaacacttaattttgtgcttcggttaattaaacagaaaaagaatggcagtcaccatttagggaaggtagtatccatgtcttaattatagatttcctcaaaatgcatagtgctctgggcagtattggttgctctgaggtgctggtgcaaactgtcatcacactttgtgatttatagggtgtgtcaccttcagtcactcagttcaagttccttagctctgtgcttgctgactggtttctatgtgatggttgatcttgtgttgtgagcagctggtttctcttaaatgcctgtgtctatgtttgctacatttctatgacaatttgttcacaccaatataattatgactgcattagcacttgccctgtaaaccacatgattcaggggtttatgagtaggtaataaaaactcacttcaggctgaaacttgtctcagacatggaaccttgggggtggggacagttgtaaatggtcggtatgggttagggccttctgaagtttgtggtcattagtctcatttattgttacccttctacagagccaagactatgtgctgtgggatttatatctttcatcatttagcaaaacacaggacctttgccaagtttcatcagcattcattaattctttcaacaaatatttgactgcctataatgggccaggggcaggtgaacagcccagagttcatgttctcatacagcttctattctagtggacagagaagtggcagggaaggagggagcaagagaaggagaaagggagcaaggcaagaaggggaggaggaaagaagagaagaggaagggaggatgagatggaaggaagaatatcagatggtcagagctttacaaaggattaaaatagagtgaattgtggctactttagaacagtagacaaggacagtctctgtggaggtgacctgaatgacaagtcagccatgtgaagggcatgccaggcagaggcatgagctaggatgctcctccaaggcttgatggacaggaaggcccataggctggtgcagaaagggcaagggcaagatatggcccatgtgatagccaatggagctggggcctctaagcccttctaaacaggggttaggagcttggttttttaaggaggggaagggcatgggctgatttcagttttaaatagatctctctggcaaatgtgggcaggagagggagcagggagaccagttgggaggctatggctgaaatcgggatggcgacattgtgaacttgcttgcagggcctcatttgcaatgtcctttcagggaacagaaaacagctgaggaatgtccaaggagtgaggtgcaggctgatatcctcctcctgctagaagcaccatccacgtgagatcgctgagatcagaagggatgcatggcctttgccaatcagtttgctcatctgtaaaatgggctttataatgcataatctgcagaactgtggcaaggatcagcaatgtatgaaaagctcctagtccacacccagcaataatcatttgatgtccaagcaaatctgttgttaactcatataagcagatcaggtgtccatgactactttccacagatgtgggaaggcaaaatattaccttttaattgctctcaagacataatagaacccattttgtatttgaattgatgtatatggagctattgcagttactgaaataatttatttttcagctgctcttcagtttccaaatcttcttagctcctatttctctcttgcttcccacatttgtaggacttttaatatgcactgcttcaaactgccttccagaaagatagtgccaaatcgtatgagaatgtcctactcctttttttaattgagatataactcacataccataaattcatcctttcaaagtgtacaattcagtggttgtctagtatattcacagagttctgcaactatcaccactaattaattcagaacattttcatcaccctataaagaaattctgtgcccatcagcaatcactccccacttccccgtccctagcccctggcaaccactaagctgctttttgtctctatggatttgcctcttctggacatttcatatagatggaatcatacaatatgtggctttttccatctggcttcttccatttagcatgttttcaaggttcattcatgttgtaattaactcctatttttgaactatatatttatttatatatttcaaaataggaatttgtttgcatagtagttatagtaagtagaacattctaccaatatgtgttattttatcacaagggagaatatgtgttcggtcagtcagagtttattgatttattctcattaccttattggatcttacaactataatattctcttttaggtaccactgcagtattaccatcgacggttttctttttcccatttgttttggagctgtctcccttgttcttagttcattttttcctttccttctttctagtctggtgcagggctggcatactgcagcccacagtccaaatgtgacttgccacctatttttgtaaccaaagttttattggaacatggccatccccattcatttacatattgtctatgtctggttttacattaaaacaataatgttgacttattgcaacagagatcatacggctcacaaagcttaaaatatttataacaagtttgctgatccctggtctaatgtctgactgaggataggacctcagtgtttatttggttttaatcagaatgatttgtgtctcatcctggcttctctgggctggggccgctcacagacagaaccatgaagatgatgaaagcatttgttaaaatagcacttttcctctatatgagagggtaaaaatattatttcaatgaaaaaaagttagaatatttttaatattccaagactattggtaaatgtaactgttacctgaagtattgcaaatatcatattgtaagcacacacacacatgcacacacacacacatgcataccacccaatgacacatgcatgtgtatcaaacttgatggtgggtaaattacttaaaccttcctaaactcagaaatttctgggttccaggagctccagctacaggcttcggtgattgtcccgtttggactcccgttatgatcaggacccacatgtctggagtcttgtagtaaacaccagtcaatttttgttattgtctcttctgcttttctgccagtgccaactgcccccttttatctgggctgagacgttacctcaaagcaacctatttggcttggatgcttctttcttcctttcctcttcaaatttgaggggcaacaaagactttatggtcatattagccatcgtgttttctaaacaaacttgaaacatggtcttgtttaattttttctatttccagatgcctcccttgtaaaccttccccctttgatagcaacctctgtattgacctccttgtagccctggctcatgtttcccatgtgccccattctctttacattctcatcttccccaccagtctttgagcctttgaggaaagagactgttttcttttcccatctgtgctcccaatgcctaatgaagagtgtggtactcacaaggtgctgaacaaatgtcagttgaatgcctgcatgcgtgcacttaaaacttcaagaattttccttcatatatgctgttgtattcacccataacttccttatattaacattgcttttaagcaataatttatgaaagatccagatgtctatcttcagcaaggatattgcctaccctttcatccgtccattcaactgtcattagcaaaacaactatgttccctgtaaaatacacaaaattgtgccaggtcaggtgacagatactacacaaagaatcaaaatacaaacacacgtatatatacatttataaaatatgataagagctcagagggaaaatgatttggtgttgtggaagaatctatatgaagaaaaactgatttaaaattgaggaatgtgaatgttagggtgttgactggaaaagaaaattcagtttagatggttcaaatgaaaatttgttgatgaaggggctactttcagaggtgggtcagtgttaagggaacacaggagagatgctgacttgcccagagacttgcatcagctgtaggaataagggaacagaatgtggcaccagggcttactgagagctggagtcctggtactagtgggaggaactcactcccagaatggcacccaagtaggaaagcggatgaaaatacctggatgtccattacctgcagccttcagattttttaccaatgctgcctaatggccaaacccaacctagagccaagcagcaagggtgctggagtcacactgacacatggggatggggcacacagcaggggagagaggggtggaaaatggataaggaagcagagcacggcctgggcaacatagtgagaccccatctctacaaaaaattaaaaataaaaaaaattacctgggcgtggtgggacccatagtcccagctacttgggaggctaagtctgggaggttgagatatgattgagctgctgcactactgcctgggtgacagagtgagaccccatctcaaaagaaaagaaaaaaaaagaaagcagagcaggaaaggaaatgggaagttaagaaaagcctttttagggtgtgatatttaggtcatgatacgaaacataagagtttagtggtagggggaggatatttccagttagagggaacagactgtgtggaatctctgtgcagggaaaatgatttggggatcactgtggctaaggcaaggtgaacaaggtgagaggatgaggtaggcagggtccaggtcatcgatgccatgtagttgttgaagcaagtttgattgttatccccagagcagtggggatctgttaaagagggctgaacaggaggcaatctgatcctggtgtgcagcagtctggagagaaacagtgagggctcagtcaagggtggggcagaagaatgatgaactcgttcccctataatgtggaatcccccaccctacctacttaggtattattaggccacttccagaaagattgcacagtcatgtgtcacttaacgacgagactgcgttctgagaaatgcatcattaggcaattctatgattgtgcgaacatagagtgaacttacacaaacctagatggtgcagcctgctacacacctaggctgtatggtagagcctattgctcctaggatacaaacctgcacagcatgtgactgtactgaatactgcaggcaactgtaacacaatggtatttgtgtatctaaacatagaacagatacagtacgaatatggtatataagattaaaaatggtacacctgtaaagggcagctctattgtaatcttatgggaacatgtcatatatgcagtccctcactgatcaaaacattgttatgtggtgcatgattgcactttgtcttaatttcactgacagatgtaaaataagataagagcatttattcaagagtagattacttacatttttaatctattcattgtcatataattgtaaattcctctgtagtttagccagcatagactttatttatttatttatttatttatacagggtcttggtctgtcacccgggctggggtgcagtagcgcaattacggctcactgcagctctgatctctaaggctgaggcaatcctcccacctcagcctcccgaatagctggaaccacaggcacgcaccaccacacctggctgattttttttgtttatttgttttgtgtttgctttgtttttgttttttggtttttgtttttgtttttgtttttgttttggtagagacaaggtttcaccatgttgcccaggttggtctcaaactcctggactcaagtgatcctcccgcctcggcctcccaaaatactgggattacaggcgtaagccgccacatccgactgaacttctttatttaaaatctggaaaggatgatatccttagcaaacgatttctaaaccttggcactactggcatttggggcctgataattctctgttgtgggctgtcctttgccctctaggtgtttagcagcattcctagcctctacccattacatgccagtaacatccacccccaaactatgacaaccaaaatgtctccaggtattgctgaaaatccctgggtggcacagtaccccacccccaccccagttgggaaccactgcagtttggcacatacaatggtgttgattttctttttgccacgtgggtttattattttgcacctattttcccagggatttggaattccctgaaaacagagatggtgcttcattcttctccctgactgcatttgctatgaacacaataagcaacatattaggagatcaatacatatttgcaggaaaagtgaatgaacaatgaatagatcttaaaggtgacacaaccatgaacatgggattaggattcaaggaaacttaagtcattctctcactggtgattactctaattaaggataagatcactagaaagagtatggaaggaagttattagagactttccaagctgcataaaatattactattttatacataatttaaataaatccattacactttacaaagtcactaattgtctggattaacttctctagtcagattctgctaatcagtttctctgatctgtatctccttcaactgaggaaatgtgacagctgacatctgagcttttgaaccaaaatttggatcaaattctggcaacctgggtgatatcagccaaaaggtataacatgcctgaatttcagtttcctcatctgtaaaatgatgatggtgatacctatttcaccattaaattaagaactgtgataatgaatgtaaagggcaaattctaaactgtaaagcattatatcaacatttattatcattaataagagtcaatcagaggtcattagggagtcctgtttgatttttatgtcttccttaaaaagttgtttatttttttaagttgtttaacttgcatttatactacattttagggggggaaattcctgttaggaagaaaagtggttttttgcctttctttagatagaagtggtttttgggccgggtgcagtggctcagacctgtaatcccagcactttgggaggcttagccgagaggattgtttgagcccgggagaccagcctgggcaatatagtgagatcttgtctctattttaaaaagaaaagaaggaaaagaagagaagagaagagaggaggggaggggaggggaggggaggggaggggaggggaggggaggggaggggaaagagaaaagaaaagaaaaaaagaaaaaacaaaagaaaagagagtggttttaattttcttaaaataattcttttggttatgcaagtagtacgtggaaacattcttattatacaatattcaaatttaaaaaaatatataaagtagattcatttaaaaaaaatagatccctcattacccccactattactacgcactcaagggaaaccagttttaacagtttggtgtttcagttaattttatatgctttaacatacatttgtttttaacatagctaggattatgtattttctactgtggtatcttttttcagtcttaaaaaattttgccatcattttctaataaatggtaggttattgagataaatatagtgtcccttttttagacttaccagcctattccttgtctaagttaactgtccacaataaacctgtatcttttcctactgtcttagaacagtttgagaacatcatatgtgttgtgtggactctgggagcttgttgaattacacttgtatttttctatttttttttttttactttaagttttagggtacatgtgcacaacgtgcaggttagttacatatgtatacatgtgccacatgtgccatgttggtgtgctgcacccattaactcgtcatttaacattaggtatatctcctaatgctatccctcccccctccccccaccccacaacaggccccggtgtgtgatgttccccttcctgtgtccatgtgttctcattgttcaattcccacctatgagtgagaacatgtggtgtttggttttttgtccttgtgatagtttgctcagaatgatggtttccagcttcatccatgtccctacaaatgacatgaactcatcctttttatggctgcatagtattccatggtgtatatgggccacatttttttcatccagtctatcattgttgcacatttgggttggttccaagtctttgctattgtgaatagtgccacaataaacatacatgtgcatgtgtctttataccagcatgatttataatcctttgggtatatacccagtaatgggatggctgggtcaaatggtatttctagttgtagatccctgaggaatcgccacactgacttccacaatggttgaactagtttacagtcctaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgaataaatgtcttcttttgagaagtgtctgttcatatccttcacccactttttgatggggttgtttgtttttttcttgtaaatttgtttgagttcattgtagattctggatattagccctttgtcaggtgagtagattgcaaaaattttctcccattctgtaggttgcctgttcactctgatggtagtttcttttgctgtgcagaagctcttgagtttaattagatgccatttgtcaattttggcttttgttgccattgcttttggtgttttagacatgaagtccttgcccatgcctatgtcctgaatggtaatacctaggttttcttctagggtttttatggttttaggtctaacatttaaatctttaatccatcttgaattaatttttgtataaggcgtaaggaagggatccagtttcagctttctacatatggctagccagttttcccagcaccatttattaaatagggaatcctttccccatttcttgtttttgtcaggtttgtcaaagatcagatggttgtagatatgcggcattatttctgagggctctgttctgttccattggtctatatctctgttttggtaccagtaccatgctgttttggttgctgtagccttgtagtatagtttgaagtcaggtagcgtgatgcctccagctttgttcttttggcttaggattgacttggtgatgcgggctcttttttggttccatatgaactttaaagtaattttttccaattctttgaagaaagtcattggtagcttgatggggatggcattgaatctataaattaccttgggcagtatgaccattttcatgatattgattcttcctacccatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgggttttgcacattgattttgtatcctgagactttgctgaagttgcctaatagcttaaggagattttgggctgagacgatggggttttctagatatacaatcatgtcatctgcaaacagggacaatttgacttcctcttttcctaattgaataccctcttctgcctgactgccctggccagaacttccaacactatgttgaataggagtggtgagagagggcatccctgtcttgtgccagttttcaaagggaatgcttccagtttttgctcattcagtatgatattggctgtgggtttgtcatagatagctcctattattttgagatgcgtcccatcaatacacttgtgtttttcacaatggcactatcagacaatctaaaaattttgaaaatacaactcgtaggccaggtgcggtggcttacacctgtaatcccagcaatttgggaggccgaggcaggcggattaccagaggtcaggagttcaagaccagcctggtcaatatggtgaaaccccgtctctactaaaaatacaaaaattagccgggcgtggtggcatgcgcctgtaatcccaggtactcgggaggctgaggcaggagaattgcttgagcccaggaggcggaggttgcagtgagccgagattgtcccactgcactccagtctgactgacagagtgagactctgtctcaaaaaaaaaaaaaaaaaaaagaaaatacaacttgtaagaggagttggcattgatgttagttggtgagttcccataatgaaaggcacatagaaaaccgtcaattgtatttgacattcaggttttcaaatctcatatgaatgctgccattgcccattgttggaaagtaacatacgtttcccattcacttttgtgtgaaggcattgtgaagtgtaagttctttggagttctgtatttgtgagtcagtgtgggtatgtaatccctataaaaatctaatgaggtttattacactgatggcagaatatacttaattattaaccaccttaatgtttggtttggtgtggttactttcatgtattttaattttatagctatgtaaaaacgggataaagtagagaactctgaaataaagcagaatgaattgtattttattctttttataaaaaataaatattttttatttgtagcaaaatattgatctattttgaagtcaaaaatttttcatccagttgatgggaaagctgcttttatatcagcaagaatatctttctgccaataggagtgccatttttttttttaaaaaaaagagctacaagtctgtttttaatctcacatttagttaaggaacaattttgatggaggtagaggattgccaaaggaaaatgctttcctgctgctaaagaaatgatgaagcaggcactgtgtttatttttataacaatgtattttgatcctgtgacaaatgtttcaccatagctttaacatttttcctattctaaactaaattgtgtatgttaacattctgatctgtctcaacttctaagaacactaggatgtattgttggtgttgaggacttttctttctggtttcctgtacatttaattcaattacatggttgttgggtgtctcgcatttgcaaagtaccagctagatgctgttgcgtgatagaaggacaattaagccaacagctctccatctgggggaggcaaactcatccccaagtaacttaggtacaaagaagagcataataagttctataagagaattagaaaaaaaggtgatgaggaaaacaaggagggaagtaaatttaaataaggatggtcctgcaggtcttcttggaagaggtgaaaatagagatttacattaaaaaatggataaatttaatagactggtatgaaagtgcgggggttggagaacaaatattcctagataaactgaaaatcttgaaatacggcaccaagatgacactgtggctgtctatttaagaatgtagtaatgggaacagaactcccattactgtactgtccagtatggccagccactagctgtccaatatggctattcagatttgaattaaattaaatacagctaaaaattcagtttctcagtcacgctagcaacatttcaagtgcttaatagccatcaggggctagggagtgtccaagaagtggtggaaagattgttgatcagtgtatctcaaactttagcatgcacctggagagcttgttaaaacaccaagtgctggcacctacccccagaaattctgtgtatgtagttctggggtaggacttgcaattctgcttgtctaacaagctcccaagtgatgttgatgctgccgggcagggccacagtttgaacagtgcttcccaaatgattactgttttaaatttttgattgatcatatactgatacatatatttttcagcagtaaaagtaaattactagaaaaagtataaaaaattattttaaaagctacaaaattttaaaactatattactagattcaacagctgcataattacatctcaataatataatcagaacaaatgtgggaaaaaataaaagaatgcctaggaaagtttcttaatgactactccctatttctctatgtatctccatcatgaaccataccaaggggttcactgaccacactggcccatgggctacactgttgtaatctgaatatcggcctgaggatcctgcacttcatgctgttggtaatagcaattcctcgcatcttttgaggaagaaaatgatgtaatctaaatcataggaagagaaacaaggtggcaatggagagaagtaacgaagaaaggatgctgcccaagccagggagaccaattccaaggccatgacaaaatccaggcaggaggaactaagggcggcagacaggaagggtcagatgccaaacacattgaggtcatagaattaacaggattgggcagctaattggatgtggggtgtgaggaagaaaagagatttcatgatgacttggtggtttcgatcctgagcaattgacagggtggcaatgtcattaaccaaaatatgaaattcaagaagcacctgaatcactttacgctgagatgcagatgcaaattcttttgttatccctgaggccgaatttatgcttcattcatctgtgtggactcgtgtttcagaggtgtactttataagtcattgttccacacacaaaaaagcatcctgatgggtgagtgactcatacacagattatttgcatgtgagatgggcatttaaaatggcaaagataaatgattttcgagcaatccaatgtactgtattaggaaaagtactgtactacttgcagatatagaagtggtccagagttcttaaaacacctttagagctttatagaacaacttaatcttttgatattttgaaaatgtactattgctttacatatggaaaatcatatctccaagaacaactaataacactaatcaaacatattggaatgtattaccagtgatccaaaagatcatcctaaataccacttctttacatgtagaggtgtagtgatggaagtcattagaaagctgctattttaaacccacaaaagcaaatgtgggtttgaaattacctttgaacttgacaagagttatagaatatttggggacttcagcaacaatgaattaatgtcatatgatgcactagaaagactctgagaaatattctcaggtcactaaaatgaatttgctgtttttctttcgtgttcaatatccataacacatttatcaaatttaaacctacaaacagcaatgtgagccctctttctttgaggtcaccatcttaagaatattattttcaaggagcctgcacatcacaaggtatactctggggatatcacttccctaggtgtttgaggcaaattcccatgaagctaggaaaggagattttatttcatatataactcttactccttacacttttttaaaagtggaaagtgcattcattgttcatttccatcactgaaaacccacatattcacaaactaaaggagatttgatattttagaacgtcattttgattaactcaggcaaaagcttgattctctttttccccttcacttatttaagccacttcaattcttaattctcagcttaaactgtaaaccaggggtccccaacctccggtactggtccatggcctgttaggaactgggccacacagcaggatgtgagtggcaggccagcaagcattaccgcctgagccctgcctcctgtcagatcagctgcagcattggattctcatagaagtgtgaaccctattgtgaactgcgcacaagagagatctagggtgcgcactccttatgagaatctaactaatgcctgatgatctgaggtggaacagtttcatcttgaaaccatccccctaccaccacatctatggaaaaattgtcttccacaaaactggtccctggtgccaagaagtttggggaccgcagctgtaaacacacaatctggtgtaaaggaactcagaaatgcattgtcacttctttcatctgtgtttctttgagtctggttggagtcattgcttctcttcttcccaactctatttaaaaatatactcctggctgaaattaatgtttcaacaattagtttagcttaactcccaaaacaatttaaaagatttatctctctatttaggactaagtgcctagatcaagctttttacttctttctgatgctgcctgcagtgtatacaaatacaatccctactttcaattctccacacctccacacccctcccaccatcagagccctggtgatggatagaaattaatgagataaattctgaaagccacaggatggagaggatatctaattttctcagctaatggacacttgaaagactattaggagctgggctcatgttatgagtacatgaataaagaagggctctctggcctggcatggtgtctcatgcctataatcctggcactttgggaggctgacacaagcagatcacctgaggtcaggagatcgagaccagcctggccaacatggtgaaaccccgtatctactaaaaatacaaaagttagctgggcgtggtggcctgcacctgtagtctcagctactcaggaggctgaggcaggagaatcgcttgaacctgggaacctgggaggcggaggatgcagtgagccaagatcacaccactgccctccagcctgggcaacagagcaagactccatctcaaaaaaaaaacaaagaaaagaaaaataggactctctagaaattgttgctcttaaaattgaggcttcccgagagcccagtcttgatcctcacattttactatctttacccctcagcctgcaacatgctccaataacctccaacttccaaaataagcaaacaagcaagtactcatatacctcttcctcaatccttccagctttagccctgttgctcacccagctttcaagagaaatctggttgcattctagaaattatggactatcattgtctccacttcccctaccttccattcactcttctaccttatctggctttcatcccacagctttactggagctacttttgcccacattattgaaaacctgccatattgtccaatccaatgtcctcttctctgagcttttcccaactgacctcgaaatagacttaacttttctgacaattcctttctatctacctcacccaggtttttattatatggccttctcaaagtttcctacctcgccaggcgtggtggttcatgcctgtaatcccagcactttgggaggccaaggcaggagaattacttgagcccaggagttcaaaaccaacctggacaacacggggagacctcgtctctacaaaaagttatccaggtgtggtagtgcatgcctgtagtcccagctactcgggaagctgaggtgagagaatccaccaagcctgggaggttgaggctgcagacagccatgatcacactactctagcctgggtgacagagtgagaccttgtctaaaaaaaattaaaaattccttccacttcttggactgctctttctcatttcttttgcttaccattttcctttgtgaaattatttaaagttgctgttttccagggtgtgaccccagctgctttctagttcttgctagaactagatggaaggtgataaccccttccatccccttggcatctgccatgacctatgtgctgcacactctgaattcaatatgttttactctcgtttggtttgaattccaagtgggtacaccacaggcactcaaactcaacatgtaaaacttaattctttatttctctgtttgctcttgtattagtttcctattgacactgttacagattaatacaaatttagtggcttaaaacataacaagagatccaaaatagcttggcattactgccttccttctggatgctctaggggagaatctgtttcctggccttttccagcttctagtggtcacctgtattccttggttcttggtgccttcctccattttcaagaccaacactaaggtgtctttaaatctctctaactactgcttctgtcatcatatctctttctctaccccgaccttcctgcctcacccttaaaatacctttgtgatgacattgggcccgcctgaataatccaggatcatctttctatctcaagagccttaacttaattacatctgcaaagacctttttgccatgtaaggtaatgtagggaagagaaagaaatcccttttccttctactcttttcaattccaggctgggaccctgttacaagagacacattaacaagagataaacaaacagatatttattaatatatatatatctcatatatacggtcatgcaccatataatgactttttggtcaacaatggaccacatatacgatggtggtcccataagattataatggagctgaaaaattcctatcacctactgacctcatggctgccataatgtcatagctcaacacattcctcacgtgtctggggtgatgctgggttaaacaaacctgctgtactgccagtcgtatagaagtctagcacatacaattatgtacagtacataatacttcataatgataagaaattatgttaccagtttatgtatttattatactatgctttttattttaaagtatacaccttctacttattaaagaaaaaaaagttaactgtaaaacagccttaggcaggtccttcaggaggtatttcggaagaaggcattatcataggagatgacagcaccacgcatgttattgcctctgaagaccttccagcagaacaagatgtaaaggtgtaagacggtgatattgacgttcctaaccctgtgtaggcctaggctaatgtgcatgtttgtcttcatttttaagcaaaaaaagtttaaaaagttaaaaagaatagatttgggaagctgaggcgggtagatcacgaggtcaggagttcaacaccagcctgaccaacatggtgaaaccccgtctctactaaaaatacaaaaattagccaggcgtggtggcacatgcctgtaatcccagctactcaggaggctgaggcaggagaatcacttgaacctgggaggtggaggttgcaatgagccaagatcgcgccaccgcactccggcctgggcaacaagagtgaaactccgttaaaaaaaaaaagaaaagaaaagaaaagaaaagagcttatataataagaatataaagaaaaaaaggcctggtgtggtggctcaagcctgtaatcccagcactttgggaggccgaggcgggcgaatcacgaggtcaggagatcgagaccatcctggctaacacggtgaaacccgtctctactaaaaatacaaaaaaattagccgggcatggtggcgggcgcctgtagtcccagctactcaggaggctgaggcaggagaatggcgtgaacctgggaggcggacttgcagtgagccacaatagtgccactgcactccagcctgggcgacagagagactcgtctcaaaaaaaataaataaataaacaaacaaataaaataagtacgtaacttctccaggcagatttttcctcagtgaaaccttgcctcactccccaggtagacttgacagctcctttctctgtgatcctgttgctccttgtgtgtacatttctttgccctagaaataacctcgttgcaaagcctttggctatttccatatgtatttatttcccagagattttagagagaaggaatcacgtacctttccatctatgcattcccagcacagaggagtacagtacatggcagatagtagctgcttaatatatatagaaagagagtaaatcattggaagtaagcaaataagctggtataccagttgccacattctccacctggaaaacttaactcatttaactgtttattttcctgttttcttttttttatttttaaaacttttttagaaactgggtcatgcattgtcgcccagcctgggactacaggagtgcaccaccatgcccagctagtttttaaattttttgtagacacaggggtctcaccatgttgcccaggctggtcttgaactcatggactcgagtgatcttcccacctgagcctcccaaagtgccaggattacagacatgagccaccacacctgacctctttttctgttttcttatctctcattctggacaataaacttaaagttaaggactgtgtctagtttattgtaatgtaaccccaaagtagcatttagaacactttaggtgagcaataattgtgtgtggttgaattggatgccttttttcatcaccgttgcaagaacttaattcaaataaaatgaaataaaaattgaattctgatgagaagcctgacattggatattctgactgtcctgaatactggaataggcatcaagccttctacactctgtctggattctgtaactaacttgctcagaatgaccttagattaaccacttaatgttttaaaatttcatgactttattttagaaacttgcctgcccctaccttggcatattatcaagatcaaacagaatagtggtattatcaagatcaaacagacaaaaaggcacaaactgctacgtaagagcaatttatggttatgattttgctttgaacaaaatggtgaattgctttttttgtgagttaagactcttagaaacctctcttcatgctgatggagcaggaatagagggcaagccttaatacctttttatgatctggatagtacctataggaattcaatctcttctgtccaactgatgcttgtaattcatggctaagtattcaaaagagaacaggctccctctgttatctacctggcaggagctgtttgtgtaggaacctgaggtttaaaagcctttgaaactattactgattaaattagcaaaagaaatgcctttgtccctgaggtcacctggttttcaatcaatcttaatatatatgctgacattcttgggtctcattacccacaacaaagaatccataagattgctgatcttcaggaaggccaaggctagcttgtagggtcccatttattacaatcccttgacaggtggaaagaatcttacaatacctctgtctgatgcaggggcttcattaatgtctgtgttattctattttataatgcttaatgctatgcttccattatgaggtttctcaatgtgatatctgaaaacaaataatgcattcatgactcaattaatgaacattggatttgaccagtacataaaaatacatggatacccactgtttcctttcccctcctctctccaatgccaagaagcagctaaaactcatctgatttgtttggtctttggtgtctaatgtggagcagtgtctaatgtgaggtttcttggcccatcttcctccttctttccaatccaccttgcctttcccttcccacccaattaactcttcttgcagcccagttaactatagacatttgcttctcatatgcatcctttccaatcacattctcttcttcattctttttcatttccaactcccttctggtgacctttaataaaaaacctttatttgtgcacattcttgctccctctccccctccatctcccctccccctcctccctcgcccctcctttatccctcctccctctttttcattctcctcactcccatattcatcccctgctttactgcccaatgccattcaggatctccaaaaaacccactgattatataatttgcttcttattacaaaacaaagcattctagaactggagaaaaactttaagattatccacatcaaacagaagaggagttagaatcactttatcaaagaaaataaatgctattgagatttgaagtggacttagatataataaaaagccaagaacgccaatcttgaaaactcttgaaagtgcttagaagcccccttcagaatttgacgaaagactttgactacctccatattttcttctgatgaaagctgcttttcctggagtaccagaattcaaggtacattaattttagaaagtattcctgatatattttattttgctgtttttcacaattttgctttttattttctcacagcaaaggctaattttattgttacttgtaagctggctgtgaaggaactttttaaaataatgatttataaaatatatattaggatatactgcagcacctctgtgtagtggcatgggaatacaagtgccatatcagtttggttagcataatcaatacttattagatatgagttatctgtcaagcatagggttagggtcctaggtttctctgtaagaagttaggttagagtcccagacaagcagaagctgggttagaggtctgggcttctttgttagaaaggtacctgcaggactggaagatttttcatggctgtttcttttgagtaggaatttacttcctgactacctgggctgaaaatttttttctggcactttgtgaggtctctctgttttctttatctgatccttcatctcccataggagcttctcaattgactgagccccctttcttgaacccctgctcactatatgctccaccaactctgtccacctccttcttgttggtacaattttgctgagggtaatttggaacttcaatagcctctttgggaaacttaagatctcctcaaattggcacctctaagacctcttctttcttgttacttctgttcctccttctgaaggaacttttaagagtgactctgaaactcttgagcaagtttagcttaattagaacttacatttaagcttccaagatggatcttcccaaagacgaatgctcatttagatatggaggttccagagtgtacattaataatcactcttggagttctgtatcttctttattatttgcatttcatgcaacatgtgttccctgttccgaccaacaaacttaaacctctactcttggcctgtatgtgagctggacctgcttatggcctatatcaacttgactcttcttttttacttatttttgcagtggactaaggtagaagccgcatccttgatttgacaagaggtttccagtaaagcagagcagacttaactaatacataacaaacaatacaacataatttacaaaacaagataaaatgtaaccaggggaaaaatctagtacttaggttcaaaaaaagatcagctgcacaacagcagaatcagagaaagtttgattaacatcagttctagtgaaaaatatgtggcagtatcagtggaacgaaagctaagataagacacatgtcacttgggaaccaaacaggcgctgcattaacagaattatagcactaaaatggaaaatactaaatctgctcttctcttcattggtcagaacgcaatggttaagggaagagaggtaagaaatagccagatttgaaacacacaaactcacacatgcacacacacataatggctctgttaattcatcaaaggcaatacataaattttctgatttattttttaaatggcatttagagtgttccaaggactatttaaacagctttaacagaactattccaccttagtatctgataataggttacatgtgcatttcctatacaatctatttaataattaataaagcacattaaatacatttagaactacatatttcattatcaataatcatatcagaattacttttcagtttaaactaaatttttaaaatattttaatgtactttcatttacagttatctttcagcatttttagaagttttaaccaatttatttttttaatccttcaagtccaatttcatacttatagttaatatattttaaagatgagctaccactcatttaacccttcatatgtcccttctggccttccaaactcccttttcactactttatatgattttacctctcatgtcaaatcattcaacatatctcacctacatatgtattatacatatatattttttatttatacatatatgtacagatatataatcaaatcatatgatggaattgttttagcaatttgttgctttttgcttttgaatttaaatttaaatatttaatataaattttaactcaattgttatttaaattcttatttatttgatctatttttgaatttgtatttaaaattttacttgtacttatttaagtttaatttagtttaatttaatttctatttaattttttttcattttttaaaaattttttatttccatgggttattcagggaacaggtggtatttagttacatgagtaagttctcaagtggtggtttgtgaggtttcagtgcacccatcacccaagcagtataccctgcacccaatttgtagtcttttatccctcacccccttcccaccctttccccctgagtccccaaagtccattgtgtcattcttatgctttttgatcctcatagcttagctcccatttatgagtgagagcatacaatgtttggttttccattcctgagttacttcacttacaataatggtcttcaatatcatcgaggttgctgcaaatgccattaattcactcctttttatggctgagtagtattccatcatatatatgatgaaatagatatatatacacacacacatatatacatatatatacacacacacatatacacacacaccccacactttatttatccactacttgattgatggccatttgggttggttccacatttttgcaattgcgaattgtgctgctataaacatgcgtgtgcaagcatctttttcgtataatgacttcttttcctctgggtagatacccagcagtgggattgctggatcaaatggtagttctacttttagttctttaaggaatctccatagtggttgtattatacattcccaccagcaatttttattccatttaaacatttaagttttaaaatttttggattgcttaatatactaggaaatgactaataatcaattaaaaatagataaatgtggccgggcgcggtggctcatgcctgtaatcccagcactttgggaggcccaggcaggcggatcacctgaggtcaggagttcaagaccagcctggccaacatgctgaaacccgatctctactaaaaatacaaaaaaaaaaaaaaaaaaaaaattagccaggcatggtgtcaggcgcctgtaatctcagctactagagaggctgaggcaggagaattgcttgaacctgggaggtggaggttgcagtaagctgagattgcaccactgcactccagcctgggcgacaagaatgaaactccatcaaaaaaaaaaaacatagataaatgtgaaaaaatagaaagcgtcgtttaaaaccatccagacagcaacagaagaaattgaaaaaatcctgttacatataaataccaatttgaggggatgcaaaaatagttttccatatgagaagtttatacttctcttttgccagacttttagcatttttaggattcttctgcctactcttaatttaccttattttgagaaactatatattagtcactaaaatacaacattccacttaaaacaattaaacctacaataggtagactcagtgaatttggcttcttgcaacatttgcttttgtccaattggcttccttgcctgaaagctaggtagaaatcctactctaaggctttcaagtataaaaagaatcttttttttttttttttcttgagacagagtctctctctcacccagctggagtgcagtggctcgatctcggctcactgcaagctccgcctcccgggttcacgccattctcctgcctcagcctcccgagtagctgggattacaggcgcccgccaccacgcccggctaatttttttgtatttttagtagagacagggtttcaccgtgttagccaggatggtctcgacctcctgacctcgtgatccacccgcctcagcctcccaaagtgctgggatttacaggcgtgagccaccgcacccagccaagtataaaaagaatcttaaggaagatagttctgagccactttccacaattttaagaacagataaaaataaatagctaattataataaaatgaagaatttagaggagctgtgcagattaatttccctcataaggaacacgaatatgaggcacatgattgatgaaagggacatttctcctgggtcttaaaactaattgactacctacgtaaacactagccttgatgagtttagtcagaaaactataacatatttttcaataggtgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactaatggactacctacgtaaacactagcctgtgatgagtttagtcagaaaactataacatatttttcaataggtgatcttccaatgaatagataaacttttgcatgccttcttaagatggtaaaattagttccctggtatatacactggactcaccttctgcattgcatcacctctctgagatttgcccaatttggggtccaaagtgcaaatgacctcagtcccctcccagaacaaaggactcaacaacttggcatccctctgaaacacagagtgaggagccagtgagtgaagccattgtgtgaagcaggtcctcaaagactaattcaatttgaagaaagaaaattaaaaacaggatagagtgttacatgaatgggatcaaccttaagatccttcttcataagccaaatctcactgtttttagtgtgttctccacattaattcatgtagcagtggcaacgtgcagtttgcagtctgagggaagagatgagggcggaccctggctgacatgttgccatagagatgacatttgagcttctttggagtggcgaatctgattagtcagttcagcgtttcccctcatttcacttcattacacaggaaaagaaactcctaaaaagactgtttcatgtgtatttgtatttgattaaaatataaatatttttcctgccaattcatggagggaaatggcaggacagtcaaaagctcagcagtatcatctcagctaagagcttacacaaaaatccgtttgccctgatgccacaatgaattgaaacatgaaaccaacaagtagaaacaaacagcatacttcatgctagagtagtcgtcactcaattatccttgcctccttctgtccaggcggtatgaagcctcggtgcaggattcaaagtctccagatatttgccttgatttgttggccagctttagttaatctttttattgaaaagaacaggagtgggaaaagaaaatgagggagttaaacgtaatctttgtttgcttagaaatgtgtttgttgatggccaagccaaattgaaggtatttttcagttcttgtgtgcttctttgaagaaaagaaagaaaaaaatgggtcccagtggaaatgggaaatgctttctcatagaaggagctttgccatctctgtgtttccgagggcatacaacagtctcaaggcacagaggaaagagtgaggacagagcttgcttctcccatgtctcccatctaatgcctttgtttggtggccctgattgaataacacgtattagtaaacagccagtagatggcactatatggtttactgccacatagagagcctactgggcttttttttttgtttggggtttttttgttttgttttttgttttgttttaaggcggtaggataaagagggtttagctcttattttcagcttactagcctaagagctatctgactatcaattctggctgttataaagtgccatcatgggttatttggatacattttctaaataggcagagcaggaaagaaaaaagtaaagtaatatgcctcttttaacaattgcatgtcatgatattgtgtagcatagtcttggtatcattttcaagtttttgtaaacgatagaaaattagacaaaaaaagtagattccacactttcatgtcccctcctacatgtgtgcacacccattcacacatcactgttggacagttctcagaagtttgttgtctccatatactttgttttgtggcaccccattactcatttgctcaaacagaaaaggaattcatggaggtttggagccgttgttatataaaaactggcaaatatggtggaatataccctaagaaactaacagaaggggaagaatatataaataaccctgccggaaatgtcctccaaagtttatgccctggatggagagttaacactgcccccaaggaccagtcctggccatttcaccactggggaaagtgttctttctctaaaagtgaggaggagagtgagggtcctttcagaactaatattcttgtattctgttgaatggtaactgagcccccattgttttatctgcccagagccataaagtcctttgtcctagaggtaaatgaggcatgcagagttggctccagaaatcatgtgactttggaaccagtgacacaagatgataagatagggactgattctatatcctcagcatcctactgcacattgaaagtgacacgcccttctgacacatcacctttgtttaatgagaacattatttcttgattgccaaaagacaaatttagctgttattcataattttttaaatgtctaagactggcattcttattttcttgttctttttttttatttagaaagggctatttacagttatatagcctttaaatctacattaatttattatgattataaaatcaagattttcctcaagcttttaagttcaacttaaaaaaaagtttcatttttctgcttatattaataataccagtatcttttatatataataaaaacaactcgtttcacagagggttttgattagagttaaatttgaactgaacaatttaaattcaaacaattgctctcatttataaacttaattagcaaaaattctttatacatgttagtgtacatttataaagtcaatatattcagttttctgtttaaccattcaagtatctgtctagctgggcaaacgtacaacccacacaagcaaattctttctagaaacgtaaacaacttttataaatctaataaatacattgatttattcaataaatatgtatacttaatttcattactatttaaacattaaatatttcaatttattaccattaaaactcttaaatatttagattttgccatttaaacttttaagtcttctagcttattaaatgttttaaatattcatacttattgagagaattgaaaggtcacttaaagagtccagtattatttaccaaacagtaaaatcctgttatatttttcaacttacaatcacaagcctaaaatcaatttcacatttaaaattgaaatcaaggccaggcgcagtggctcatgcctgtaatcccagcactttgggaggccgaggcgggtggatcacgaggtcacgagattgagaccgtcctggctaacatagtgaaaccccgtctctactaaaaatacaaaaaattagctgggcgtggtggcgggcacctttagtcccagctacttgagaggtgaggcaggagaatggcatgaacctgggaggcggagcttgcagtgagccaagaccacaccactgcactccagcctggtggagcaagactccatctcaaaaaagaaagaaagaaagaaagaaagaaatcaaaaggctaatacatttaatcatttgacaaatatttattgactgaatgaatatgcccattttctaatgagccaaaatctcttaaacattaaaaatgttttcaatcacatacccagtttgtccctatgattactaaatgtctttctaaatttaaaacaaaagagttagccctatgaaattcatttattgcctgcattgaatttccattacaggctgactgaggatgctaacatggagccttatgggttagatgcttagcctaaaatgtgggacatagaggctgctctcacccaggttgtgtgccctgagccccagaagacatcttcgttttagcgtcactgtgtcaacatgtgagtccaaatccaattatttacccaactatttttcttttttttttttttttgaggcagggtcttgctctgtcacccaggctggagtgcagtggcatgatcatggctcactgtagccttgacctgctgggctcaagcagtcctcccgcctcagcctcctgactcaggcacatgctaccacacccggctaagttttatactttttatggagacgaggtttcaccttgttgcccaggctggtctcaagttcctggcctcaaatgatcctccaacttctgcctcccaaaatgctgggattacaggttaaagccaccatgtccagccctacccagttctttaatctgatttgggttgaaataagtcagctttcttcttattgtgtttttggcaaaatattttaagaaattttgattcttctcatctgcctctaaatataatttgaagtcatcccattgtattctgaagaaatctcaagtccttgtttggtttggttctgtgtctgcatggaacattcccacatgaccacatcagccggatccttggatatgttgctcctatagggaggcttgtgctctccagttcaccatagaccaccacccccagccccaccctccaggccaggcttggcgattatcctgtgcattgtaggttgcaggatctgtagtagtcccctacatatcctctacccactaaatgatggtagcacaccctctccagttgtgacaaaaattttgctcctggtgagcttgagatgaccaactgtctgcccaagacagaggcagagccgatggggcctttgtggcacgattgttggtctttttcttatgtcccatcagtaccctcagggctgcaccctgcctgtctccccttgggtgtttgagtgtattctccctgctcagaccctaaggcaagaggttctgtttctgagatttgagcttcattttggttttggttctttctttctttctttctttctttctttctttctttctttctttctttctttctttctttctttcctttcctttcctttcctttctttctttctttctttttctttctttcttttctttctttctttctttttgtcttttagcatccatgatattagacagcatacttcctagatgaaagagttttgtgtcagcttttagctttttattaacaattgttacacaaattctgcttttaaaaacatccgtttattttcatatggtattgggaagtgagcttttaaaaacagtgatgtttctgcacatgcttattgttcaaaccaggactccagtttcacatgaattttttgactcactctttacattaacagtgataaactagaatttttaaaaagcccacattggcaacatttttggctataatggtttaaaaccaaaaataataaaaatatgagcagtaaaagaaaagagccttaaaaactgtgaatacagacaagctaaaagatgaaaggaaaccccatggcttgatcaatcgcatgctacatgataaatcatttcttctggaagacagaaggaacctgcattgtgcctcacaagaggaatatactgcaaagtctagctttatctctgaataccagcctttgaaattaagtacagattaaattacaccataaaatcaatgtcacactgtgagattgctgaaacccatcttggtaaatgaaacctttttaatgatgaaaacctggaaaaaattcatcttgagctagttcactctgcagaaggcttaatgctatcatggaggtcttcacaagccattctccaacatctgcacaccaaactgggctcacacatgaatacttctttagcatgtctgggcagctgggtgagtgtgaacctggagagtgtgcgttcctttccctaatatttttcttatgggctgagcatgttagttagccagtctccacaagagtgaaccacagtaattattgggtttgtgtgagagcctgttaacatgatgagggctaaataaaaatggtgtatgagtatgccttcattataagctttcagaagccaaggagaggttctacagaaaagtccgtgggaaaaatatatattaccattgatattcctgttgattactatttagaaagcaaaaagtgtattgtccaatatggtcaccaacaaaataggatggcatagcatgcaaataggtggaaataccattacatgggtgccacatagacccaatgttgacatatgtagaaataacagaatgaaagtcctacagagaacaattagacagaaattaaattaaaccagcctgccaggcagaatttgtgctaagaaattctgttctgtaaatgttgagaaacttcagaccatgaggatagatacaataaataaaatctaacctttgattatcatacacagagctttaaaaaaaattctaaggtttaaaagataaacccaagagatatttacatgaaatgtaaatattatattaggaacatatttgaactttagtgtggctaattttattttaatatcatcattatttttgtcttagagtttattgtttataccagctgtcggtgaattatagaaaacagccatgtaactagtcgtatgtagaaacctgaaactggatcccttccttacaccttatataaaaattagttcaagatggattaaagacttaaatgtaagacgtaaaaccataaaaaccctagaagaaaacctaggcattaccattcaggacataggcatgggcaaggacttcatgtctacaacaccaaaagcaatggcaacaaaagccaaaattgacaaatgggatcttattaaactaaagagcttctgcacagcaaaagaaactaccatcagagtgaacaggcaacctacagaatgggagaaaatgtttacaatctacccatctgacgaagggctaatatccagaatctacaatgaactcaaacaagtttacaagaaaaaaacaaacaaccccatcaacaagtgggtgaaggatatgaacagacacttctcaaaagaagacatttatgcagccaaaagacacatgaaaaaatgctcatcatcactggctatcagagaaacgcaaatcaaaaccacaatgagataccatctcacaccagttagaatggcgatcattcaaaagtcaggaaacaacaggtgctggagaggatgtggagaaataggaacacttttacactgttggtgggactgtcaactagttcaaccattgtggaagacagtgtggcgattcctcaaggacctaggactagagataccatttgacccagccatcccatcactgggtatatacccaaaggattataaatcatgctgctataaagacacatgcacacatatgtttattgcggcactattcacaatagcaaagacttggaaccaacccaaatgttcatcaatgatagactggattaagaaaatgtggcacatatacaccgtggaatactacgcagccataagaaaggatgagttcatgtcctttgtagggacatggatgaagctggagaccatcattctgagcaaactatcacaaggacagaaaaccaaacactgcatgttctcactcataggtgggaatcgaacaatgagaacacttggacacagggtggggaacatcacacaccggggcctgttgtggggtggggggaaggggggagggatagcattgggagatatacctaatgttagatgacgggttgatgggtgcagcacactaacatggcacatgtatacatatgtaacaaacctgcacgttgtgcacatgtaccctagaacttaaagtataataaaaataaataaataaataaaaagggcaaaaaaaaaaaaaccagccatgtaaatttctatacatattgtctatggttgcttgcatgttacaatggaagagttgcatatttgggatagagaccatgtggcccacaaagcggaaaatacgtactatctgaccgttttcagaaaaagtttgcccactcttggcaaaatcatttgacaagcctatctaaactaagatcacttctgtggctacaacataaaggaaagtaaacgtcttgctgttgtcattgcttcctacacagtggatcatgggtttaaattaggaagcatctcacttatatctgatacttatttgtgggattttatggaggataggggagggaagagaacatatttaaggaatacgtttagtgatctgctctgcttgattttccttcaaaagaactttgtgtttagaggccaggcacagtggctcacacctgtaatcctagcactttgggaggccaaggcgggcggatcgcttgagctcaggagtttgagaccagcctgggcaacatggcaaaaccttgtctctacaaaaaatacaaaaaattagccaggtgtagtggcatgtgcctgtggtcccaactacttggggggctgaggtgggaggatcacttgagcccaggaggttgaggctgcagtgagccgatattggaaaaaaaaaaaacacacaacaacaacaacaaactttgtgtttgtgtttggaaatgtgtccataagatggaaatgtgtccataagatgaaacttgtgtccagagcagtataaatagctcagtgggtctttccatttttggtaaatcatccttttggaccctgggcaaaaagaatggtagactttatacttgaatttttcagaaggcaaggaaaagcgaagagttatataagtaaaaccggaagaaaatgagcaaaacattaaaagaaataaaagaaaaaggaatacaaataatgacccaagtattaatagactttctctcacagattgtactgaataaaaataatagctaacatttatttgttgttctgccatatgctgggtagatcacatactttatccatggattcctacccttcaaggtaaatattgtaattattgttttacagatgtgcaaacatcgaagttctgaaagataagggaattttccctctctataaatatagagtcatctggctctgtagttaaagccaatctatttctattatgattctcctaagattatactgagtaatattaacgtatcattatatcaaatttaaaactaagctaatgaaatgaaccactaccaatcaatgctgtaaaccaaacccacctgatggcgacttaatgctgtatcagttacctaattccccataacaaactaccttcatacatagtggcttagaaaaactatcacttatgtctcccaagtctaccaatcaactgggtgttggctaacctgggcttggcatggggagagctttactctaagtccttgtcatcctcctctttgtatggacaggctagcccaggcatgtccttcttatggcaatagcaaatttgaaagagaacaagtgaaaacacataagacctcttgaagccttggtttaggataggtacactgtcacttctgcttcattccatgggccaaaacaagtcatgtgaccaagacaaggagcaaagaagtacaccctgcccacagtgtactgtggcaaagggctgagatacagggagaggtgaaggattggggccaatcttccagcactccagtgtacttggtcagagaacaaaactttattggtacccagttgaatactgcatcattgattaaatttaaaaaggcataaacatttgaggaaagcagcatattcttcacctatagaaaattcgttagtgcacagatgtgtgtgtatgtgtgtgtgtgtgtgtgtgtaaaatgaaggagctgaacatgggatctacatagttagactctcttaacaatttacttaaatgtattattagccttacattttggtaaaaggaatcatctccttgctgtctgttgttctgagtgagagataatggttgatatcagctgtgtgataagataataacttcctgctgttctaaggcactcatacagtcattaatagaaaataaagtaatagcatagaaaataacatgatagcaaagcttagacaattcatttcaaggcgggaggtatggattggtttaaatattctatagattctacccagctggaagagcaagcaagataattacggacttgtcacagtgattaacagacactatggcaatgatggggtttttccgttttgtttttgtctttgttttgttttgtttttagaggcagggttttgctgtgtcgttcaggctagagtgcagtgacatggtgtaatcatagctcactgcagcatggaactcctaggctcaagcaatcctcctgcctcagcctcctgagtaactggaactacaggcaggcaccataacatccagctaattttttatttttggtagagatggggtttccttatgttgcccaggctggtctcaaactcctggcctccaacttctgcctcccaaagtgctaggattacaggcaagagccactgcaccccgaccttgttttgttttttgaagacaaagacaactccatattaatacttcccctcgcaagttatacctatgcaaaagcatgtttatgagatgtttgtggggacagtataaaaaggaaatgtaaaattttcattttctttgctatctgagacatatccaagaaaataaaaggcattttacagttttggcataaagaatgtaagtgatattacattcttatatctttagagagagggggattcaattaagcaaaccagcagaagaatgaaaagagaaacgtgagcagtatatgcagtaaccattgcagaattggcacaattgtagatttataaaaggcagtgtgctctcttacttccccccgagtgcaagccttcacctgcccttgactgactatccaggacattgtcaggcactgagcattgatctatcacaggtgtaatttgtgatcgacttgatgcaatgtgtttaactccaaaatcagattggttggaaaaaatgcttctcagaacggtatgaggatttcatcaacaaagtttatgtgtacctggaagagaggcttgtgcaaagctagcagcgactatgcgagagagtccgctaggagaagatcagtgtcctcaggagtcagcggacaactccaacccagattcccatttggcctcttcttgcctaatgtatcaagcaactgaattcactcgcttagaaaattttttgtatctgtttgtaaattgtgctttacaaaccacacaggcatttcttatgctagagaacttgagtgctgaattgtccctgaaaagaggagttgagaatgggaacttgtgcaaatgaaatgggtgcagattcctgtatggggcaggcaacacagtgatgtaaatgacagaggtggctaagaaacaaatggggttgggggagtggcggagggtggggtcagaggaagaccagggaggcagtgaagaaacatcagggcactccctccccgtcccctagggagagagaagtcacaggcgctccaggtgagcagaggaagaagcatcctgctgaaagtggcatcacaaaggggaaggaaggaagattatctcacccgtcactggcatagatcaccagaagcgtttctcatctcacttcactttgggaaccagatttgtgcgcctatgtgatcctctttccaactccttcccactgcaagagaaagttctgaaaataattagaaccacttggcccactaccaagaggccccacatcaaagttgtgcctcagccctgcgtcgccagcatttcctcggtctccttcaaatgtgaaactgttatgcaaaattgagtaacagcactcgcttaggactaaatgtcttcaaagtctcattctatggcaatatcttatcacaaatctccaaagtgaaattactagcaagattgcatgagttcagctataccttcagtgcgtaataatagcatacatgcgtgttgtcaatgtccattgaaaaaggagtattttctatttgggacctcctgataaaggaattagtgttttacaggataaaagactcaaaataggaaagtttacactgtgggaacataatcatttgcctgccggtgaaaaagcaataaactgtgttcagattttaaattgtttgcttcatttgcttgttaaattgatataatttctaatttgtattctttaaatttttgcagcttttcttgaagcttacaaacaagacataaaatcccttttagttaaatttggaggagagcaacacagaaaaagtactatttaaaggccgggcgcggtggctcaagcctgtaatcccagcactttgggaggctgaggtgggcggatcatgaggtcaggagatcgagaccatctctctactggtgaaaccccgtctctactaaaaatacaaaaaaattagctgggcgtggtggcgggcaactgtagtcccagctactggggaggctgaggcaggagaatggcatgaacctgggaggcggagcttgcagtgagccaagatcacgccactgcactccagcctgggcgacagagcgagactccgtctcaaaaaaaaaaaaaaaaaaaaaaaaaggaaagaaaagaaagaaaaagtactgtttaaagactggtttcaagaaaacatggagtcatttggagacctgaaaaaactctttgtcagtggcctacagattcagatgagggtaataaggagaacaaataaacctatttagaacaaggacactttctatctgtcttgatagacaaactagttttaatgcaaaatataaagtgaattatgaggccaggtgcagtagctcacacctgaaatcccagtactttgggaggctgagacgggcagattgcttgagctcaggagttccagacgagcctgggcaacatggcaaaaccccatctctacaaaaaatacaaaacaaaaaaaaaaaaaagcagggcatgctggcatatgcctgtagtcccagctgcttgggaggctgaggtggaaggataacttgagcctgggaagtggaggctgcaaagcggagatcatgccactgcactccagcctgggtgacagagtaagaccctgtctcaaaaataaataaataaataaataaataaagtgacttatgagaccaattgatgtacattaatatggtttaaaaccattattaggattaataaaattttgagttgtcttcaaatctgtatttaaattattaattttttctggtacatattgagttagtaaaaatagaaacccccctttataaataactacgttgttcagaatagcacatgtaagcagaacatttatttctttatttcgatagagttccatttcctgttgaaaagtaaaacccaagaaaaagaacatccagcttaaactatgtaatactttaaaaagtaagagttcagatgtaaagtttcaataatgaaaaagttcttttctaatgagatagtttcagaaatacttaatttaatccaaaaaaaatgacttttaaaaattctccacacttcttggaactgcatgcataaacctcagcaattgcagcaagtattcattttagttttcattgatgaaacaacttttcaaaagatgttccatcccattgatcttgcacatggagatcatttaaaccccgctttggaaaattttcctaatgatgcttgtcaatattttcctgatggcaatgctagaaatttcacattttgccaccactttcatctgcaggtgacagatgcacacatccattatgtggtccaataaaagagaatcattttcatctgtcaactcggtaatccaatttcagcaaacctaagctgtgctagtgcagtgtgttggatccaagtgtgatccttgcactagcagcagcacaacctggacacttgttagaaatgcagattctcaggccccacccagatttactgagtcaggaattctgacggggtcaaacccaacaatctgttttggcaagccctccagctgaggctgatgcccaagttcaaggaccaccatgctaagatgtctgggtgcatgcagggagcaatgaaaatgctatggagactgagacctggtgctcctggtattcatgtcatagaggtgattttaatttgggaggttttcaaacatggtgagagcaccttcaatttcttaggacaacagagaggtaacatggcaatgcaacttgggtccaatgcccgggaaagtgctggcagcctttgcaagtgaattctgcacacttgtcatttttagcttatctggaaatctatatatgccacctgagctttcagcccacaacataaaggcctgactttatatctgatgaatccctcttctctgcaaaacctgtatgttttcttccaggagagtacattgccacaagtgtatgctgcattgtttttcatgttctttctctgtgtgtttgagtgtgtgtctatctcccccttctgatgcatacataagtgactggacacgtagccttgacccgagcttgtgtgtgtgacttcacatggtaggaatgtctgtgaagtgagggagttggactggagactcccaaaggtcctccctgcttggaaatgctacaagtccacatgccctacacgattgtacttgtctttctttgttcactgtaatttagcatattaattagataaaatcaattcaaatactccattcgaaatgctctcagaattaaaagctccttatgaaattgcctactttgctcctaacatgcaatgtctttatttctaatttcattgctcgcttgtgtatgattacattacacttatcaaatagagaaacttatttgaaaacacttgcataaataagtagcatgggatttttttctccttccaaaggagcttaatttatatggactatagaaatgccctgtcataagtggccgtatgctatatgctcttaattttgcatgtccatatgaagctgtatgtgtgcatatacagagaaatgtgattatgtcctggatatcttgttcatttcatttcttaaggtggtgtcatgtcaccaagaaaattagtgatagattcacatcacagagtagaattctattcattagatattttttgcaaagtgcagcttcttttcttgcttcctcataagttgtgagcatgtgggcgggcaagcacaggaaagcatttagcaacagaaaacagaagcaaactgtctcctttccaccagtttccccacctcaattttgttctcatatttctttacttcagtgggccatctctgacattctaaactttctggaactctttctcagttccccgggctgttcttcatatgcctctgtttctctgaaggctataaagagatgtgctcacaacaggctcccaggagtccatggggaaattgttgacattctttcccgctgaactaggttggctcgctccacatttcttagttcatttggaattccacagctgccacctgagcttttatgctgtcgataacgacccctggcttggggggtggtgagattctgttttagtcatgctgtagtctgccttttaccaaatgtctttgccatgaagtagggggtaaatctgttctttttcttatgcttctcgaggaatgacagataactccctttgctacatgaaagcatcatctgacatttaatttgtttggtttttacaattcatttttccattctcattgccaggttagttactatctcccatcagcaactcttgaacaacaacaaaaaaaaaatctatatacgggaaaatgaaaatgtttcaatattcttcagtttttctacttttgttactgttctagagagggaggtagatttttgttttctgcaatcttctccgtgaatcacttttacttctctatgtcttaacaggggacatatttgaatttggactttgcttatttttccaaagcatctctgtttaaatcatcaatctacaaacaaacttcaaccacagtccaacttataactagctaaataggatttacactaacgttttcttgcttatccccttatatcaatgtcactgtaggattactttttcaaacttttcctgcaagttctctggagttggactgttggtatgagcaacagcctggtaaaaatcacatatcttagaatcaaacttatacgaaaacatattttaagggtaatataaaacccaacattttcatatgtttagtgacaactttgaatttagctacctagcaaaacaataaaaataagaattatgtttaatatattttgcaactaaataattactgtttttcaataacgagacttttcacttgaggtaatgtgaactttccaagggaaatgttccctagaccctagactgatcatggagattgcagggccatagaaaatggccctctggtcccacacacccggctaatcgcatcaccatcatacagtgcacctcgctcactcgggaaatgaaaacaagataaagcaggagggaaggcttaattgatctcagtctctctctgtttgggaagtgtttattttaaaagataaaatttcatttcagggggtcttacgagataaaattcaaatagaaaaattgtcttcattgcttcaacagttatgttaaggttatttacaacagcatttttttcccataaaatatagcagagtacatttttcagtgagaaaagctaacatttgaacccacaacgtctgaaggtattctgtacgttttatctctggtggcagctgatgtaccagcaggctgacagatgacaaaaaaaacaaaaaacaaaaaacaaaaaaaaactctcttgtctattcttttctaataagacaattcagtggaaataagagaactcacctgatccaaaaatgtcttcagttcaacaatatctctcttcaggaattcagcactcaggcaaatattttatttgccctcataacaaaacaaaaacaaaaaccaaaccaaccactctgttcttctgaacttttgccaacttaaatatctctttcaaaccttctctatctgcttattcacattaagctagaactacaccatttgtacagcttttcaggagatttgtgacaggtctgaaaaggatttgaattttttacttggacttttgacaactcccactacagaagttattgtccaggttatgtggcttagtagcctaaaacttcaaagggcttcgcttagtcaaaattacttaaataccctattttattatttttataattgtagcttttaaaaaagattaataccaattttcaacatgcttttagcatccagtttgccacctaccaatacatgcatcactattttctagatgtggatattttggggacacgatataaaaatattttacaacttttttgaattttccccaaagttcattttcaaactccaggcagagagaaatgtttccgaattagtcatttttaaaatttttttgagcaagcctatcttttcccaacattgcattgctttttatcctgtgagattttaaacacctttcatttaaatgtttttttttttgaagtgtgcactggatgtgtctaatgaacagtccttgaaaacagaatcaccttatttataaattcaattctctttccattcatatgaggaactttatccttcctcagggcatatatttaataactattaatgaaatctgaaattatatatgagcactgagacctgaatttgctactcattttttttttccagtggaaatttcataagggttttggcatgggaacacagcaggcatttaaggcagatggaataatatggttggccacaatggctccgaaggaatcataacagtttataatcaataatttgcttactagggaagacagtcttttcagccaaatcagcacatagcatactgttcatcctcccagttagacagccgactactgccaccgttctgcaagcctttgattcccatggatttacatgtgcaagctgggggctcagtgctcatttgttttgtcttttaagatttcagtttccaccctccccttttcacatgtcttattccaacttccccttaaaactgcagaagccatttgagcaaacagggccacagggaccagattcagcaggcaccctgccttcagaaagaggcaggacttcccgaggaggagggtccatctcaactggttttaggccagagactagacggaaggggatttgcacgacaggtaggggaagggcctttagaatttcagatgtgttgtaactgggcaagttaatttcagatgtgttataacttgaaattagaaaagtcatttcaagaatttttttaagagaaaaccatagtagggtcaagactctgagagatgaggtaagcaagagaggtagaaaaacctgtcctcacctaataggctacactacagagcaacgtcacccttgagtaccagtttccatgcaggggatggagaaatctggaaaataaggaggccaagaaagaaggtatctaggcagttggcttccatgggctcttgcaggattctaggcaaataggctatttggggctatctaccagattgacaatgctttatctaccagaaagatggccctgtattttctcatttaatcctctcaacagttctgtgacacaggtattatgattatcccattttttaggtaccaatgtgaggcacaggaactctgggtaacctgcctaaggtgtcatagcttttaagaattgagtaggattcgaagtaggtagactgacacaagaattcgcatgcttgccccctgcactatacttcttaccttggcttctttggagtaaagaaaactatttccaaactctgctggtatgtgaagcaagtttccttacaagagaagctccctggcttcctatgacttgaggagaggagtggacactgtggagaggtgagcatgttagtctgtttgcattgctctaaaggaatacctgagactaggtaatttatagggaaaataaatgtatttaggctcacagttctgcaggctgtacaggaagcatggtgccagcatctgcttccagtgagggcctgaggaagcttacagtcatggtggaagaggaagggagagcagccatgtcacatggcaagagagggagcaagagagagaagggggaggtcccagactgttttaaacaaccagatctcatgtgaactaactgagcaaggagtcacttatcaccaaggggatagtgctaagccattcttgagtgatccacccgcatgatccacctcctactgggttcctccaatattgggggtcacatttcggcatgagatttggaggggacaatatctaaaccatatcagtgggtgtttcttctgaaaccttaagaggggccaaagagggcaaatgctgacagttgaccaaaaatggggcttgaaatttcctttttatttcagacaatgaagacccttttgtggtttggttgattggtgttgttattgttgttgacaaggtctcctcctctgtcacccaggctgtagtgcagtggcatgatcttagctcactgaaggctcaacctcttgggctcaagcgatcctcccatgtcagcctcctgagtagctgggaccacaggcatgcccagctaatttttgtattttttcatacagacagggttttgtcatgttgcccaggctggtcttgaactcctgtgtgcaagtgacctgcccacctcgacctcccaaagtgttaggattacaggcatgagccaccatgcctggccaagacccttgttttaagaaatgtctaagtgaaacagtgtacactacattgatattttttataattttcttttttctttctttcttttttttttgagatggagtcttgttctgtcacccaggctggagtgcagtggtgcaatctcggctcactgcaatctccgcctcctgggttcaattgattctcccacctcagcctcccgagtagctggaattactggggtgcgccaacacgcccagctagtttttgtatttttggtagagacggggttttgccatgttggccaagctggtttcgaactcctgaccccaagtgatccgcctgtctcagcctcccaaagtgctgggattataggaatgagccaccagaaccggccagatatttttataattttctgataagatcacaacaacagaatcaagcactattgtgatactgaggacacaaccctctgcccaccccacattctaaatcgttttattttcccctcaacgtgttcacaaatatgcttctaaataaagactcacacctcatcagctgtcttggattactctagtcagggcaacaccaaatgtaggtctataacttcagattttcgtgggtagcaagtctgaaaatggccgtagacttgagaatgttactagattactcagcaaccacatcctgatattgatggccgggaatttattttattttattttatttttattttttattttttatttttcgagacagagtctcactccatcacccaggctggagtgcagtggcgtgatctcagctcactgcaacctcctcctcccaggttccagcaattctcgtgcctcagcctcccaagtagctgggattacaggcacgtcccaccatgcccagctaatttttgtatttttagtagagacgggtttcaccatgttggccaggctggtctcaaactcctgacctcaagtgatctgcctgcctcagcctccgagagggctggggttacaggcatgagccaccatgcctgggatggccaggaattcataatggtggcttagaacaagcagcagttccttccacgactcatctccttctgatttttatatatcaaggtcttttttttctaagctcacattagagattagagtatgaaaacttctgtgaccactcaggaggctgaagagtagctagttgaatctgtagaagattcaaataccagccagttacaggaaaatcacccaggtgcttgctaaaaaatggaggttcttgggcccctcctcagatcagtgaaatatgaatctccggggtgtgatcttgaaatgtatagttgtaagcaatgaatcagatggtcaaactgctttgggaaccagtgggtagaatattgctccagaagagtctttggcaaaatagcttgtttatctttgatatagtttggatatgtgtccccgcccaaatctcatgttggattgtaatccccagtattggaggtggggactggttggaggcaactggatcatgagggtggacttctcatgaatggtttagcaccatctctttggtgctgtccttgtgatagtgacttctctcaagagctgactgtttaaaagtgtgtggcatctccctgcctctccctctttctcactttctcactctcactcctgctttagccaagtgacgtgcttcttcccctttgctttccgtatgactgtaagcttcctgaagccactcaagaggctgaacagacatcggcaccatgctttctgtacagcctgtaggaccatgagccaatcaaacctcttgtctttataggttacccagcctcaggtatttctttatagcaatgcaaaagcagcctaatacaatcttcaatcatctcttgtgtcatcttggcctggccatctgtgttcctaacagtgctgcccctctttcttcaaggtgagtactaaatttcgtgtgcacataaaccatcctggtaaaaggcatgctctgactcagcagggtggggtttgaggttctgtgtttctaccaagctcccaggagatgctgacgctgttggtccatgggctatattttgagcagcaacgtgctggtcttctcctcaggctcattcctttctagtgatgacatctctgcttggcccatttgtgccttactcttccatgtagtgtctgcagtttatgagtgtcttggaaacaaaactcttttaggtcttgtcaaatatcagggaagaacctccttgatggaaatttcagacaatgttggaagagaggatagggagatagtgggctattaacaaaggcatttctggcaattaagatatacaaagcactccacactatgcagtgcagctatgcacaaggatgaccttagaaccttccagaaataatataccctgaagaaatgagaaatatacatcattccagagctggctgcagagaagcagtagaaagaagggatccttaaaatagcagtaccaaagactatcttgccttatgacagcatttgtgtgtgtccccccatccatgatactaacatgctttcctaggtttccctggcacagatttaattaatggggtttaaagtactagaggtcagacccctgtttagcttacaacccattatctactgcacacagtagattaagttattcttctttgggatgacatcgcatacatgctacacaatcaccaatgcgtatattgataaccttgaaattagttttacatctccctgaaccctattttgtcttccattcaatcactttatcataatgattatagttcctcctagcttttggggtcggattaattcataacaataaatttctcaggtgatgactacccaacattacagttaattcatataacttaagagaaaagtttacctcaatgcaaagacatcaacaacctataaatatgcagttatctatagctcagaccttttcctgagttggttggaattgtatataaatctttaatgtgagcaatgtagacttgaactatctcgacttgtttcatttcagactccacaaagtatacctaataaatcaaaggtgagttttcacatttaattgttctctatcctgtggaagagtgctgggaattgaacctagccctgctgctgctgactctgtgtctgagcatcatgacagcctgctagatgggctggggcctgagaacagtagggttgcttcgagggaggccccagggacaataaacaggagaaaggccagctgggtgggagaagctggagccagttgtcaacaaaaatatattagtcccaggacagaaagactatataagctcctaatgatttgggctgctagcatctcatgaaccattatcatctccagctcactaaatggatcccagaagattgaaaattgacatgcctagaaaaaaaaaagaaagaaagaaagaaaaagaagtccctcttatttcccctgtatgatcagacctagtgtttgtagcttatggttttgaaggagcatagatataatgtgaggaatttttagaaggcatgtgtaatcttaaatgcataagcatgtcttttcataaaagaattttcacaaatttggggttggaaagaaggaacacgtaatgagtggattctaaatacacacaacagggaagttaatgagataggaagacttccattcagaaatgagttcaaggcataggagaaaatttttaaaaacacacaacacaaattgtcatttattaggtaaatggaaagttatgtctgcagtaaattaataggctacgacaaagatgaatttgagatcacaaaaagacctaagaaagttttcatgactgtctcaaatagtcaaaccaaatagacttctaaaaaattaaaacatgtgaaataatattcaaaattgatttcaaaaatcaccaatcattgattaagtttattactcatatcccttcccctgattaagaaaatgtgtgtatcacttaaatgagcacatgaggctgtaactttggaagggttgctctcccttgaaattcacaaatatttgaattgaaaatgagctgtgaatgtttttgaatcctctgactcatagatttctatagaactcattttccagctgccacggcatgagctctcactgtcatgctaatcctcatcagttctgtcctcaactattatgatggcctcagactgctcttccttcgtctagtctctcccccatcacatccagtcttcaacctgtcttcatgctgaccccactaacacataaattgaacaccaaactcccaagttccaaagccttcaatggctcccctccctctgcgtagctgggtatcaacagcgttggctgtgcaaccacgactctctcccaagccatttcttctttccatcacctctcaccttctccatagcaactcacgctattttcatttagtaaattttgtcttgtctgtggagtgatggaaaacttgtgactacctttgtaggtatcggaattctcattagagaagtatttttaataagctacttattaaagtagcttttaagctactttataatagtaatatacataatatatattataatcgtaatatatataataataataatacttacttattaaagtaaagtggactgtgagatccaaaatgcctgttcaaacaacaaaaatccatttctaaaccactgggcataagacaagtggaggaacaggttttgcccctagatggacagaagataattcttctctgcctcatacagaaaagaagaatttggattcccaaaggagtctataatgggaaaccagagtgtgtggctaggaaaatggtggaaggctgcaatttgacagaccaaaatcttcagaaaagactcctaaactcaggaatgtgagttaaggtatgtgaatgattttattgggatagaaattgaaggtgcagaatttcaggcaaaaatcaaaaaggcaatggtcgaatgtgcatgttccagagagctgaacaaccttggaaatagaaacccactggaatttcccagaaatcttggttttggatttgcacaagcctaaaaattggtagtgggtgtggccataaggtatcaagtcaattgtattgagatctcgaggagtacaacagcccttagctatgtctgttccagaagaaggttaaggctgctacgtcaatacatcttgtgttttagtcacaatccacattgtctctctggctcttcccaagcatactctgcactttcccaccaccttgactccttgagcataattatctctgctcaggaatgccgcctcttctctacccagtgaacagtcaaaacccgtatcaaatattagctctttcgtgtctccttccctggcctcctcccagacttaagtcatcgtttcttcttctgggatttcattgctctcttagttctcgtctctgggtctgtttcggtgaacagactctgaacatcacaagaaccgtggttgtaacacaacccagtgtaacacacagaagatgctcaatatgttaattgatgggctaaatctttgattcaacccccttctttacatgtgtagaaatgaccccagtcacaacaccaattcttctctgcccctctaggaaaataataacaattcttcatacattctcaatgtctctacagttcacacatgtcaaaagatgtgatcttcccaaaagtgctgtaaacacacatggaaaactccatttttaccacttcttaaagggttgctacaaacataacgctctgcctttaacttacaagtggcagaagcagggccagaacctcatctttgtaatgcttctgttgagcgcttctctttttactgtttgcatttaatttggtgaaaacttggaattctttacagctaagaatgaggccatttggaggctggaacatctaggcaattgaagcaacttacttctgtgagtcagatggtaggatagggtgatgtctgcttgtcagcaatgccactcggctgcagatcaccactccgcagtcacactgtgccccctttcctgcatcctgggcatgccactttctgtggggctcagttaacaaatgaggtggggagaagcagctcttccaagaattttttcatccaagcatgagagaggaagaatgattcttccccactcaatagtaataatttaaacatttattaaatcttctgtaccaggcactgtactgcatttacatgcattttctcatctaaacatcctctagatctttgcgaggtgagaaccaggatggtcctggagaactcaggaactggagtcaggtattcaaatgaccttaagagtttcattcttccatttttgcatgtctttacttgtcactgtcattctcttcctctgtagtccagctttatccactgataggaaatgtggttaacagtagctctagcagcttcatcactgggaaaaaagtgtttcccctggtcatacttgaacttttatttcaatctagtttttaaatcccaatggcaggattctgatcagcctggtctgagtcattgtcatccattggaccaattactgtagctgaagtggagtgggttttggtgggagtgtttggattctcactggcagacccctctggaaacatatgttggctagggatttccctaaaattaagagaggggagtctgttgctagtagacagggagaggtggcgtcgggctgaaaataagcatgcatgtaggttacattattctgcccctattaaacacaatgaggactccaaggcttaaggagtgtatgtaactcacccaaggtcaccaactagaaagattaggacttgcacccagaccccagagactgcattatggacttctgggctgtgctgatcatgtcagtggcataatatgtctatattatagctatttgggggctagttagctcacttggtcagagctaagctccctttctccttttgttgaggctcattaagtcaagaacagggtgataaattaattcacaggacccaggtctttcaaagaagagctgtcagctaccaggtgagcaagtagcagcatgtgaatcattcctaatcccagccaccttcattactagtagaaaataacacaaagcatgccttttccctcagggcacctgtagcaccatctcagtgtgcaaagggcctcaggctttcatttccctttccaggtcttcttacattttccctaacaagactgccttccttttcattttacccacagcagtggcccctgctgggccaggaggcagagctatcatggccgatgttatcacagctcacaccccctctggccattattaaggggcagcctgtgttcagttgcatgtttcttagcaaccaccatgagccatgtcctctcctttcatttgcgtcttccttctctaacctagggggcaaatttactaagaaatgaacccctgccttctcagatttctaagccatggaaaccagaaaattgacaatgattgcattttcagtctcaaaatgatgaccaatttcaagggttggtggggtgcagggcgggggtggagcagaatccttttcttacatactggcaatagctttgcaaagcatgtgtgatttatcgcatgtgtaaactcatctgtaaggaaattgatttaaactgagattcttcataagatcaaacatctctactgcgttgtagcttgctgaaaggctagacatgcatttaagcctaaacatttaaaaacatgaagactgctttcttacaaatttctgtaacagcattcccctagcctatttgctttcatatggtatgcactcagtacagctctgttttagaggaagcttcccaagacagatgcttaattcttataagcagccaattgcttgttcccattccatgtacatgtgaataaataactccacactccctgccctaaacacagttgttaagatcctggaacatggaacaaaggctagaattctttatcccatgaagcgtagactcttggctttaatttgtattaatctggtttggtttgtttgcttttgttttgcatttttaatgccgccgtttcgtatttatctttggccaatgtgttttcccccatcgccaccacattgccataattcaatcttgttttgtttatggctatagccattgaggttgttcatacctatacacatttgggaagctgcaaaatagtttatcacatggtgttcccaacgcagatcataaaaacaaccacccagcccaagaatcagccgctgtaacgcatcatgttccttctaagccacagcggtattcttctgtctagacgcagtctgttctctagaacagatgactgtaatcgaatatgtcagtttgcagggaagacttgcttctaatgagcttttaatttcaagtaacaaaatttagcaaaatgcaaagatagcatattgtttaaaggaagacttttgaaatggatgtttttgacttggctctaataagctgttgtgcaaccgttcccctgaatgtagtctgaaagaaccagaaaagtcgagtctatctcattggtttgaatgcccccagtaggcttatctgtagaccaaatattcaaacacacttggttttagttcatttgataggttgaagttaatgcattagtcatggagactgccaaaatcaaccaattgctccaatgactggatatttgaaatgcaacagggccacttatgttaagatgttatgtagtctgtctcatagacttgtgaagaaaataagtctaatttttctactgagaataatttgtaagtatttgaagaaatcaaaaagttgaggataaagtatcttgccctctggatgtttaaaccacaagcaatttctcttttaccatttaaagtgtttttaagatactaacaaagaaaaaccataataagatattgcagagaattgtctttctttgctgtttgagaaaagcagatttaacttggttggttgttagaagggctaaactctaccttctgaagtaagcacatagtacccttggtgcaaatatgtagaaaagggattttttttcaatgtagtttgttttcattaagacccttttattgatcctatcttcctcaaactccctttcctccatattcccactttctggccacaatcctgaatgccatgtgaaatcattactttagcattaatctttgatctttattaaaatgcaattctggaaatggggaggtaaaatatgatcatctcatgtcagtttttataactgtaggtgctggagtttcagactcctatctgagattgggaattaatgaatacagaaggcataaggaatatgagggcattgagccaaagggagaggtggggcgagggaggggctgtggtagcaacatgaacagaaaaggagaaaaaggacctgagttggaaaattgaggtctccatatcaaattactcttatttcaaaatgtttcctaggtttgcttattcctactgatttttattaccaagagctttatagaaacataatatacttttttattactttaagtacagctagttttagccacttatacctccagacatgccactcaactgtgaccttgagtatcatttattcataaagtaattttcttagaatgacgaagcatctacatttcctaaattacatatcactagttatttttcttgagacatcactttatatgactcattttacaagtttacaagttgcttctttactagaatgtttccccgtccccaacagtggaattagtcttctacttggtttaattttatggtgttcctgctgcaagctcagcaaattatgaacagttgtctcctttccccagtggacaggcatgggacaattgcctttctcctctaggttcttaataagtggaaaaaaaaaagattgttttcaaggactgaaatcttctttcttttaacctaagaaggaaagaatgtatttaaaaaaaaaaaaagaggggaatgaaaagaaagcatgccctcgtcctgtgttgttatcacttacttaattcagggttcagccgagagcccaaggctactgtcttgatctgcacttcctgtctgcacacagatccctggtgtataagcctctcacgatcctaaaacatttccagaatttctccttgctctgaccctcttagtgttgaaagtggtagtcttaatttatttccaaagtctatcttttctctccaaattaaataacagtgtcatgaaatgcttcatcttctaatgtcctatcagcaaaatcctagctttaatagtccaaggttatctcctgggctttagaaatgtaaaggcattacacaaaattgatgttgacaaagcacagatactcctttgcacgatcacaatgaaacttttctcttttttgcacatttcctgcaagccaagctacatcagttgctaatatgcttggttccacatgtcacacttgatttctgatccttttacccacttctcaaaaatggttaggaaatatttatatggatttctttggctagactttaagataaattactttttggtgaagttcttaatccttttttttttcaaagtgcctgatctcttagagcaagcttacaaacaaaagcccacaagcaacatcctagactaatgtgcaagttaacactgaagaagagttagaatccacgccttgatacaataataataataagtgcaggtggggaaatgtctataataagaactttatatatatgaatatattcaatcctaacaacagccttgaagaaaatattattattaaacccgttttacagttcaaaaaaactaaggctgagaaaggaaagaaactggtccaaagtcatactgcaagtaaatgatggagcagggatttcatgccacaactcagtaattaatcactgtgttgcaattctttctccttttcattaggctctgtaacttgtctggggacaaattaaggttgtaaagttcagtttactttccgtcagtcatatggcatcaccaagccacctctggtggagtgagaaaagcatggtacttcaacatcggaacccctgatactggtccctggctggatcttcacttcttgagttcctgtttccttatctgaaaaatgttattaatattcctacctcatagcaatgttgggaaaattccacgtggacgtgtagccaaccccaagtcatatgtagagtctgaaataccacataaatgtaaagtaacatctgttcatgtattggattttcttcatttatctttccccagatgctgtattgcatcccagttcgcaaaaaagaaaaagaaaaaaaaatgtgatggtgctatggttctagaatatctttaacttatgtgccaagggaacagaagatttattttcacatatataagcagttgtataaacattttctagatcaatatatcttcttgggttgcagtttggagccctgtctgacaggaggtcaatgcctacgcttggggcattgaaagtattcaaaacagatgcagcccattctccaaggcctagcctctggctaattcttttctgagttctaaaatgttgtggctacatgctcacaaaagagagtctacattttggagaagggggacagcacacattacacttcaccttaaacaatgccccattcaattcgaattggttttctgtttctccatggtgtcaggacactcttttcccagttatttttaaaatcttcatcactttacattttcactcttccattgatacatttccataattttatcctattgtaacctccacattccacccaacccattggcacttcaccaagagatgattgaatcattccaaagcccagatagttccctgatattctatgagaatatttgctggaaagtataaaattttagcttaatcattttctttcattcccaaatttcttgtgctaattccttctgagagcagataggagacattctacaaaatgatgaagctctatgatagaatttttccactggactagagaaaaggctcttaatacacataggcctattttaaaaatcaataccagaaaaaggtttaagttagatgggatcttagagataatttgttctcacttcttacttaccattcctcaaggaaggcagtgatatagctcctttcaaatgctttcagatacaggggatccatgccacccacacacaggacacacacaggaacagcatatctaattgtgccatctcatctccccaactgcccttccccaatcttctttttgctctctggatcttcactcaacaaatttattcaaccaattgacccgcttctcaacacacaccaggttttctgttattcaaagaagcaaatgttttacttttcctcctaacaaaatatcgcttgaatcaaggaaggtgctagtatgaaagcaaaataaaacaaaataaaccttggtacacaggatgagagtttagggttttttctttctttctttctttcttttttttttttttgcctttagtagaaaattgctatgctgtgaggatgaaatcctagtatccaccattaaccaatagatagaaaaagggtggatgaaataatgaaattagtaaaaataagttagaaaaataacttagggggaaaaacagacctgaaactatgtctgccagataaaatataggacaccaacttcaatttgtgtttcaggtaaacaaataactgtagtatcagtatgtcccagagattgcatttgtttgtctctgccactctgtttctcctcccccttcttattttaccccctctttttagagtttctcccttcctctctttgcatgggatatacttatcctaaaacagtatttcttctactaaaactttattcatgatttatctaaaattcaaattgaagtgggcatctgtatgtgtatttgctaaacctgataattctagttgaaatgcccacaggctgcctagagaaaaaagaccccagacgaagagtcctgatctcagagctgttgtcatttgtttttcatgactgggtcttactccttcctgggtgggacctccttctgtttaccaaaaggagatggtgtgactgtgaccttaggaaaggcaatgagaactgctgtgggtggctctgctttaggattacaacctctactttccacccatgccctccctggctttactggagcatttcctgttatgtgtttgttccttcttctggaaacctgagccctaacagaagaaggaaaacataatgttttttacaattcattaacggtgcaagagggcccttgtgcagagatcagaaaggcagccaggtgattagggggatgaccgctaactgtctgagcctggccctctgagatttgcatttctcgagaggaccagcccccgggactgatgacaggggtacccaacctcacagtactggccatgccaatgctgctctgggaggctgctctgggccactggctaagctgctagcagggtccacacagatgtgcacagcctccttctttctcatcttttctatccccccttggtctctgtcattcggcacctctcttcctctttttccatcttcctcttctttaagagtattcttgtctcctcatccctctcttaattttatttctgtctctctggtccctttctacttctgctttcttgcatccctcttctcccatctttttgccaaccctttccctcctttttcttctccagccttcactttcctccctcctctctgacacccttccttccactctatcccccttcttctctcttctctttccttctctcctctgctttctttctttgtcctctccccccaccccctttcactttcttctttctccctctctttcccacctgtctcatgcattcccattttgcatcctatgtagtgaatactacggaggtgccatttctgaaactgtgacatggaccttctgtgatatttgctcttccaggctctggcattggccgcggccggcatgtttcagcatggggttggcccaaatctatgaatcaaacatggcaactggggcagcaagatccatccaaagggaaggagatttgaggatacaaagtactgagtctttgctagcatcccttgagcataatagtgccttgtttttcagggacctggtgtatatatttgatgcataggcttggttctgcagaaatcaattttgcaagaattgagaaaatttgtcaaatcactctcatccttggagcttatgtttgttcctaagcatatttttgaaggggtcaaagtaaggttttcattagctctttctaacttcttgattgagaatgaaaagcaatattctaagactatttcccaaaccttgagagaaaatacagagagtttttataagaatgtgcgtatgtatttgtgtgagaatacacacacacacaatgtaaatacaataactctataaatgtacttccacaaaaatatatcttatatatataaactatacatgtgtgaatctatattgtgcacatacacatacaaatcctcaaaagcctatggttgtatataaatatctaattatataaagagaaggtttaggacattatcatgaaccatggttagggataaaaaatgaggaatttgagcatttctgattttatttaaagatactgtgccacctcttggtttaggttaagttagatttaagcactttcattaaaagtagctctcacaaataggtgaaaaaggcaataagccatagctcaaagaatcctttagttagtataaggaaatgaaggtaggcctagcacaagcaagaaaactcacaatctagaagtttgtaagttcttgtcattaatggactaagtctacatgtcaacatgtctcttccaatgcctgccatgtatccaagggctgaagacagcctagtgaccttgaaaataacactcccctcatcatcagacccagacaagtataaacagccacatgtttgagtctctttgaggcaggggagctgcagtattgaacaacaacaaaaaaatatggcatatgaacatcctggagaaaatgtttatttgctctttgcaaagaaaatctcaataatagagataactgtgaagtgttgcttcaaaaacaacccctcccatccactcccccaaaaccctcagatttcaaactcagtgtgagaatagtagttaaagataacaattttactcactcctgtaatccgagcactttgggaggccgaggcgggcggatcacgaggtcaggagattgagaccatcctggctaacacggtgaaaccccgtctctactaaaaaatacaaaaaattagccgggcgtggtggcaggcgccggtagtcccagctactggggaggctaaggcaggaaaaaaatataacaattttagattaaagatatcataactaactctttgacaactgatttgaattaatatacaatattactccatggtagaggctaggaaaatgtcagaagttaacacactctgacaatgtaccttcaaaattataaataactatataggctggtgcagtggctaatgcctgtaatcccagcactttgggagaccgaggcaggggaaaatattttagaaacttaaccaggatgtggtggcacatgcctgtagtcccagctactcaggaggctgagaggggaggatcacttgagcctaggaggctgaggctgcagtgagtcatgatcataccattgcaccccagcctggatgacagagcaagaccctgtctcaaaataaataaataaataaaaatacatatatagaagtatatgcaaggattctttgtttttaaaggcagaatattttgaagttcgaaggataagaaatttaaacaaaacttcaacttgatactcacttatacataaaattcaacaaaaattccctaaccttgtttagagacaacagataaaagattttcttttagtgtaagaaaaaaggcatatgacacaaacaacaagaacaaattaagaaagagagaaactacgttgggttaaaggctactaccttactgtgtagtgtgtttaaaaatccctataggccaggcacggtggctcacgcctgtaatcccagcactttgggaggctgaggcagacggatcacctgaggttgggagtttgagaccggcctggccaacatggagaaaccccatctttactaaaaatacaaaattagctggacatagtggcgcatgcctataatcccaactactcaggaggctgaggcaggaaaattgcttgaacccgagaggtggaggttgcagtgagccgagattgcgccattgcactccagcctgggcaacaagagtgaaactccatctcaaaaaataaaaaaataaaaatccctattatgtctaatcgactcttggtagaaaataggagggaagagataccgaagggaagtcagttttgttagcaattgactcctgagcttgctctgttgaatttcaaaaagccaggcagtgactgacaattcatcactatgagaaagatgcagccaaagccactcctgagctcagaagaacagtctaggaatcaccaaaacatattgagggaaaattgacataagatgaaatgcacagatcctaagtgcacaattttatgagttttaaagaatgcatatgcccatgtaccgacagccccaaccactaggacattgttataaccccagaaaactttctttgtgtcccttccttctcactttcaccaccatagacatggactcatacctatctactctttgtgtctggcatctttggcttggtgtgatattttcagattcacctatgttgttgcctgaacctgttgtttcctcctttttatggcgcaatagtattctgttatatgaaactaccacaactggtttagccattcacctttttttttttttaacttttattttagattcaggggtatatgtgaaggtttgttacataggtaaacacgtgtcatggggggttgttgtacatattatttcatcacccaggtattaattaagcccaatacccaatagttttcttttctgctcctctccctcttcccacccttccccctcaagtggaccccagtatctgttgtttccttctttatgttcatgagttctcatcatttagctcccacttataagagagaacatgtgatatttggttttctgttcctgcgttagtttgctaagaataatagcctacagctccatccatgttcccgcaaaatacatgatctcattcttttttatacctgcatagtattccatggtgtgtatgtaccacattttctttgtccaatctaccattgatggggatttaaaataattccatgtctttgctattgtgaatagtgctgcaaagaacatttgcgtgcacatgtcttttacattcaccttttgatggacatttgggcactatacagtttgggactgttatgaataaagctactctacacatttgtatacaaatcttcgtgaggacatatacttttacttcatttaggtaaatacttaggagtggaatttctagatcacagcataggtatgcatttgaatacagcagaaactacaaaaccaatttccaatctgcttgtaccattttacactctcaccagcaatgtatgcaacttattttggttgctccacatcctcaccaacatttggtgataacagtctttttaatttttgctattccagtgaatatgaaatggtactttctgtggttttaatttacatttccctgtgcttattggtaattcatatgccttccattaagaagtttctgttcacatgtttgctcgtttttattgagttgtcttttaattattgaattttaagggtactttatatattctatatccaagccctgtgtcagatatatgtgtgtatatgtctgtgtgtgtatgatagtcttcccaatattcttttcaatgtatagcttgccttttcatttttcaagtgtattttgataagcacaacttttgaatttataataaatacaatttttattttttcttttatgtttattacattttgcaccctctctaaaaaaaattttcctgccctatggttgtgagatgtttgcctctgattttttctagaagttttctagcttttgcttttaagtttaggtttatgatctatctcaaattaatgactgtgtgtagtgtgaggtagaggtgagggttcattttttactcaaatgattatctagttattctagcaccatttattgaaatgatgattcttttccccatttagttaccttggcctctttattgaaaatcaacttaccggccgggcgcggtggctcacgcctgtaatcccagcactttgggaggctgaggcgggcagatcatgaggtcaggagatcgagaccatcctggctaacacggtgaaaccccgtctctactaaaaatacaaaaaatagccgggcgcagtggcaggcgcctgtagtcccagctactcgggaggctgagacaggagaatggcatgaacccgggaggtggaggttgcagtgagcggagatcgcgccactgaactccagcctgggcgataagcgagactccctctcaaaaaaaaaaaaaaaaaaagaagaagaagaagaagaaaatcaacttaccatgtatgtgaaaatgtatttctggactctattttgtttccttggtctcaatctgtccttaagccaaaaataaatgatgtcagctactgtcatgttatagttagtttttaaatagagtaggatgggttctttaactttgttattctgttaaggattgtttggctgttctaattcttttgcattttcacataaatgttggaatcaacttgtcagtttctacaaaacaacttgtaaagcttttaattgaagttgtattgactctatagatcaattaggggagaattgacattttagcaatgttgaattttataatccctaatcatggtatatgcctccatttatttctaccttttaaaatatctctcagcaatattttatggttttcaatctacattttgcatatctttagttaaataaattatccagtatttcatgctgctacaataatatagaaatacaaatgatttttatattaatcttgcatgctgatgtgttaaaatgtcattaatagtgtaattatttagtagatgccttagaatttttcatataaacaattacataattgtttttaaaaaggttaagcttatttccttttaagtctttttatttgtcacttatttttcttgctttattgcactgactatggtatataatgttgaacagcagtggttagagcagacattcttgccttgttcctgaccttggaagaaagtattcaatatctcataataaagtatgatgtgagctgtaggttttccatagatgtcctttactaggttgttaaaattgccttcaattcctaatttacagagagttttatatcattgagtgtatgttgaattttttttttttttttttttttttttttgtgatagattcttgctctgtcgcccaggacagagtgcagagtgcagtggcactatctcggctcactgcaacctccacctcccggattcaagcgattctcctgcctcagcctcttgagtagctgggattacaggcatgcgccaccaagcccagctaatttttgtatttttaatagagacggtgttttcgccatgttggccaggctggttgtgaactcctgacctcaggtgatctgcctgcttcgggcctcccaaagtgctaggattacaggcatgagccaccgcccccagccctaatttagtctttttaaattagctacctaaggtgtaaacttagatcattgattttaaactttgcttcttttataatcatttaactctataaatttccctctaagaagtgctttaagctacatctcacaaattttgatatactgagctttctttttcattcagttcaaagtattttctaatttcccttgtgatttgtttctgccgatattcattgactaccttacttgacattaatacagcctgctaattttctcatgctgggtatttgcatgatatacctttttctatcttcgtttatttaacctatttttatctttatactttaagtccatctcttgtacacagtgcaaaattaggctttattttgtttcgctttgctttttatccagtctgacactctctgccttttcactggagtgcttagtttctttatatttaatgtaattgttggcattcttaggattagacctactgcttggcaatttgttttccatgtgtcccctctgttttagatgatttttacccctttattgctttcttgggagaataacagacagtcacaaataattacaaatattcttttcatctcaaatattttcaagatttaaactcaattattttttctgtgctgctgtgagcttgagacattatatacattaaagttattttaatcatatatagataacacaaatttccatattaagggatagtaataattataaattgttattctgattttagtcagatttaaattatctaatttccaataagatgtgatttcttctcaaaagtatctgatcttgccgggcgcagtggctcacgcctgtaatcccagcactttgggaggccgacgtgggcggatcatgaggtcaggagatcgagaccatcctggctaatacggtgaaaccccttctatactaaaaaaaatacaaaaaattagccgggcgtggtggcgggcgcctgtagtcccagctactcgggaggctgaggcaggagaatggcgtgaacacgggaggcggagcttgcagtgagccgagatcgtgccactgcactccagcctgggcaacagagcgagactccgtctcagaaaaaaaaaaaaaaaaaaaaaaagatgtatctgatctgaaaggttagttgcggtacgatttgagtgatgggatactatttgagtgatagttacactgaaagcccagacttcaccactacacaatatatccaaaactaaacttgtacctcttaaatttatacaaattttaaaaatacaatgttagtttgtcagaagcattttcaatcttcttgatctgggcatcacatactttgatttgatgcttttttcttataaaagcaaatagcttttaaaattagatcttgatttttatttcgatacacttacatatcctcatattcttcttgtcatatacagatcaagtaatttaaatattcaaaaattgggcatccagatttgtattcaaatctatactctacataacaaatacatctactaggttaattgtattgtattgtgttaactgtaaaatataagaattttatttatttatttatttattcatttatttatttttttttttttgagatggagtctcgctctgttgcccaggctggagtgcagtggcactatctcggctcactgcaacctccgcctaccaggttcacgccattctctcgcctcagcctccagagtagctgggactacaggtgcccgccaccacgcccggctaattttttgtatttttagtagagacggggtttcaccatgttaaccaggatggtttcgatctcctgaccttgtgatccgcccgcctcagcctcccaaagtgctgggattacaggcgtgagccaccgcccccggccaagaatttttaaatctttagaaacatctagagtctctaaagtaccatttctagaaatgaaagaagtcctactctaaaatctattttgattattttaatgagttcatgtctaagttctataacattaatagagagtactgctttgaaattagcattttaaaatgaccagttgagtggtttagaaaagtccattattttataaataatcacagaagcctttttccaagatggattcgagtaccatctggatgaggcttcattattatagcttcatttataaaattaaaggatgaaacgtttaatttgtaagtgtattttttttccttttcagaaagtcatagaatgatatatttggataggcatgtgattgctttaatttttgagcaaattttcagtgtattttccctttagaatcatgacttaagtaaggattagcattcggtagccaaggtttaagaatgcaccgtggatttaccgtggcagacacggttttggaatttaatttggtcagcctctgctttagcaggacaaagagagaggaaggtgatagcatgccttacattagctgtgttggaaatgtgaccctctcctttagaacggctcccagtttgtctgcaggagcaagcccctgtgacacaggagagcagtcaggaaaggacagtgagtgagcacggatgacagaagtgtctgtgccacccattcattagggactcacaaaggggtatagaaattctgggcttttgtggggattgagaagttcctatcaaatgtctgtcgggtaatttaattacacgggcatggtaggaatgacacagtggttacattaataaactgaagcattaaagaataatagcccagttattgctgaattatgggaaacacgctgcctattcattgctggtgatattagaagggagaaggcgggggcttcctactttatactcgcaatgcataaagaaacagtttcttgcctttccagacctgtggaaaaccgggtagaggggaaggcccaaagtcacacccaatagcataaatcttgctttgtttaagatgcttaaaatatcataagctaactctgtttttatggtgctaaataaaattgacttgggccagacatagtaatgagcatgtgctgcacaaacatctccaaatagcctttccaacggatctcattcctgataatttccatttgttgtcctgctcctcttgttaatggaagccattttataggatcacaggctactagcttagtagttttaaaaaagtagcctattaatataatagaagcaaacattatttttcattctcactcatccctctggcagactggaacaaaatgcctttttccctcctgcaggagcgggggaaaaggagcacacatttgatttcgtattatttaacaataaacgtttattgaactgtgtcaacactgttccaagaagtgtgatgtggaaggagggggaagagatgaagatgagctcctgctttcagattccaacagagaaagtcacagctcagcagctggccacccactcccatggaactcaggaagatctttctgcctaaactcttgtaggtgccatattgcagcctacgttttttcctggggggggaaaagttgatgagttttaaagatccatccacctctaaaattctttaagcctatgaaatatttatttctaggagacaataaacacttcacttacacagaaacacttcacttacacagaaaccagttaccatgtgcagaagatggtccaaagaaccactcaataatacaaattacattttgtgctttggggttttaagaaaatatttcggaattcaagtttgaacaagtcaactaatagaatttgaggtggcagatcacttattttcttcatctaaactagagtgttacgatttcatgggcaaaatacaaagttgaagtgtccctgataacacatagcaagctgcacatttcccaggaaaggccagcactgcttattctcacagaagtcacccctgcaagggttctttagatcagtggttctcaaattgagcattcaagagcatcccatggaaggcttattaaaatgcaggttgctggcctcagagctcagattcagtagaagtcagttagagtctgggaatctgcatttctatgcatccttgctctctctccctcccttcctgctgctactgctggttcagggaccacactttgagaatcactgctttggatattagaatgatgattctctcaagtcttgaaaaaaaattgcgaagttccctctaatttagcagagttaagacaaatgtttcatttaatttgcatctatacatagctctgatggactaatcctttataattcaaagggaagaatttaaaaatcataatgatgaggctgggcacagtggctcacgcctgtcatcccagcactttgggaggctgaggcgggaggatcacctgaggtcaggagtttgacaccagcctggccaacatggtgaaactccatctctactgaaagaaaatacaaaaattagccgggcatggtggcaggcacctgtggtcccagctacttgggaggctgaggcaagagaatcacttgaacccaggaggaggaggttgtagtgagctgagattgtgccattgcactccagcctgggcaacaagagtgaaactccgtctcaaaaaaataaaaataaaaaaataaaaatcatgatgagatagaaacagcatgggtcttcattctgccatataacagagacattacataaatggagatttgactgaagactttgttctttgcttcagctcttcagagcattccatctgaatcaagaaagtagtcttggaatatttgctagctgtagcccttcccagtcccactttgtcatacgccacaggcagaaaagaggaatgcaatctttgcccactgattcctgtgtagccacaagcttcagaaagagtttagtcagcagttcatggctccttggcccacactaaccacagtttggccaccaaaaatgtgggtcagcgagttgccagaatgctgaagtatagtggttacaaggaccaggacgctcaagttggaaacatgtgataccaccacagttcttaagatgggaaatgagggcaaaggtaaaccctgctgttcttggacttggttctgttatgccatccttttctaaagccaattgtcactcatacaattttattttgctctcataaattctgccagacagtagtttcattcaaccaggactggctataatttttagtcagatgtatctcttattctgtttttttttttcctcagagaaagaaacactcaactaaattttatgctacagactgaatacctaaaatccccaaccttttatcttaacctgagtcataaaacctgtaccgtcagaaatgcctctttttttattttgattttctcacaaagcacatgtaaataatttagattaaatgtttactgctttgccctcacagagaattagatgtttagcttctgaaaataataaaagaaattgttgttaattatatcatacagagtgtgccaaatttatcaatttgtaaagaatgacaaatcctgcttagttgatatccagagtgtgtctacttactgggtctgatgtaaatatccagtgagaaatctggcttagataaaataaggctaaaagaaaaatctcagaacgtataatttactatatgtcttatttacacagccttacctaccatcagacgcttaaaatacatagtggcttttaaaagaaaaaaacttctaccttgttccattagaattgaggaggcttaggtcaagaaatatagaacatcttaagagtaactatgagacagtgaaggaaagaaaacttatttgggtactcagccaagtttattgtctgtattatttcttttgtgcaccaagttcttctttttctttctttcttctttttaagacagaatctgactctgttgcctaggctctagtgcagtggcacaatctcagctcactgcaacctctgcctcccggattcaagtgattctcctgcctcagcctcccaagtagctgggattacaggtgcaccccaccacgcccaacaaatttttgtattttcagtagagacggggtttcaccatgttggccaggctggtctcaaactcctaacctcaagtgatccacctgctttggcctcctaaagtgctgggattacaggcgtgagccaccgtaccaggccttttttctaagcatattgaccctaagtatgtattgtggttatgttcagtaatgtacacagattttttttaatttactaatcttttaatatagaatatgtaacatggccaatatcttttaaaagtcaatttaaaaaatggttacatgcagttttttccctcgggaaaaatatatttataatttttaaatcatatcttagagaatactattgtgttctcttttctttcatcaaaaccgaatcttttaaggggagtgtttactgggaaagcccttggggaaattgagagatgcaatcttcacctagcggtacaaagaagtatagcttttgactggcacctgattttattcactgagcttctttagtgctctgaagtgaacacagttggatttctagataggaatttgctactcttagtgtcacagtgacatcattcctgggaggagaaaaaagtgctgttttcttctgtattccaatgacataattgtccctctttgcagggaaatgtgcagtgctacagttttggagttcagacccattgttctgaactaataactataaggctagagcataatggaacaacacctttagaaagctaatacccccacaggtttcatctgacatcttgaacgaggtttgcagagagacacacaaattgaacctgtccccaatttttaaaaattcgccctcattctttagaatctaaagtattgcagaatacattgtacaaatcaatccccaaacaaatggttttctccatgttgagtaaaagagcattggaatcctatgattaaaacctcaaaatcaaccaaggtaactaagataaaacagtaaaaccacaaggtgggccagatggcaaaaaggaaaagctcatctatttattttatttatctttctatttttccaaagagaaataagtacttaaaaatctacttgaaagtcccagctcaagtgacaccccatccaagaggcatttagagttttttccggttgggaaagatcttgccctcatcctctaaactacagagaatccaggtctcttttattgaattactatagtcagctgcatatgctataatcaattctcatcattcccatacatgtcttctctcctttcttagattataagctccttcaagatgaacatcatactttagatagacatcactggcttccctggaaaacccagcatcttactctgacaacactcaaaaacaacatgctgaggcccaatggctcacacccataattccaacactttgggaggctgaggcagatagatcatttgagcccaggagtttgagaccagcctgggcaacaaggtgaaatcccgtctctacaaaatacaaaaaattaccgggtgtggtggtgcgtgcctatagccccagctactcgggaagctgaggtggctgatgcttgaacccggtaggttgaggctgcagtgagccgagataataccactgcactccagcctgggcaacagagagagaccctgtctcaacaaaataaatgaataacaataaacagatgtttccctaatatcttacagagtaagatgccactgaagatggtccagccaacagtatgcttttgactagaagtgcaattagcatgcaatacatggctacagtctccttttactgccctttagttattttttagctactttaagttacagatggtttaaatatttcggctgcggatccagaactggtaaatgaagtaagaaactacatctttagctgggcgcggtggctcacgcctgtaatcccagcactttgggaggtcgaggcaggcggatcacgaggtcaggagatcgagaccacggtgaaaccacgtctctactaaaaatacaaaaaaattagccgggcgcggtggcgggcgcctgtagtcccagctactccggaggctgaggcaggagaatggcgtgaacccgggaggcggagcttgcagtgagcggagatcgcgccactgcactccagcctgggcggcagagcgagactccgtctcaaaaataagaaactacacctttagtgaaatagtgcagttttcctgaacttcctgaaatgacattttaaaaatcgatatttggccttactatgcatttctaaggagccaaggcatgtcagtgtggtgtgtactttttgtgacaaattccttttatgattcttaatagcaaaattacagaatgtcatatgggggctcagcctcatagcatctttcattcttgagtgaggcttgtttatgcaagtctgcaagaggggagctctacaaaaggaaaatgggaaggcaaagtcggccctggaaaaattcagccgctggaaatgtggtcttgtccagatagtgagaaaataattgtctccaggtttgatgaagggtttatagcgctaacattttaggatgaaatacagctggtttcagattccactgtcaactcagaatcaagctaatttcatgtggtttggggttttgtaactacttttttgcagagtacttctcggaactttttgttccagaaacacccttgacatccctccaccagcacctaaaattacttcaggcccagtagaaaactcactgggtagcattactgactcttcccagcagagggcaccattatacctccatcggtactggacgtacccataacttcagcaaagaggttctttaaattctcaaccatgagacacaacctctctgataagaaaaaatagtaataataacaaacctagcaagaaaaagatacttaaactttctagaggcagcagcttctgcagttccgaccggggctcccaatgtcagcaattgcaagagaggattctgcccggaaacttaaatttcaggacatgatttggcttgggtttctgatggcctcgtctccctttgttcttggccatttcctgagctagttcttcagtcatctcagaaatttctgctgatatcataaacacacacatccataaactagtctgtgataaaatacatttcaattttcctcttgaaggccgatattcattaacccagcaatttaaatgacgggatgtttctcaaccagggaaggtattttttgtagctttcatcactggtttggttggggagaaacgattgactaattcctatttgtcttagatttttgctttcccccactggaatggccatttttgcccttggggactatttaaagttgtaatatctctagatgatttataacaagtaagtagccagcattgctaaatatccaggcacatctcatatccttagatgcatttttgagactcaaatttcaataatttgccgtgtctttataatatcaacatgcacaccagtagaataaggtagtgggggagattgttttacacagaaaaagaaaatgttagaactagaagaagctttagagaaatttatgtctcctgtctcccaacctctggataagtagcatcatctattaagtgatttttttttttgcagccatatgcttgcttttaaaattatacttagcataggataacataaaaatgctttttctaatcacacattcattcagagatataaggagatggccaaagaactatgttggtggcagtttggaaatatttctacacataatctcccaaaaagcaagcctgtaccctgcagaagaaggtcgtcttcttctttcttttcttctctttttgtagtgacagtaatcttgctatgttgcccagcctggtcttaaactcctggcctcaagcgatcttcccacctcagcctctcaaatatctgggattataggcacaagccaccatgcttggctgtattctttattgagtgcaaaactaatgatttagctttaattttcagaaagttttttttttttttttagatttaaatcccttttgcccgagaaaacaattattggtttttgctagcatcatttgttaaggaagttttttgcccccacaatcctcacattccagattgtactgtaggtgggagaaatttgattctgtgttttcggcacagaatgaccatagaaaatacttattgatagttgaatgttactgaaacattagcaaagaatgctgtgtctttagatctgataagtgagaaacccacaaaattacactttatatgaatttatctgagtttgcaacatccaaacctcttaaatctgttattcctcagcttctttggtcctttggaatccaaaggacccaaaggatacagtattgtattaattactctttaattcacactagagaaagttgacctctagttctgattacatacagagaaatatatctattcacatacacacatatgtatggaaaatattctgtttaacacaagaaaaccccttaacacccaacttcatttttctttatttatttttcttttttttattatactttaagttttagggtacatatgcaccacgggcaggtttgttacatatgtatacatgtgccatgttggcgtgctgcacccattaactcgtcatttaacattaggtatatctcctaatgctatccctcccgcctccccccaccccacaacaggccctggtgtgtgatgttccccttcctgtgtccatgtgttctcattgttcaattcccacctatgagtgagaacatgcggtgttcggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttataacagcatgatttataatcctttaggtatatacccagtaatgggatggctgggtcaaatggtacttctagttctagctccctgaggaatcgccacactgacttccacaatggttgagctagtttacagtcccaccaacagtgtaaaagtgtttctatttctccacatcctctccagcacctgttgtttcctgacttttgaatgatcgccattctaactagtgtgagatggtatctcattgtggttttgatttgcatttctctgatggccagtgatgatgagcattttttcatgtgtcttttggctgcataaatgtcttctttgagaagtgtctgttcatattctttgcccactttttgatggggttctttgtttttttcttgtaaatttgtttgagttcattgtagattctggatattagccctttgtcagatgagtaggttgcaaaaattttctcccattctgtaggttgcctgttcactctgatggtaatttcttttgctgtgcagaagctctttagtttaattggatcccatttgtcaattttcgcttttgttgccattgcttttggtgttgtagacatgaagtccttgcccatgcctatgtcctgaatggtattgcctaggttttcttctagggtttttatggtgttaggtctaacatttaaatctttaatccatcttgaattaattttagtataaggtgtaaggaagggatgcagtttcagctttctacatatgactagccagttttcccagcaccatttattaaatagggaatcctttccccatttcttgtttttgtcaggtttgtcaaagatgagatagttgtagatatgcagcattatttctgagggccctgttctgttccattggtctgtatctctgttttggtaccagtatcatgctgttttggttactgtagccttgtagtatagtttgaagtcaggtagcatgatgcctccagctttgttcttttggcttaggattgacttggtgatgcgggctcttttttggttccatatgaactttaaagtaattttttccaattctgtgaagaaagtcattggtagcttgatggggatggcattgaatctataaattaccttgggcagtatgaccattttcatgatattgattcttcctacccatgagcatggaatgttcttccatttgtttgtatcctcttttatttcattgagcagtggtttgtagttctccttgaagaggtccttcacatcccttgtaagttggattcctaggttttttattctctttgaagcaattgtgaatgggagttcactcatgatttggctctctgtttgtctgttattggtgtataagaatgcttgtggtttttgcacattgattttgtatcctgagactttgctgaagttgcttatcagcttaaggagattttgggctgagacgatggggttttctagatacacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcagagggaatgcttccagtttttgcccattcagtatgatattggctgtggctttgtcataaatagctcttattattttgagatacgtcccatcaatacctaatttattgagagtttttagcatgaagggttgttgaattttgtcaaaggccttttctgcatctattgagataatcatgtggttttttctttggttctgtttatatgctggattacatttattgatttgcgtatgttgaacctgccttgcatcccagggatgaagcccacttgatcatagtggataagctttttgatgtgctgctggattcggtttgccagtattttattgaggatttttgcatcgatgttcatcaggtatattggtctaaaattctctttttttgttgtgtctctgccatgctttggtatcaggatgatgctggcctcataaaatgagttagggaggattccctctttttctattgattggaatcgtttcaaaaggaatggtactagctcctccttgtacctctggtagaattcggctgtgaatccatctgttcctggactttttttggttggtaagctattaattattgcctcaatttcagatcctgttattggtctattcagagattcaacttcttcctggtttagtcttgggagagtgtatgtgtcaaggaatttatccatttcttccggattttctagtttatttgcatagaggtgtttgtagtattctctgatggtagtttgtatttctgtgggatcagtggtgatatcccctttatcatttttaattgtgtctatttgattcttctctcttttcttctttattagtcgtgctaggagtctatcaattttgttgatcttttcaaaaaaccagctcctggcttcattgattttttgaagggctttttgtgtctccatttctttctgttctgctctgatcttagttatttcttgccttctgctagcttttgaatgtgtttgctcttgcttttctagttcatttaattgtgatgttagggtgtcaattttagatctttcctgctttctcttgtgggcatttagtgctataaatttccctctacacactgctttgaatgtgtcccagagattctggtatgttgtgtctttgttctcattttttccaaagaacatctttatttctgcctttatttcattatgtacccagtagtcattcaggagcaggttgttcagtttccatttagttgagcggttttgagtgagtttcttaatcctgagttctagtttgattgcactgtggtctgagagatagtttgttataatttctgttcttttacatttgctgaggagagctttacttccaagtatgtggtcaattttggaataggtgtggtgtggtgccaaaaaaaatgtatattctgttgatttggggtggagagttctgtagatgtctattaggtccgcttggtgcagagctgagttcagttcctggatatccttgttaactttctgtctcgttggtctgtctaatgttgacagtggggtgttaaagtctcccattattattgtgtgggagtctaagtctctttgtaggtctctaaggacttgctttatgaatctgggtgctcctgtattgggtgcatatatatttaggatagttagctctgcttgttgaattgatccctttaccattatgtaatggccttctttgtctcttttgatctttgttggtttaaagtctgttttatcagagactaggattgcaacccctgcctttttttttttttccatttgcttggtagatcttcctccatccctttattttgagcctatgtgtatctctgcacgtgagatgggtctcctgaatgcagcacactgatgagtcttgactctttatcgaatttgccagtctgtgtcttttaattggggcatttagcccatttacatttaaggttaatattgttatgtgtgaatttgatcctgtcataatgatattagctggttattttgctcgttagttgatgcagtttcttcctagccttgatggtctttacaatttggcatgtttttgcagtggctggtaccggtttttcctttccatgtttagtgcttccttcaggagctcttttagggcaggcctggtggtgacaaaatctctcagcatttgcttgtctgtaaagggttttatttctccttcacttgtgaagcttagtttggctggatatgaaattctgggttgaaaattcttttctttaagaatgttgaatattggcccccacactcttctggcttgtagagtttctgccgagagatcagctgttagtttgatgggcttccctttgtgggtaacccgacctttctctctggctgcccttaacgttttttccttcatttcaactttggtgaatctgacaattatgtgtcttggagttgctcttctcgaggagtatctttgtggcattctctgtatttcctgaatttgaatgttggcctgccttgctagattggggaagttctcctggataatatcctgcagagtgttttccaacttggttccattctccccgtcactttcaggtacaccaatcagatgtagatttggtcttttcacatagtcccatgtttcttggaggctttgttcatttctttttattcttttttctctaaacttctcttctcacttcatttcattcatttgatcttccatcactgataccctttcttccagttgatcaaatcagctgctgaggcttgtgcattcatcacgtagatctcatgccgtggttttcagctccatcaggtcctttaaggacttctctgcattggttattctagtcagccattcgtctaatcttttttcaaggtttttaacttttttgccatgggttcgaacttcctcctttaggtcggagtagtctgatcgtctgaagccttcttctctcaactcgtcaaaatcattctccatgcagctttgttccattgctggtgaggagccgcattcctttgtaggaggagaggtgcttgatttttagatttttcagtttttctgctctgttttttccccatctttgtggttttatctacctttggtctttgatgatggtgacgtacagatggggttttggtgtggatgtcctttctgtttgttagttttccttctaacagacaggaccctcagctgcaggtctgttggagtttgctggaggtccactccagatcctgtttgcctgggtatcagcagcagaggctgcagaacagtggatattggtgaacagcaaatgttgctgcctgatcgctcctctggaagttttgtctcagaggagtacctggctgtgtgaggtgtcagtctgcccctactggggggtgcctcccagttaggctacttgggggtcaaggacccacttgaggaggcagtctgtccgttctcagatctcaagctgtgcgctgggagaaccgctactctcttcaaagctgtcagacagggacatttaagtctgcagaggtttctactgccttttgtttggctatgccctgcccctagaggtggagtctacagaggcaagcaggcctccttgagctgcggtgggctccacccagttcgagtttcttgactgctttgtttacctactcaagcctcagcaatgacaggcgcccctcccccagcctcgctgccaccttgcagtttgatctcagactgctgtgctagcaatgagtgaggctccgtgggcgtaggaccctccgagccaggcatgggatataatctcctggtgtgccgtttgctaagaccattggaaaagcacagtattagggtgggagtaacccgattttccaggtgccatcagtcacccctttccttggctaggaaagggaattccccaaccccttgcgcttcccgggtgaggtgatgcctcgccctgcttcagctcaggctcggtgcactgcacccactgtcctgcacccactgtccaacaatccccagtgagatgcacctggtacctcagttggaaatgcagaaatcattcgtcttctgcgttgctcatgctgggagctgtagactggagctgttcctatttggccatcttggctccaccctcccaacttcatttttaagaagagaataactttctattgcatgccaattaaattatttctttaaaaaactgcaatatgtacagtatacaaaaggaaatattatgtcttgattggagtgaaattagaacaataaacactttttgaaattgttgtatgttagtggtagaattttatttttttaaacaaagctcggcattctacatattgtcactagttgctttagtagttattttttcttttgtctgatgatattgttcccttatgttaacattttggcaggctccttggatataaaatattttcaagccctaccagacgttgcttcattttcattctcttttcgttatgtttggagtattatcaaatgagacaattggcatgctacatgtgacttacttttatccatggctatcagtaagcatgagctacagttaaataagaaatactgctaatacaattgaaatgcaaagcatattaaaatgttccagattcgattaacaaaagtagatctcacacgaattttaaagaggctctgctagtgctacacaagatcagcaactgtcaaagatgaatcttttagaagaggagttcttgattttggcacacaggccacagtgagctatataagtttccaggctcaacagccacaggatttagggctccctttgggattgagggtcctcaatactctctcccactcaactttaacccaggcttcgctctaagctgtgcctccaggaaagcatgcttcttgcaggggcctgggctgctggcatgctaatgaacatttctgattgtttgcattccaaatgaccagcacaaagaaggctttctccccacctttcaattgtatttttgttttcttttaagaatagttttttgaacatgcaaaggaaaagcatcttgctatggagcctgtaagagggaattctgccagagtgtaaaattccaagtgttctgaatacagtcgaagaatggatgattaaagcagaggtgctttaatggtgctgcagtggtaactggaaacaggacatttgctttcctccatgttctcagtcccgctgtcatagggcacgtaaatactgacatacctgatgatatttcttcaaagcttgagattgagataaatttggaggtgataggaagaattagctacagccctctttatcatgaaaagagtaaacatgcccggagtacttcatcaagagagggtgccccatctctccctggcctggcacttactacatgacaacacttaagttctgaacctctttggaccatctcaactagtgggcttgaactctacacatctgtgagactcaaagtgaaactccaacccaaactttatatctttagttaaagttgttgaggttaaagggttgtcttggtttgttgttgagtagtgcaaacctagaacttcctttaaaaattctctttcaggcacagtggctcacgcctgtaatcccagcactttgggatgccaaggcgggaggattgcttgagcccaggagtttgagaccagcctgggcaacatggcaaaaccctgtttctacaaaaatgtttttaaaaaattagctgggcatggtagtgcatgcctgtagttccagctacttgggaggctgaggtgggaggactgcctgagcactggaggtctaggctgcagtgacccatgatggtgccactgcactctaacctggaccagagagcgagatcctgtctcaaaaaaaaaaaaaaaatctccttctctatttctctgtgtccctctctatctctctaccacttttcagctaaagcagtggttttgaatttgggcatgttatcagcaacacctggaagatttaaagcacagtgaactaggccgggcgtggttctcaaacttgagcatgcattagcatcacctagatgacttgttaaatcacagattgctggccgggtgtggtggctcacaactgtaatcccagcactttgggaggccaaggtgggtggatcacaaggtcaggagatcgagaccagcctggctaacatagtgaaaccccgtctctactaaaaatacaaaaattagccgggtgtggtggcacgtgcctttaaccccagctactcaggaggctgaggcaggagaatcgcttgaacctgggaggcagaggttgtggtgagccgagatcacgccactgcactccagcctgggcaacagagcaagactccatctcaaaaaataaaaaagaaagaaagaaaagaaataataaataaagcatagtgaacataccctagagtttctgattctgtatgtctggagtggggctccagaatctgtatttctaacaatttcccaggtgatgctcctgctgagagaaccacattttgagagcagaagtgaaagtttaaagattttagagcaggaatgaaaggaagcaaagtacacttggaagaggaccaagtgggtgacttgagagatccaagtgccccatttggcccttgacttggggttttatacattggcttggttccagggtttgtatttcttctcctctgattcttcccttggagtgggctgtctgcttgcacggtgacctgccagcacttaggaggggccatatacgcagtgagtttgctgaaattgtgcacatgctcacttgaggtgttcttcccttaccagtcccgcattcctaaaagaaggtcatatacccattaaactccaccattttgcctcttattgtacatgcttgaacccacttgcccaactcctgagatcttatcaggaagcgctgatcatcagcctcaggtgttttctatctattgggaggctccctttccccgctgccagttgtgaccaggtatcattttagagagacagttaacaactgcctgaccatcacctgatggtcacctgacattcctgggggtaaaggggaccctctccttccctactcatgtcagactacctacttttaactgtcactgctgataatgcttgaaataattatttaaatatggactttgaatccaacaaactgaattggatgtacataaatcagagtttctcaaccttggcattatcgataattggggccggtaattctttagtgtgggaggctgtcctgcatattgtgtagcagcatttctgtcctctacccagtggatgccagtaacactcttctcccactgagttgtggtaaccaaaaatgttctagacattgccagatgtcctttgcagggaaaaaataaccccttgttgagacccactgcattaaatcattcacaggtcactaaaatatagaaaagcattagaagatacattcgtaagaacatgccactataatgcacttgagcttcactttcaacagctggtcactacaaacctttatacactgcctattgcatcttgattctttaattcatcaacttgatgatcctaatatttgctccttctctttttttctaagaggggaaaatcatgaaaggagatgaaaaccacaattgaaatacagtgtaattttactttgggctacttgaaagaggcacagccagaattcctgaactgttcctattgtatatgggatcaatatggctgggagtgttttaatcatgtttcatgtcatatacacctcaatgtgttttattaacttataattattggagcagtttgcttggctttagtagacactataaaagcccaaatttacagaggcctgaaagaggtccattaataatttgaaacttgtcagagtattctggaacgagggtgagctctgaagttcctctcaccaattgaaaagctatttggaggctttcctacttaaaacaatacagaaaaccttcattaattgactgtcactttccttgacaagaaggctgttgttcatcctggcttcttaaagcaccatgacaatagctcattaatacaatacagagtctgaagtaagggaggaagggtactaaaaggttccactgcataaccatgcactcttgtctcttcactgcctaaacctgaggctggggggtggggatgtgaagaggaggcaccatagtgccatcattgaggaggagaaaagatgaagagccatttaatgagtgcggcagtcaggctaaagaaaagacatggccggtttctgtctcccacagttatggtgacaatatttccagagcaaaattgaggagcatggtctgacacaagaatttgtgtgacttccagatgtgaaaagcatctgggaaagggggattgaaagtcagcatgttggaattttctatgatatttatatggattatgtaagaagacaaaataagagaacatatgatatttttactctcccacacatgctgactaatgtgattgaagactttgtgtccagtgtttgaatgtgatcagtcaatgtttgtcagcaagagggagggataaaggaagaaaggaaagaaggaaagaatttggggaatatgccctggtctcctccaaagtaagagtggcctggctggaatctctcaaaacaagctaataactctcatttggttggtgggattacaaataggtacaagttttttaaaaagtaatttctccatccatatatatatatataatatatgtacttattaatttatgtaacttattgattatgtgattatgtaatatatgtaacttattaattactataacccagtataagccaatttgtctataaagaaaatattgcctgcttgttatttgagtgtaactgctgggcaaaataaagtcaatggatacatgaaataggccatgcatttctatagagaaatgttggattgtggcatccttctaaactacagagcagaaaatactagctccagtagctacctaaacccattactggcagagggctttggctgcctcctgaccaccccatcaatgaaccaacccccatctgaatttcctgccctaggaattctctcattgccagcaacaagttcccacacctgtaataacaattgaccgtgaatgttggaccgccaggtagcttctttccccagacaaccccagacacataatcttcccccaatggctagacccataaattcggggcagttaaaatgagctgtctcatttagaagtgaataattcctttaaaaaagaagaagaatctgctgtctttctctctccccacatcctacacacactccctcttccaaccttctccagacttgctgactttttcacttcctttcctgaagtttgtcttttgaatcaaaatcgtcattgcaattaaagctgggtatactgagttagaacaaaacaagaaagttttaactggcttttataacctgtcacaagaggattacaactaccaaaatatcatgccatccaaaaatgtacagggttcagaaaaaaggacccagtgatagttaataaacagcatgtgaattctgtaccacgtaagtgaatccacttgtataaatttggactcaagtttcaatttcagtgggtgacaactatgatggtggtcagaatttgctaactgcctctggctgcattcactcaagtaatattcatctacttctagaaacttgtcaagtcaccaaattctttcttagacaaatgagccagaaagggcaaaactcgcctaacccgcctgaagcctgctgttctgtctctcccagatattaaaagacccggaactctataataacaaccatgcagttcattgcacacatgatatttctaacagtggaaaaggaaagataccatcagctaacaactagctaacaacttcttgttcttttttgaagccaatgactgatctacctttttggttattgctgttgttgcaaattggcccaatcacttaatgattggacaatgtcaacttttaggttaaaaacttcttgagcactcataccaaagagagttggaagtcagaacattggagatttttgaaccttgaaataataccctttgaattattttacaccattaaaatgtctccccatcagatgtattgtaaagtttctcagcaggacgcatcttactttatacaaaggatatgttcctagaaagctagatcttaaggttaaccttaagaaactgccatttttgctagtcacaaatgatcagatatccacaattccatatggttcaacctaaatatgtgaaaataatttttgtaagccaaaatgttttttgttggctccagggaaaattcactagatattcattttatagtgaatgtctggataaggagtggaatccctttgtaaatttggtaataaccaaataatgtattcctctggttccatgctctagttgtttaaagcaggatataccctttgtttctgagaaccagctaaatagagaaaacgaaagccagtgtggaccctctgtttcaagtgaggcttgcaggctctcactccgcatacaccctcgaggttgctttggaagagtccatccctttagttgcacttttgtcttgtttctcccaggaatttctgtttcctgtaataggagtcaggattccagtgaagcggcctacggagaagctaaccaatgtgtggcttagctcagagaccctagacttccctcatttccccttttctttttgccccctcatttccccttttctttttgccctggtaaccatcctcctctgctctgaacttccatcaagcctggaaggaattgatttgtatcctgaattatgcagaatgcaccctgactgcttaacagtgggagttattttgttaccattcagttaattcttttttacttaactggttaaaaaatcatgaattatgtatacctgtctgaactaccagcccatatttcacttccccaaaataaaataagtttcatagaatatacattttaaataactaataaatgttaatgtgtggtatacagtgcccagacattcatttttatgatttgaacaaataccagaaaaacagaacctaatatagtcatctatatcaggaaaatgaccagataatttttactaaccattttccttttagctgatttatgataacatctctttatacaatagtaaggtcttgacattgaagattcattcacatggctctaccaacacggtacatttatttaaaccacacttgactagtggtatataaataatctcccccaaatcatattgatttcccgaagggaatattaaatgctaaataacttcacagattggaagcagccctgtctctgccttcttttttgatataatcaaaaatgatgacattgtagctagcttatttttaataattcacacattgagagcaaaagaaaatattacaccagtgctgggggacatgaactctgggccgcaaagcacattctcctttctctaatgaatgataacagattgactacatcatgtctgccacagattaaaaatgtgtctattcataacggagctataaattagcatagtgcattattctccaggtatcagatacatacatagcacaaggtctttgggaagaatgtaagttatatatctttcattagtcctcacagaatatttctgattttatcaatcctgattttataaatctgaaaattagataaggtatggctttttggcaatgaaagtgattttgatcatattggcaaagtatagctggatgttcaccaaacagtcctcccttctcttctagacacacacctggattctatttttcagcctcccttgcatttagtggtagtcatgtgactgagttttaaaccaatggaatatcagaattctagtcatggtctgtaaaaattccattgcagtccccatattctttcttccccttccgcggtgaaggcaagaactccaagtacctaaaggaaggcagagccataagattgttgaagttcaggtctatgagttgctgtgtagagggaagcctctcagaagacctgaaaaaccaggatcatccatgtgggactattgcatgaacaagaaataaaatttttgttgtgtaaattttagatcgcaagagttaacctgccagaagtaacaacatcatcaacctgaaaacactgtgataaacctggacatatcaaacctagcaagaccttgattctagccttctcaaattgcatgctttcctcacctacacaattataatgctatagttagacccaattatgagtcactatgtctttataatccttgattttcttttgaaaacatagtaatgcacggtacaccctgttttggataagttgactataaaacatatttctattgagaaaatttgattggcttccttttctaaactagagatagtttcaggaacgttttcaataaaataatgtgaaaactttttgtgaggtggtggttgtatgtcagactctacattatggtatatgactattgtaatagtccattcttatgctgctaataaagacatacccaagatggggtaatttataaaggaaataggtttaattgactcacagttcagcatagctgggggaggcctgaggaaacttacaatcatagtggaaagggaagcaaacacatccttcttcacctggtggcagcaatgagaagtgccaagcaaaagggggaaaaacgctttataaaaccatcagatctcgtgagaattcactatcacgagaacagcagcatgggtgtaactacccccatgattcagtttcctcccaccaggtccctcccatgacatgtggggattatgggagctacaattcaacatgagatttgggtagggacacagccaaaccatatcaactatgattatttttacttttctagaaagacactgtattttacaagagaccctagatttcccttgcttccccaggctaagtagaggttccctaattttttaggcacaaacctcttaatgtttaatattgtattcacaatattaagcagtggttctcatttcacacaccccccaccccttcctcaggaagcatttgacaatgtctggagacattttttattgtcacaacttgggttggggaaggtcttgctcttaacatctagtgggtggaaaccagagatgctgctaaacatcctacaatgcataggacagcagtccccataacaaggaattgtccagccccaaatgtcaatagcaccaaagttgaaaaaccctggactaggttgtgagttccatgaggatgaaagtcatgtttgctttactcatcattgcatcttcagcaattcataaagtacctaaaacatagtatgtacccaataatatttgctcaatgaataagtggactgagcccccccgaattagcagattggccagtggggctatacttagccaatgggtaaggcaggatttggagttaaaaccttagctctacagcttagctcaaatgcattcttaagcaagtgactccatctttctaggcctcagtcttctcatttgtaagttggggatagtaagtgccaacttcatggagctgttgtaaggttaaatgtgatgaagcatgtagaatgctcagtgtagtggctgacggcctcaataaatattcttttattattactaagaagaaaggaaccaatgtttcctgggtttttatcatgtaccaggcacagagttaaagatgcgcatggtctcatttaatcttctcaacaatatttacggagtagaacttttgaaacaaaatgtgaaactgggttttagagatatcaagcaacctgctcaagatgatgtagccttttagaggtagaaactgcagtaggcatactgggagaaatcaagttcactcacctagatacagttttcatagttgtctctatttttaagatgcaaaaagttaatcccagaataccataaaacttacattgacttcatagtaacaaagggatttaataaagtctcaaatttcctattaaagtttatccaatagccacctactgtttaacaaggtttagcaaattaaatgtaacaatgttttgagaatcagaataaaataaaatcataaaagaaaaaaggctaggtgattattatcttcttttttctttatgtgtcattctttgggtttcatatttgttgtctcggctgggtgtggtggctcatgcctgtaatcccagcactttgggaggccaaggcaggtggatcacgaggtcaggagttcaagaccagcctggccaatatggtgaaaccttgtctctactaaaaatacaaaaattagccgggcgtggtggcacgtgcctgtgatcccagctacttgagaggctgaggcagagaaatgcttaaacccaggaggcagaggttggagtgagcctagatcgcgccactgcactccagcctgggtgacagagcgagactccatctctctctctctctctctctgtgtgtgtgtgtgtgtgtgtgtgtgtatatatatatatatatatatatacacacacacacatgcatatatatacacatacatatatttatatatataatatatatttcttgactcatctccttttacaataataccataatatttgttgatgcaatgacatttggattctgttgtaacttttgctgttatttcacatgatataccagctcgatggagttttgctggcttcaaaaaagcaaaccacaacaacattcagaagagtctgggggcccataaaggctgggaggcagagctactggtgacaagaggagtgggaggccactttgaatatggctattccctttgatgtgttactaacaatcaccacacagtagcaacgcagtagtccctgagctctctttaaactgtgtttttcttcaggaaaaaaagtcataagaaaacgttgacctgctaatgacataataagtgaagcttaaagctaaatgtacctttaaaatgtcacaattaagtacaagcagtaaagtataaataggaagactttataaccactttaaaaagtaaggtgactgacaggttattttgcctgttggacaaggcactgggtagggagagggattgggctaagtacttcattattcattggttttaaaacattcacttacatgttcttttcctataaaactaacatcatatggttttggtacaataggcaataactagtctatcaacaaaagttacgttataacaactctccaagagatgttttagcaatagatttgttttagatatttatattaggataaacctcatttcattcatcagacactggagatgaaacggaattggcattagtcagtatgtgttgattttcgaagaaaaaggaactattttgaactttttcatccactatttggtctttcttgtttttaaaatgagaaaattatattggaaaaaaggattcaaagcacctctaaaattcttcaatcacatcttactttatgaattctctattgcctttatttttgtgtacaaaaagaatgtattaaacattgccttcaagggctaaaaatctgtctttagatataataaacttttttttaaacagactctcactctgtcgcccgggctggagtccagtgacatgatctcagctcactgcaacctccacctcccgggttcaagcaattctcctgcctcagcctcccgagtagctgggactatgggtgcgcaccaccgcacccggctaattttttgtatttttagtagtgatggggtttcactatgttggccaggctggtctcgaactcctggcctcaggtggtcctcccgcctcagcctccctaagtgctgggattacaggcataagccactgcacccagcctgatataataaacttaacaactatctgcttatattttgcagttacttcgtgaaatgtataagttggtagctaaataccacatttacttgtgtggattttgcaaactgtaccattttagtaagaaatagtaataatacttaaagattaaaggtgctgatggcatgatttttggttactttttcttcttgaatcttggcacactttttgtttgctcctgaaaccgtaatgtagtgacaagttactaactaaaatatatctctagtaataaattatgttgttcattgtattagtcatcttggactgccataacaaaatactacagactggatggcttaaacagcagacatttttttcacagttctggaggctggaaagtccaagatcaaggtgtccacagattccattttaggtgagaactcacttcctggctcgctgcagcctcacattacctttccacagtgtgtcctcgtggagagagaacaagctctctggtgtctcttcttataaggaaactaatcctgctggatcagagcctcacccttatgacctcatttaacattaattacttcataaaagccccaactccaatacaaccccactgggggttaaggcttcaacatacgaatttggggaagacacaaacatttagtccataatgttaattatttgtagaaaagagtaaactgtccaatagagtttttgataactatcaactaactttcctggtggttaaatgaacatggaaaaataatttgtattggtgcaaatgtgagtttgccttcgaaaaacacagtgatatttattcaacttgctcatagattctgataaggatgtgtaattaaagacaaataagataactaaaatatgtcttggtgtatatgtgatttaaattttttaaggaacttttcacacagatcttcttcagtttgtataataaaactattcatcagactcagtttaaagaagatacatctttctgaacagattctccacgatttttgaagacatactatactaaacgttcttctcacaaaaacaaattcaacctaggactcttgacagcttcattttcaggccagtgagctaggatgaaaattgagctgcccaaagagagttggccaaatagtttactcactgtaattaaaaaaagggaaatttcgaaaccacagtcgtcttcaatgctaatgtgaacaaccaaatgttatttccagtggattttgtatttccttattcttggcaagttggtacagttctgtgcagttgggaattagacactttttccttaagatagaaatattctttgcattaaatgcagagtggcataattatatgttcactgcatgcattcagtgcagaaacatgattgcaataattttgaatttgaacacttagctttacacctttcatttttaaaaatcatagcaactatgtacttctggcagaatatttcttgtggtcaatgttatttacttatgcaattggaaaatgacttgattgcaaccacgttgaaaatctttgccaaggtatgagcttttcttacactggagttttctttatgagaataggtaactttattttgtgattttatttggttctgctcaatgactcaatctggcttaggagacatacttgacaggttttgatccagggaaaaatgaatacaagtatttgcatatgagctgctataataaacaaccaatgtccaattgactacaatattaaaattagtatatcaccttggtattgggcacacaaataagcaagtgttgataacttccagatgttttactcttttaactgctgccgcatctcctctaattccaccttcttctttaaatagaacaaagtttaaattctgagcttcccaaagaaacttttccaagtgctccgtttctcatttaccagccacggaatggcatcattgtgtatttgggaagagacaatgggggtcgcaggggaagctgggaaactgggggaggccaactccctattttgtccttctaagcatgctaaaggggtgtttgagcagactttggccactgtctattgtgtatacgtcaaagttttttgaatggcttcaccacttttgcacatcttcatgggtcctatttaccagccttgagatgcagatggaagtaaaatcctaaatctgttctggttgcgatgtaagaactaaggaagggataacacttcagcactaatgggattcacactttgttagaaaacagccatgttgctctaacctttgcttgcatcaacagcggctgctttagagtgagtatttacttttcctcttgcctgtgaggttatattaatttctttttccagcttgatggtttgcctgttctggattttacatttaaaaaaaacaaaaaagtaagtaagtgtttcatcactacattctcaatggtttgtgtccaggcttgtaagctgctctttagttaccaaaataaatgactttttgtcttcataattcaacattgtttgtagatggcattttttaaagtaatgctaaagtctccaaattcatttttcccacgatgtcacaaaagaacattattattgcacatgtagactccacatcatcatagagtaggagagacctggtcttttttccaaacagtcaaaaatttgattctcctttaattgtatttattgaaggcaaatttagtttttttcctaagatgtcttaaagctgcttcctcttttctctgccccagaattacataagattgtgccccttaatctatcatttgaagtcatgctctcctaaatgtaaagaactttttggaaagttctttttattctatcgtcttcttttttctttttttgagacagggtctcactgtgttgcccaggctggagtgcaatggtgccatgatagctcactgtagcctcaacctcccagagctcaggtgatcctcccacctcagcctcctgagtagctgggactagaggtgcatgccaccatggccggctaatttttgtattctttgtagagatggggactcaccatgttgcctaagctggtcttgaactcctgggctcaagtgattctcccacctctgcctcccaaaatgttgaaattacaggcatgaggcatcatgcctggctaccctatcttctatactcatattttttacagcccataagtataaaatacattaaatataaggaaaattataacaggtttttgctatgttgcaggataactttaccttacaactatattacagtaaaactttattaaaactattgagctagccaggcatggtggctcacgcctgtaatctcagtactttgggaggccaaggcaggcagattacctgaggtcgggagttcgagaccagcctgaccaacatggagaaaccccatctctactaaaaatacaaaattagccgggcgtggtggcacatgtctgtaatcccagctactcgggtggctgaggcaggaaaatcacttgaacccaggaggcggaggttgcagtgagccgagatcgccccattgcactccaacctgggcaacaagagtgaagctccatctcaaaaaaaaaaaaaagtattgagctagccacttttcctaatctacatacaagtgtctatctaaaaactgcacaccgtaaaaagatctagacagtgctttaacatatttgaagactgtatttgtgattatctgacttaatttgtagactctgtgatgtccagaaatttattttgcctcacagagactaagggtgacaccagcaagaagtacaacataattactcaggaaaaaggggcaagctcaagtaactgctccagggaaagatcagccccttctatcaatacagggccagagaaaacaagtgatgagtccaatgtgagcctccaaacaaattttacagggtcaaagctccaaactgcagccttcagtttacaatggaacggtttctcaaaaggacaactccttatagaaaataaggggagagctgcccagagatttagttatttaatgatggttaaaagtgctgaggccagatggtggaataaaagtgtttataaagttttccctagatagaagatatcagtcccatttatttgcacaactgcagcacgttttgtcaatttagtctgttgtgcatccaccttggtggccccttcccagggccaacatcatgttgagaaggaaaaaaatcatttttcctctaacctcttagattcagtgaccagggccttgcaaactaaacttgaaaaaaaagattaaaaggaaaatggagtttatttcatataagcattggggatctcacagaaatgaagtgaaaaccccaaagaagtagtcagagccagggccttatataccattttagcaaagggaaataaatgtatgaaaaaataacaagtgaaaggaaagggtttggggctgctaggggcagtacattgtaggaaggtagatacatggaggaaactaatggaagacaagggttattttagtaaggtttatttgtttatgcagatttaaattcttgtgatctccagtaatagaagttgtctcctctttctggtacaagaaaaaaggagaggggacactttcacaaaggaaaatgtattccctgcattccctgcctttacggggaaggaggaaggaggaaactgcggtgttttttttttttttttctttttcttctttttttttgcatctgctgtttctcaattgccttcagctcaaaataatccttatgacaaagtagcatattttgtggtggcatattctgatatctttcaatggggaaatgattgtacaagtgagaagtgggagcactgaggatattgattccctggctataaaatggtgctccattacccttcctgaatcacctttagtacaacattcagaatagcatgcccatatagattcagcctaccttactatgaaatgtgaactggctgcccagaaccatgtgcataagacataagctgtgcataagatattagctgtgcataagacataactatgtatataagacataagctgtgcatttaaatgagatccgttttttaaaaactaaggcagatcatcatttacatttaattcaagggcgaacacaagttggtgttatgaggctatttcatttctctgttttttctggatggttgcagggatggggggcaggtgtcaccacatcagaatgtcaacatgtgaccagagtaaatggtccctccagaccatggctcaaatctcagcctgcctgatgaggtcatggctcaatggaaaacatgctctctccatcattgttcaacttactagaaatattttagaaacacgcaattaaagatatgcatcatagcactgaggaataagaaataattggggaagcccacatcaatactttgaagtctatgcctctctacatactatatttcaaggggttacatcagtggttctcaacagagtgagagtgggggtgattctttcccccaggggacattagtcaaattctagagacatttttgattgtcacaactgagatgtgggggatgctgctggcatctggtgggtagaggctagggatgctgctaaacgttctataatgcacaggacagtccaaaatgtctgtggtgctgtcatggagaaaccctgttttcaatcaccatacaccacatgtcagcacacagccaccccctgctgcccaaccacggctccaaaaacaaaccaccactggcaggacacccgcagacgccatgccagatatttagaaagagaccaaaaccttcaatcaattcgtaaaaatcttatgtgcttttaagcaaccacactgaatcatgagtaaagatatttgagcttttttttaattagcctcattagagcagatttttcatggaaaaaagtcatcagtgatgaatgcacacaggcaatcatgaataaatcatcttctctccttattctgaagattcctgctaattcggagacaattctcttccctcaattgccctgttccaagcttcttttggtttttctcaatatttcttttggttttgtttggactaatatgaatttggggaacatcctctgaggcattctgagatccagtcctttcaatgttgattcttggacggatcattaaagagctattaagagctggcagtggtgtccttttgtagaatagtcagcattttcacccactgagagtagccctgcgaatcctttgtttctacttcttggagggagtagcagatttttgtaactaaaaagcaaaaccacctggtagatttctgaattaaaggaatctccaatctctcaactttttcataagtgggagaaatggtattggagtcctagaggtgttcctacaccctatgcctattgaagtggaggcaggagggtagccaatgtataagaaagtaaagatttcttactgagattggaattgcactaataatgactttttaaaaacagagattatggacaaggtcagcctcctgtttgttccaaacaaggtgatcattagccagcatatagttgggtgaaaattgttgatcgtgaccacttatagttaatgttatttttggatacatcattgttctacaaacaagtcctaacttagctttccaggtgcttcctggtctagagcagtgctgtccaatagaaatataatgccagccacatatgtattaaaatttttcaggtagcaacattaaaacaattaaaattaattgtcataatatattttatttaacccaatatattcaagttattatcatttcaacatgtaattgtcagcagcagtgaatccgtatgggtctgcagcaacctcaattcttgcttcctcagaagaaagacttagaccaagggggcataactgcagtgtgagagactgaggcgagttgtagagcaggagtgaaagtttatcaagatgttttagagcaggaatgaaaggaagtaaagtacacttggaagagggcaaagcaggtgacttgagagattcaagtacattgtttgacctttgacctggggttttatatattggcatgcttcagtgttgcatctcttctcccctgcttcttcccttggggagggctgtccacatgcacagaggcctgctagcatttgggagttgctgcatgcatagtgtgtttactgaagtgatgcacatgctcacttgaggcatttttcccttttctagtcgagtgatcctagacgaaggtcatataccagttaaattctgccatttttcctcttagtgtgcatgcttgagcccactcgcccaactcctgagatcttatcaggaagctgctgatgaccagttttaggtgttttctatgtattgggaggctgtctttccctggcactgggtataaccaattattattttagagagacagttaacaaccacctgaccatcacctgatggttgcctgacattcctcattgtgtgtgtgtggcggggggctctcctgccctgcttctgtctgactaaccacctactataacataatcaatatttaaaaatttactaaggagatattttgctttttttcatactgtgtatttttatatttacatcccttctcatttcagactcactgcatttcaaatgatcaatagctacatggagctggtggctactgtattagacagcacagtctagcccctgcctattcctccaactctgtaattgcctgatgggttcttcctgcctgctgcgcagacaaaaatcagtccgctgagactatggcattgcagtaaagaaagagtttaattgacaaggccagccacaccatgtgggaaatggagttattactcaaatcaaactccctgaaaatttagaggctagggtttttcaaaaatactttggtgggcagggggctagggtataggtgctgctgatgggctgtgaatgtaatcataaggatgtggaagatgggcattcaatagtcagaaatgcaaaagcctgaaaagatacctcaaaaggccaatcttaggctgggcatggtggctcacacctataatctcagcactttgggaggccaaggcaggtgggtcgcttgagcccaggaatttgagaccagcctgggcaacatggtgaaaacccatctctacaagaaatgcagaaaaattcactgggcatggtggtgtgtgcctatagtcccagctactcgggaggctgaggtagaaggattgcttgagcccaggaggtggcagctgcagtgaaccatgactgcaccactgcactgccgcctgggcaagagaatgagaacctgtctcaaaaaggaaaaggggccaatcttaggttctataatagtaatgttaattacaggagtaattggggaagttgcaaatcttgtggccccccaaataatggctggtaatcatttacctactctatatcttagcagacttcaggcccctctcatcgtcctaacctggtggcctttcattagttttacaagggcagtttcattttggggaggggctattatcatttaaactataaactaagtttctcccaaaggtagcttggcccaagcccaggaatgaccaagggccatttggaggaccaagggcagtttaagggcaagatggagtcaattatgtcagatttctcttagtgtcataattttcacactgttaaaatttttgcaaaggcatttttcaactccatctattttttcaccatgctttgtaaaattcgcaatccagcactagtgaacgtctctcaagtcctttgccccaagtgtttgtctctcttatttcttggtctttgtacaagtgttttcctggaacactttctccaccatccctcccacccaactaggctaattccgacttacccttcgcaaaagttgattcctctggaaaaaaatggttggagaggaaaaacttttcccctacactcttaggtttggtgcctggggacttgcaaatttaaactgacaaaacagattaccaacagaagagacagaatttatttacacacacattgtgcatgcaggagtgctcagtgatgtataactcagaggggtggttagaatttggggcttatatacctagcttgttaggggaaataaagagtggagaaaaggcttctatggaaagaacaaataggcttatttaaaagaaacaaacggctttttaggaaaaccaacaggagagaagaaagtttgtgataatgtttgtttatataagtgagattggtgtttccatcttcttcgtggccatgaaactcccccagagagggaatttatggtaggtttactctttgtctctctcctgggagtagaggctgccccaaagaaagaatctgtggcagtcctcattactcagaagtttctgctttcagtcagaaaaaggaagctccacaaagacttctttctgcatctgttgactctcaaatgacttcaggttaaaataatctttatgccaactcttgggttctgagtgagtccccaaggaaccatagaagaggttaggttttgctacttcattccctaatgctacttttacctcccattccgtaggtctcattcacttcactgtcctcgcaagtttagtgtctgtttttccaaataaactataacttctgggaaggcaggaatagctctgactttctgtttattagtgtgaagtcatcatctagaacagtagactagcacataatagatacttgataaatacttgtggaaggaatcaaccaaatataagcacacacacatacatacatggtaatattcattcagattttaaatatcaacatgtctaatcctaaaaatagatgtactcaagctatgtatatttgatagtcatttagcctctctgaatatatatttctttctccaaagctagaactgttaatatccatcatccctattttaaaggattcctctggatgtcaaaaaataataatgtgaaagttaagggccaggtgcagtggctcacgcttataatcccagcacttcgggaagctgaggcaagagaattacttgagcccacgagttcaagacaagcctgggcaacacagtgagaccctgtctccaaaaaaaaaaaaattaaccaagtgcagtggtgcacacctgtggtcccagctacttggaaggctggggtaggaggatcacttgagcccaagaggtcgaggctgcagtgagccatgatcataccactgcactctagcctgggcaacagagccagccctcatctcaaaaaaaaaaaaaaaaaaagttaaaacaccttaaattagttagagtatatattgtgtttagtcaaacttactgcatctttcttacaaaatttattttttataaacaaatcgatcagagggggcatcatagaaatttaagggcaggaaaataatggaatatgtaaactacttgaaacaggatcgttagagataaggaagtcaggctagaggaagagttggtgggaaggaatagtgaattcagtttctactcatcattggggaagaagtgttgattagttaccttcgaactatccttttgtctcattcaactaaagactgaaggagaaagaaatatgaagctctgggaaaaaccaacatgttgaaggtgagccatgtaaaaaccaccataagatgcctgaagctacactattttctgaattataattctagacttgacctgttcaatatggtagccactagctacacataactatggggtatgtgaaatatagtgaattcaatgtgatatatgctgtaagtgtgaaatacacaccagatttcaaagacttactacaaaaaaagaatgtaaagtacctcatgaataatttttttttttgagatggagtttcattcttgttgcccgggctggagttcaatggcatggtctcagctctctgcagcctctgcctcccgggttcaagcaattctcatgcctcagtctcccaagtagctgggattataggcacccgccaccacacctggctaatttttgttgtatttttagtagagatggggtttcaccatgttggccaggctggtctctatcgggggaaccagcccccagtatttcaacgtatattcttttctattttccctaagtgttggctggtctgagaaataaagagaaagagtacaaagagaagaattttacagctgggcctccaggggtgccatctcacatcagtaggaccgtgatggcaacctcgagccgcaaaaccagcaagtttttattagggattttgaaaggggagggggtgtacgaacaggaagtaagtcacaaagatcacatgcttcaaagggcaataaaagatcacaatgcaagggcaaaattagaattactgatgagggtccatgtcccgctgtgcacacattgtcttgataaacatcttaacaggaaacagggttcgagggcagacaaccagtctgactagaattcaccaagatggaatttcccaatcctagcaagcctgagggtactgcaggagaccagggtgtatttcagtccttatctcaacagcatgagacagacactcccagagcggccattcatagacctcccccaaggaatgcattcctgccccagggtatcaattattaacattccttgctgggaaaagaattcagcgatatttctcctcctcacacatccatctataggctttctgtgagaagaaaaatatgctctattctgcctgaccctgcaggcagccagaccttatggttatctttccttgttccctgaaaatcgctgttattctgttctttttcagggtgcactgatttcatattgtttaaacacacatattttacaatcaatttgtacaataatggtcttgaggtgacgtacattctcagcttatgaagataacaggattaagagattaaagtaaagacaggcttaagaaattataagactattgattggggaagggataaatgtccatgaaatcttcacaatttatgttcagagattgcagtaatgacaggcataagaaattataaaagtattaattttgggaactgataagtgtccatgaaatcttcacaatttatgttcttctgcctcagctctagctggtccctccattcagggtccctgacttcccacaacaggtctcgaactcctgacctcaggtgatctgcccgccttggcctcccaaagtgctgggattacaggtgtgagccactgcacctggcccatgaataatttttatattgactatatgttggaattattgtattatggatatatattgagttaaataaaatgcactattaaaattaatttcatgtttcttcctacttttataatgtggccactagaaaatttgaaatgctgtatatggctcacatttttctattagacagcactgagctaaaatattgtattagaagactgccagaatgtagttcccacactcctgaggatcctgggcctgtgagttaaatcacaaggagacagtggtagggattccagtaaaagccatcacaaatagagatgccatccactatcaccatcatttcaaagcactaaaaagaatgcctaacaacacaaaagtgtaactggtacaatctcagaataaaagagagtcctttccattgaataaattgccttccaagaacaactctgtatatggttcttattttgcccatttcgatttagaccagggaatcctttgacatggagcagtacttgggaaaactgccttacagatctctagtccctccctctgagtatgcaggtgaggaaactgaggcaccaagaggtacagtgattcacccaagatcacacaggacctgaacccaaagaatagacttcacctcaaatgtagtaagtggtttgaaggggaagcctgactgaatgcttggtaaccacatattgtaggactgaagtcggtggtgagcactggtcattaagatttcaattatacaagcagtaggaatatgatgttgctaaagtagccaccattatacctagtttcttgaattcatattttagaaggataacgctaacagccttattgtcacaaagtgcaaatctcttcttacgattctcttcttataatctttcaatggtttctttttgcatacatgatgtattggaatcattttagcccggtttggaaatactgctttttgaagtcaggctgaattgaattgtaatattgactctactacttgctagccaagagatctctagccaggtacttaacacctcaaagcccaagtctcctttgtcaaatggagttgcaaatcgtgttgacctcatagatatttgggaaggattaactgaggtaatgcttgaacaactctcagcatcttgattacagttagctgaaagtctaactgagggttgtcattgttgttggtattgtcataacttgcctcccacccaccctgcccctcatttcctgtcactccttagacatgaatccaagagttaacaagcactccaaatttcctgttttctggacactccaagtttttacacatgttattttctctgtctataaagagtacttgtcttttaggatttagcccaattctctaattaaattcttttgaagcaatttcaatgaaattctttccagatattgacaaaatgatcctaaagttaggccaaaagaattgacatgaaagcacagccaataaaaggggaaaaaatgtgtaaggagaaggaaattggccctaccacatgaagaggcactataaatctacatttggaaggggagaggaagaggtaaaaaaaaaaaaaatctacaacatttgaaacacggtgatatcacaagactagaatacaaagcccagaaaaaaagactagacaggcagatagagatttaggtatagatatggatatataggtgtggacataagttttggtgtaggtatagatataaatgtaggtataaatatacatagatatagatatttatatggtttggctttgtgtccccacccaaatctcatgtcaaattgtaatccccacatgtcaggggagggaactgatgggaggtgaggtggatcatggggcggatttcccctgtgctgttcttgtgatagtaagtgagtttttatgagatctgatgattttaaagtgtggcacttcccccttcaccctctctctttctcctgctccaacatgtgataaaggtgcttgcttcccctttgccttacaccatgatcgttaagtttcctgaggcctctccagccatgcagaactgtgagtcaattaaacctcttttctttgtaaattacccagtctcaggttgttctttatagcagtgtgagaacgaactaatacagatacagataattaacacatgtaaagtctgaacacctcagtggtgtaacataatctaatcagaattcagtgaagtcattagggaactttgtcccattctgtcaaatggggcacacattccctccatctagtagctctgtatcctgctagatcctcaaaatcctctgctggatactcaacatccatccaccaaataagatagagaaataaatacagactaggccagcggttaacaagctttttcagaaaaaagccagaggataggtatttttgtgacacaaagaacagtgtatggcctgataaattttgcagacctcacatagctcagactgttctgaactttttcttttctcaattcatatgtgccaaggtgggaaagagacagggatttgcttaacatatggcattgtctctcctataatacagtatatgaatttaacatataccatcagattactcaacatatgggtatgaagaaaattggctgtttgagaaaaaaaattgaatctcacctcatgccacaaactaattaaagatgaattcaataatcaagtgaaaaaaagcaaaattattttaaaaagacaaaattgatttgtacatttctttgttcactaaatatggaaggatggtctaggtgtgagtaccgtagacaaaataacaaaacagttgatgctatatttgtgaacataattttctgccttctgaaagataaaaagtagtaagaatgaaattaaaaggcaagcaacaaaaaggaggaaaatatttgtcagaaagaggatagaagtaatatccttatataaagagctcaaactaataagaaaagtaccaaaatgctggttacaaaaatgggaaaaaatacttttgaatagataatttagagaaaaggaaataaaaatattttataacctcataaattatcaaagtgtatacatttaagaatgcaatgtgattctatcctctttctcctaataaaagagattttaaaaaaatgtttagccagcacgtgcctcacactttgtaatcccagctacgtaggaggctgaggtaggaagatcacttaaggccaaaagtttgagaccagtctaggcaatatagcaagatctcatctcaaaaagaaaaaaatatattggcattggctgggagcagtggctcatgcctgtaatcctagcactctggggaagcgacgggaggaggatcacttgagtccaggagttcaagaccagcatgggcaacataaggagacccccatctctacaaaaaatagaaaaaaaagtaggtaggcatagtggcaagcacctgtggtctcagctactcagaaagctgaggtgagaggattgcttgagcctgggaggtcaaggctgcagcaagccatgatcacgtcactgcactccagactgggtgacagaacaagaccctgtctttttaaaaaatgtttaatgttggcataattcagtaagaaaatctcatgtcctactgattaaaataaaatatgtaaaaccctcctgtaaagctttcgcaataggcacaaagaactttaaaaatattttgactcaccattctcacttggactcaatctgaaagaaataatcacaaatgcacatctactgtatatgctaacatatctaacatactgttccagacaggactacatttggctgcctgtaacagaaaccctaccatactgaattgaacaaaagaaggtgatgggggtatttttctcgtgcaagaagccaggcatttggcagtcccaagccgatacagttgtttgagaaaatcacccaggtagcttcttgccctgccttctttaggctgacttttgtcttcatagtctcaagttccaggcaggaaaaagggagaaatttaagagacaaaagactcatccttgggaggttttgtctcttttattgataaaattatcgtgtctagataaaattatctagaaatttatggctctatctatttggcccaactatgttacttggtccttcctacctctgaaggaggtcagggcagagaatatgtaaaacaccggagctgcaaatgaaatttgggtgttctgttagtcaaaataaaggtaacagtggatattagacgggcaattccaagggttgggcaaacacaaagatgcactgccaagatccccttccaaggaaggacttgctatctcactcctggaatggggtccacagacacctccacccataaggtcacagctcagaggctgcacaattatagagagtcacttcacccaatgtcccctgcttcccagagcagcctgcatctgatgcctgagaaagacagggacataaagacacaaccatctatatcccacatgagacaattctgatctgcaacgcttgttccagagctctcagccaggttgtccaaggatttgtagggcctggattgcagtttggctgctttgtctgcccaatcttgcttcttcccccttctctttactgatgtggatctctagtaagtatcttcaccccaaattccacctcagcatgtgtttctggagacctcaatctgcaacaacaaagtattttttataatagtgttgggactaagggaaagctttacccttgccctgtggaggtttgctgaaaatttcagacaagaggcagattaataggagaaaaggcatacaattttatttgatcatagttttacatctgtgggggccatgttgtgggcataagaaaggtagtcaatgtatgtgggaagctgctggtctcagtaaacctggaagtgagtcatccatgttgaccaacactagatctatgcagaagatattggtgatgatgaagcctagtctcttgggcatataagagatgaagaaggtggaacctaatccattgaccccgaaccccttagacacagccccctgcccagccagcacacccgagccttaagggttgatggtgacaccaaacccccttccccagaaggatggtcagcaccaccatcagctctcaagatcacagactctgagccatggtgatgatagtgactcacatcccaatgccccagacccacaggatcagagtcttcacattaaccagattcccagatggctcacattctcatgaaactgcaagaggcacagacacatccttgttaaacacaaaccttctcatccactggtccactggatagaaacctaattttggatttgtgtctctgcatcccaccctatttctttccatcttgtactacacaggtaggggtgagtgtgtgtgtgtgtgtgtgtgtgtgtgtgtgtgtgtgtgtgtatgagtatgtggggtgtaggggccgaggggtcccctgaagtttcactgaaaaaatcaactcacaaaagacagattaattggagaaaaggcacacaaatgtatttaatgtatacaaataggagccttcagaaggaaggcccaaagatacaggggaaattatccatttttatgcttaggttcaacaaagcacggacagcgtgtagaaacagggttggacaaaaagggcctgatctaaagctaatggactgagtgtggaaacccagcaaggcctgtctgtctagattcttcttggcctctctgagcagcgttccttccttctgggtgtaaggcaagaccctctctggaatgggggtgttatgacctacagtcaaacaaggtatgtcagggaatttcgttatggccagtttttacacagataaggtggagggaaagttagagtgatatttttagattttatggctggctttggggaaaagcagttttggtttctatgatccaccttggggaagaaggattctagtttctatggctagcctcaagggagaatgtgactgagagacagaagggaaggagaaggtcagagagaaacttttgcttctgaggccttcattttggggtattgttttctgagtcccaacaatagtaaatacacagcaatagaaaaaattaatactttatagtataatgaactattatggccattgaaatgggaatttacatgaaatttttaatgacataaaatattcatgacatgatatttagttttaaaaagatagaagttgtggcatatgtatataatagaatactatgtagcaataaacactaaaggagtaatgatacatgttacaacatgaagttcaaaaacactttatttagtaaaagaaggcaaacacaaaagactatgattccacttatatgaaatgtccagaaaaacagatctatagagacaggaaggagttgcctggggcttggggtgggaacaggaattaaccgtaaataggcataagaggtcttactgggtgttaaaaacctgaattttaatgatggctacataacttgtcaaatttactaaaagtcattttaaatgggtaaattttataatatgcacattttacctaataaagttgttacatattccaaagtaatgacacttagaaaaagacacaattggccgggcgcggtggctcacgcctgtaatcccagcactttgggaggctgaggtgggcagatcacgaggtcaagagatcgagaccatcctggtaaacatggtgaaaccccatctctactaaaaaaaatacaaaaaaaaaaatagccggcatggtggcacacgcctgtagtcccagctgctcaggaggctgaggcaggagaatcacttaaacttgggaggtggaggttgcagtgagcggagatcacgccactgcactccagcctgggtgacagagagagactccatttcaaaaaaaaaaaaagaaaagaaagagaaagaaagaaagaaagaaaagaaaagagagaaagaaagaaagagagaaagcaagcaagcaagcaagcaagcggcacaatttaaaaatatatacacctccactatacacccaactagttgaattttatctctatctgcctgtatgtgtatcaaactgttaatagtgactgtcacttcattttttagttatgggtgatttttattcttagatagatcttttaatatccacattttctacattgagcatttattccttaaagcagttaacttacaaacaaacaaacaaaaagccaaaacgaaacaaaatcttttttaaaggatgaagtgctgccaggcacggtggctcatgcctgtaatcccagcattttgggaggccgaggcaagtggatcacttgaggtcaggagtttgagaccagcctgtccaacatggtgaaaccccgtctctactaaaaatagaaaaagtagccagatgtcgtgcacatgcctgtagtcccagctactcatgaggctgaggcaggagaattgctcaaaccagggaggcagaggttgcagtgagccaacgtcgtgccactgtactccagcctgagagcctgcctcaaaaaaaaaaaaaaaaaaaaaaaaaaaaaagatgacgtgcaattccttctgtgcagatcatctcctgcccttccagaatggctggaacttagtcttcaactcctacaagcacatgttaaatcacagagtacttgcttgtgtgtttatgtctctgtgcgtgtaatatttaattgaataatgagagaaggtccaaatccaaagaggaggaccaaagacagtagcttccagattcattctttttctttttcttttttctttttaatcaagttctcactgtgctgcccgggctagagtgcagcagcatgatcatacctcactgcagccttgacctcctgagctcaagcgatcctcccacctcagtctcccgagtagctgcaactacagatgcatgccacactcagctaatttttaaacttttttgtagagacagggctcactatattgccaggctggtatcaaattcctggcctcaagtgatcctcctgctttagcctcccaaagtgctgggattacaggtgtgagccaccatgccaggccagatgttaatgattctgtcattaagagttgatagaaacatttgaagtgaaactttttatttctagagaatcagggctgagttcatccaagcattctttcagaagagtgacctttcaagggttgaaataacagctctcacgtaaagtatgagagatttcagttgagatcaaggaagagaaaatgactacaattgagcacagtatgccaaagttgactaaaagctgattactgttaaactggtctataagttcagttaaagctatactctccttctagtttcacacaaatgactctcattatttcaggactgtgtgtttaatcaacttccacccaatgccccagatttgaccctttgcctgtggattgctctcttaccagagaggtaatctgacattcaaatttgtccatatataacttctagaagctggtttaaaagcactttcaaagtattgttatacgagaagttagcaatttgacttccaaaaataagttgtattttaatatattttttaaaatattaatgatcagggaaaaggtagtgagagtacagcatagaacattacatgaacaccatgctttttcttttctgatatccttgtctccattgaactatatcctgctaattcactgatttaaatgtgagtttatttattattctcactgaggtatgactaatttggagtcaaattatatttattttaacgagctatcttttttaaaatgcattttatgttgctggtgctcttgtgttacacaaatgaaaaataaaatttttatttttacatccgttaaatactttgcagcaattaaatgcttacagatagctgaacaataaattcttcccacaagcagaaaaaagaaaaagtgctttgccagggagcataataattaggtttcaattatctacaaagaaaaaaaaaagataaaaagaaaggaaaagaaaagaaattaggtcaaactttctgacaatcaactcaggttattgtcctctgaggttcattttgaaatacagtttaattttctatgcacatttattataagaatattataagctcacaatcttagaaaagttaaattgcaatcccatcacagaaatataaccaatattaacatttttttttattgagatggggtctcactatgttgcttaggctggttttgaactcctgggctcaagcgatcctcccatttccacctcccaaagtgctaggattacaggcatgagccaccgtgcccaactcatattaacattttgatgtagcttctcacagaatgttttcactataggcacaaacaaaagatattatttgtttttacacaaaggtttattcaacaaatgtttattgagtgtctattaagtgccagtgttatttctactgaatgacaccatagctacactgccaactcagcattcactatcatttgaatgtcctttcgtgtgaataaatttggatgtgctatatcattttaatgactgtataattacaagtgattgtactctccaaaatgacaacagcaacctttccattcgcccccgcatactttctgaacctcaccatgccccaccaagaggtagaatatatggccccttaccttgaacatgggtgaagttttatgactgcctcagtccagcagaagtaacaccatgtgatttccaagagagattgtaaaaggtgatatgacttctgcctagcctcctcttagaacattcacccttggaacccagacagcatgttgtgagggagcccaagccacatggagaaactgtatatatatgttccagctgacagctcccactgaggtctcaggcaacaaccagcatcaactgtcagccacgcaatgagcgagtctccagatgactgcagcctctagacttcgagccacagcagctggtgccaaatagggcagaggtggctgtacccactgagcccttccaaaaatcacagacttgtgagcaaaatacacatggcttgctttaagccactaagtgtccaggtggtttgttatgcagcagtagataaaaggactagcgataggcctttgaatgaccataccacaatttttgtaaccaattccttaattttagacatttttattgtcacaaagtgttttgatgttgctgttgttgttgcctttaatacaaacatcacatatatatacgtctgtgaacacaatagtgtgtgtagcattattattattattattattattattattattattattattattattattgagacagggtctggctctgtcacctaggctgaagtgcagtggcacaatctcagctcactgcaacctccacctcctggactcaagccatcctcccacctcagcctgctgaatacaggccgcgccaccacacccagtgcatttttttatttttatttttggtagtgacggggtttcaccatgttgcctaggctgatcttgaactcctgagctcaatcggctcaccttagcctctcaaagtgctaggattgtaggcgtgagccaccgtgcccagccaccttatttcctcaatattatttcccagaagtagaagtgcaggccaaaggatatgaatattttaaggaactttgatgtgagcttttggcagttcaatttaacgtagtttagtagttcacaaatatgtatgacctaaaaatagttaaacctaaaatgctatggcaaaatcaatcactacaaattccatgactgaaaaggaaagatcactgagtatagaaaaaacaaaaaacaaaaaaccccacaaaactggtaattctatcataaagaagttctggcttttaacttaaagataatacattcaaacatttaaattttttaaagtgattatgcaaacacgaattttgagggtgaaagtcttactgaagtctgcttccatatttgtcaaatataatccccagatggttcccaaatacccttggtcactaatatacccctcttcatggtaagataactttatctgatgaattttaacttcaagaacgtaaagatacgtatcttcaagcctagaaatttttcttgagctctctgaaggctaaataattctactgcagtctgaagaccttgccctgagtagggttttacactctgaatcagtgttgtcagatgagcagatacaatggcttaactggttgtggagaataggaagagctgagttaccatgtgaccatagctgatacaattgttgctttaaaatgtagatgcaagttttaaggtaatgcttttgcattaagtgctgcaaagtttttaagtgccatggctattctaattctttactaattacgtgtgtgtattacctgtcaccttctcataaagaatagtaataataatatctgaggtttgtatagtagttcacaaggtgctttcacatttgttttcattgtttcatttaatcttcataacaaaaccaaggggtcagcattaccttcatcactttgtaggtgaagaaagcaagtcgaagaaagctaagtaacgaggcagagacagccaggactcaacttaagatcttttaaagtagaaaccacggaagtctatcccatcctcttcagtttgtctcttgacttatgctaaaactcattacacagcaataggggtcaacaaactttttgtggaaagggccagagagtaaacattttcagctctgtggaccaagcagttcaatactgcaactactcaacagtgccattgttgcacaaacacagccatggacaatactcaaatgaacggacatggctgtgtactaatacacctttatttataccaacaggcaaaggatcgatttggccctcagaccatagtttgcccactcctgacataagaggatgagtaaacctacaggaatctcacgtctgtttctgcccttttaaccacaatccttcccttcccctataagaaactatctttattagattcttattgatccttcgagagttcctgtttttgcaaatacaagcctatgcatatatagacttcatcctcccactgcacctctcttatttccctcagccccatgccctcttcagcactttgttttcattgcctgggcatctgtctatattagtacatagagatctgatattccattttgccattgcatagtacttcactatatagatatgccacagattagtcaatctactgctgcccatttgtgtgggttccttgtattgcttgaaaatatgacatttcttgctttctctggtgattgtgtagaataggtgcctagaagtgggattgctgggaggaagggtccatgcatctataaatttgttagattgccaaatctctcccccaaccccagattggtggtggtatattatactcccagcagcaacctataaaagtgcccatttccccagagcctcatcaatggtgtatgagccaaacctttgaatttagtccactctgacaggcaataaattatacttcggtgtagttttaatttacattgattttattgcaagtgagaaagaacacctttccatgcatttaaagactaattatatgtctccttttgtttcataacctttgcccgtttttcttttgggtggtaggtttttttctcttttccaagtttaggcattcattaaacatgaaggagatgggccctctgtcccagttcattatttcttttgacttgacatatgctgttttattttgccatggaaaaggtttttaaaatgtttatgtagatacatttattgatcatagagatatataggtgtagctatagatacagacataaatatcttctagattttttactctctttgtactggacatctgagatgaatgtaggtgaaaaggatagaggtgatggtgagagtcagaaagatattagagcttttactcacaagtaagtttgtatccaaaattcaaatggattatccaggtattattttaaatgttaagaccggtggcaggtactggtacagagaacaactgagaatagagcaaaatggccaaggaaaaggagggaaaggaaactattttatatcaagaaaattatgatgctaaatgagttctagtaaggctgaaacacatgatatagacactttaagtatttttgtagttgcttacatataattttatggcaaaatgtcttaaattgcgtataacaaagatattagtatcattgagctagtgttcagtagtgctccttttgaaggttattattctgctatcatgttacaaactttttagaatattgagttctgtgcttttgtttggttttgtctgaattctctgcctagtatgttcatctcatcctactcccattactccagcaaaggggaatcagaaaactgaggttaagaaagatagctaagttatagcatttgctatgcacctcagactcatttttgctattgagatggcattgtcaccaagcagaggcaatttttttttctggagaggagaggcaggacaggggcctggggtggggggtgcggccagaactgtgatgtcacagattgcattgtctcttgggaaactcatccatcaaaccgtcacctctgattctatgcagggtcactatgaaagaggcagcctgccccagtttgggtattctgaagtgttagtatgtagtggagctggtggtgtgaagctgattcattttgtttcaaagccccaaatggcatgctgccgaacacaggcacaagcacagcagcgtctccttagaaataatgactccaaggcaaacagccctcattgcaaaatgtagaagactgccatctgcttgtctccactgtggtttattcgtttcagggttttaaatgacgtaataaaaaggtaagtcttctttttaaaaactggaggggtaagtgggaattccagattgattatagcatatctggaatatatgtaagatatttgccttaagttagaagaggatttgaatttataaagtgtgaatattattttcaaatgcaagtgcaaatcctgtcctgggaagataaggtaaaatccatatcttaaagaaggtcatgccttacaacttagcaattttatttggtattttagaaacatgatttttaaaaaaatgaattttcataaagacagtaattttccagatgtttgatagtacatatcgatcactttttcatatatgatattccaccttttcttgatgtttgcaatctgttttcagcttttggataagttaaaaacaagcagctgctataaattgtcaagggctcttaaaatgaggtgccagatagatttgggaagcgtctagctgatttctacataactcgtttggaattactctgttatgggagggagtataaagggtcataagactcagatgaagtttgaagctgaggtgtcccctctcccatccctgagggatagtgaccagggtttggagatataggaagaagcaaatgcacacctccgtgcctcgccatgacctatcgtattccagtcgatgaggagtccagagggctgggatccatgactccctgaggattcgcctggcaggaatgaatgccagcaaacaccccccttccacccctcccctcctagctccccaggagaggcgcttctgcagaagtcatttggtgtgtgtgctggttttccttgtgagaggattagagaataggagagtgctttgtgagaaaaatcctgggagaggttgctgggaagaaatcaaacagagggaaggaagacttcagctttcagagtcccctcagtcaagtaagtctgagacccagttgcctggcctagagcagctgaggggttgtttcctttcgtccacactaggagaaactggtaaggctcattttattctctactgctctgggatgctactgtaattgctttactgaagcgcaggggtcagaagggagggaagttggttagtgactctgcggacgtcctgcatcgtctctgtctggtgtatgaggacggcgctgtttctggtacaaagggctggtagccacagaacaattttacttttcccaaacttgattagcatcacttctgagcaactgacttaagcaaaacgcatgcccacgcaaaaactataccccatagaggaatgcacttatctatcagatactcggatctttaaagcatttctatctcaatttgattagtttggggggtacaacttcaggagagtgagagaaaaacccggtccttctggaaatttttcaattgtctgtttcctgtgagaatgtatttttgccattgtatgtatcacctgttttgtaacaagagccgttcagatccaagccactgttaaaaatccaagtagtacctagcgcaagttcaagacactgtgaaaggaggggagagtgttcacactcaagtgaggaaaatggaacttgaagaactttatattctttgtctgtatgcagaggagttctaattggaaagaagaaatgaggaagctgccctagagtcagaaagaataggtacacgtttccttcaacattttcaaagaatcagctcatgcacacagccttcttgggcaaatgttgcttcttactccctaattccattctgttatttctagagctgactttcatatttgtgtgaagatatatatagaatacattatttatattacttatatatttaaaatgtatatgtatacacacacatataaatatatccttttatcatatcctggcaaacttgagcctgaagagtttagaaatatattgattcagtctgaagcaaattatcccttaagcaagctacaaaagtccttctgagaggcgtgtttggagttgggggctgtgtgaagaagagagaagtggcagacagctgttgtttctgtgatggacaagtccagaagcctttcctcatagctgagaaccaaattcctaaaaactctgcgcaccctcccccatccccaagacagggtggtaatctttgttgttgtttttgccctgagaaaatttgagtgctgcctaatttagggggctctctgcattttttcctcctcattaaaataaaactagaagcattgctaaatgcaaagttctgatgatggatgttttgtttctaaacttaacatatgccaatacacttattatcatttcagttgaatctgcccatcatgaaaacactgatcaagtaaaatgattcaacacaaattattcaagtctgcaactgttacttcagtttacttaattctacagtcttaagatgatgtgcttattagaatattcaaaaattgaaaatgcatgccatttatttcattaataacaaccaggttatttaaactataggttataaaatataggtttcaactacaggttataaactatttaaatacagtttctttgcatgcacattgatatgaaaacctgaaaaaatatatgctttttcttttaaaatgaaataattatttgcctgagatatcctttgccaaaaaatgaaagtcaattccctttcaatttcagttttttattcttttctcaactgaaaatgctaattcaaccaaacgatgttatctttgcctttaggaattgtttacggaatgctggcagtcaatttgggagtcctgagtgtgagataacagttaatcaatttatctgtgaactgtgaagttttcaggttttgatcaacattattcactattctccaccccatgctcattctggttataaagactatttaccttcattattatatttgaacctgagagcgtcaagtttattagaattgattttctttccaggttgatcttctgaaatactttggccatttttcactactgccttatgaggttatcattaatctggcatatatttattgagtgcttgggtgtcactcatatggcacacgtttgctgttagagatgaaagctatgttttgtggagtttattgcagaggcgaccaaggctagaagggaaagaccaactcgtgctgttctaacaattgtttgccagctcccgtggttcagttgcgaatgtggtttcagcaacaacgaaaaactcttaattcttctgaattattgatacattaaaatatgttactggctacttggaacctgtgagctgagttaatcaataaccctctcacattgcacaagacccactgtgtgttattctcatcactggccatttaaataattcaaaagaaaggtttctcgtgaattaaccttgccattgcacaaattgggaaaatacagaacaaaacattccagcatccttaatctttagagcttataaattactgttccttctcatttttttcttgatgtattagttttttctgttagatgacttttgttaaatgttttgatatatcataataatacacataatttgcaataatgtcagtaagaaaaaagaatcatgggaaagaaatgaacatgtcttgaatccaccatataccagacactgccctggcccctttacaagcatgttatcatttactcttctcaacaatactgcaaaataggtattattgggcccattttaaagatgatggaatgaaggaccagagaatttaagaataaattcatgccacactactaaggtagcaaacccaaatctgttccctgctccacaaaagcactttttagcacacttctatattgctctcttaccagccatgtctttcttcccagatctcgtatcaattgagaactcactatagcttaccttaatgcttccagagaatctcccttgacagcttctgcctgttccctatcttcctttatgatcagagagccaacacatgtaactatggattggacaggcaccatatgtatttacgtgtaaaaatggcttttgaaacatcaaggtagaaacatcatattaggttaaaatacagaatacagtattttagatttgctcagttaagagaaattacagacttggtttagtttggtttctggccatgcctgccctggtttccaccagctatccagtagggagccccggtctgcatgtacgctgtgacatatttgtttgtatagagatctgcttgtataaagatctaggtttctataccgacacagcctcactttctgcccccagcaggtgagcagaagacaggatggagttgtagaaaaatgcatcccttacccccatctgaagttactggttgagggaaagaaaatcataacacatcattaataaaaagaattctaaatatatcagtgcattagtctggtactctcatagtatagtcattcatttaccgcaacacaattatttagtcagcactatctatccaattgccttgtgtactagtttccgatggctgctgtaataaattaccacaaattattaaaaatttaaacaacacggccaggcgcagtggctcatacttgtaatcccagcacattgggaggctgaggcaggaagatcacttgagcctaggagttcaagaccagcttgggaagcatagagaaacccctcctctgcaaaaaaaataaaaagttaactgggtgtggtagcacatgcctgtggtcccaactacttgggaggctaaggagggaggatcctttgaggccaggagtttgaggctgcaatgagctataatcatgccactgcactccagcctgcccatctcaaaaaaaaattaaacaacacaaatttattttattacattcctggaggtctgaagcacaaaatggatctaaaatcaaggtatcagcaggcctgcattccttctgaaggctctagacaagaatctgttccctgcttttccaacttcaagaggcttctggcactccttggctcatggcgctgcatgtttctgactctgcttcattcgtcacattgccttctctgactcttctgcctccctctttccactataaggacctgtgcaattacactggggccaccaggtgaccccatggaaatcttcccatcttgcatccttagatctaaccatattgaaggatgtcgaaggatgtggttaaacatccttagccacatctgcaaggtcccttttgccatgtaacataacacatacaaaagtttgggagattagaacgtggacaactttggtggggagcattgttctgactaccacatcttctttcaattttttttttttttgagacaggatctcgctctgtcacccagattggagtgcagtggtgcaaacatggctcactgcagcctcaacttcctgtggtcaagtgatcctcccacctcagcctcctgagtagctgggactataggcatgcaccaccacgctcagctaatttttgtattttttgcagacatggggtttcaccatgttgcctaggctggtctggaactcctgggctcaagcggtccacctgccacagcctcccaaagtgctagggttataggtgtgagccaccatgcccagacacaaatttctttatattaacttgatatgtatttattccatgatcttgtaggcagtagggagccatggaaatatttcaagtggagaggtgaaatgaaaatgatcaggtttccatgttagaaagctcactgagagagccctatggagatggaggcccaactaggctgcctgttggaatgcaggagagagaggtcgagaacatgacttctgagagaatctgtagagaaaaggacaagaagtttgagaaatactaaggacagtgcattggcaggacagctgagaggaagaggtttgtgacttggatatctcaggtagatgatggggaggtagagaggatgggggactctgagaagatgtgtgtatgctgcactaggacctggggatagaacaccggccagaaacaccttttctcctaagaagctaaaagcccatctgtgaagacaccagtaataataataggaataactcatattcactgagtactttagcttcttccaagcacactacatttaattttcatatcaaccctctttggtagacactagtaacattatcatctcagttttctgatgaagaaactgaagcaaggagaccttacgtgatttgcccaacatcatgcaatttgtaaggagagagaaggcagttgaagtcaagtagtctggttccagaatccatggttttaattcttacactctactgccttgcttaacaaacaattataattttgtgagatatttagtatgagagctacctgtacatttaatgggggcgggagcaaaccacagggttagcaattactgctatcaagatgaactgtgaatttttctgaggcacattcctgtagaagcctggctatcagtagggtgtgatccatgacaaaataaaacatttatatggagcattagcctggaagcctggacatcagggcaaaattggagaaagttcttatttccctgctgtctaagaatttataaccacactgagaaaaccatattgcaatcataaaaaatagatgaccaaaaattaaatggttccaaggccctctggataaatatgaagtgagagcatagttcttttctaaaagagagtgggaaagaacaaggcaataagaaggtcaagatgatgggatgcagagccattgtgtacattcattgaatgacttaatgtgttatgcacttgcattctcccatttccaacaacactataaaataatggcagggtgaaatttgaatcccaaggtctctcactctgctatgtgtgtgtttaaagaatgttgggacagagctccctttgaataaaatttttaaatgccttaggaatcctaaaatgatgcttacattttgtaagatcttgataccttgacgtagttgttcttcattatcattatcattgactagttgttgggtggagctgccctgggcgtgtgaagatttcagtatcactcaatataggtgggtctttaaaagaaaatcatgccaagaaagatagatgtaaacttatttttttttacattctcttttattttctttaatattctgtatctttgtagaagctataatatggaattatagactatttacttatgggctttaaaaagcactgtggtaatcattaggtaataaatttcttaccaagagatattactgaaaggaatgtggtttttattcttttatagccagatcaccaggaagatatgagaccttgccatttaagtttgctttttaatttgtgtaacagaaagattcacatttaaccttttctactagacatgtatttaacaaacaattatttggtatctactatgtgaaagggacacattttattccatttgttccttgcaattcttgttcggaaagaccctctttacagtggaagaaggagaatctcagagaatggcccagctagacttgaactcctgtcttctgtctcagcccagaagacttgctcccatgtcctttaacctacttagctaagacagatattcaaagccactgaggaaggactccatatttcttcatttggaacagcaaactaggagagtttggttatatccccatgaccaatggtaggtatatcttggggcaattatctctatgctaaaatcaatattgctatttatcaagataatctacagcttgccttaaagatagagaggggatttcaaagtctatttgttgaaaagattactctctggaattgtagaatttgcttcaaagtgagatttgcaaaaaatatgagatttataccatagctgtctacccaatccctgaaagatttccattcaaggtgacatctgttcaggcttacacactgcttacctatgtgttggtgaaacactttctgtgaaccttctaaatgttctcacagcactctgacttcacccaatactcatgacaagaagaggacaaagctagaattattataccagagtatctgaccctgggttcaatgctgagagtgggtcacaattagttttaatagaaaataacatataattactgacaggtgccttggggcatgggaaaatagcatttaaaataatgtttttagtgatacattgcctacaggatgacatcatgcaagcttaatggcaatgcttgaaggtgagaactgactatgatgttgaaagggaaagtttgttcagatttattcatccaccatcagggaatcaaacgtgtcctagatttcttttttttttttttttttttttttttattttgagacggagtctcactctgtcgcccaggccggactgcggactgcagtggtgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattataggcgtgagccaccgcgcccggccgtgtcctagatttctaagactaacgaaacaagaaactaaaatctactattgaaacctaaataaatacagttatcaatgtgctgataagatctgcaaagactaatagcataagcccttaatgaaaaattattttattcaatgacttaccaatacaaaggttagatatccttacatcaaagtaatactgtattattcttccctatagttctgtaccacaaggaaaaattagtgctttatttttgctaattcacaaatttgttaaagtgatcaacaaatttaatttccatatacatgtgtaacttcaaatgtacagaggcgtgaagctactgcaaacacaagcttgctcactaaattttatttgataatatctattgccttgccatataacagcaagagcaaacattctaaaacttctaagtaaaaggaaatcatccgtctttttaaattatgtgaactttaccttatttgtaaagtactgtatagaaccaagaaaagtgtgggaaattggaacataattggaacataataggcatttaagccttatattttcacaacaaaattgccttaaattaaaataaaaatgatatgcaaataggatttgtttatccaaatgtgggcaaaagggctgtaaagataccagtatgtattagaacgacatgaataatttattttataatgtaaaacctaataaagatttaatgatcacccataagcctttaaaattatgtgagtaatagcactatggcaagcaaatacaggcagctattacagctctaccaaaactctgtttataactctttgtatgttactttttggaaagggtgggtcacagaatgatgtaataaatggttgcaaagaagtttctgtcccaagatgcgtattcagtgaattctagagctcaagctgcttttctctaaaaccatgcaatacatgcctttgcttcaggactggactaaccattttctgatttataaatttaatgatttcaatattatggagtaacttcagtgaagaaaaattgttttaggggcttactttcctgcaacgattattgccctattgcttttaattccatttgaatgcatgctatggagtagttgagttaaatccatggcatcttggttattcttcacggatgagttccagttctttgggtgatacaactaaaagctcacaagatgctgtgtatcggcactgaaacaatcagtctttgagctttggggaaattactcaagcagcgaattaatcattgcgattctggtcccccttcacaaatgctaggtctccgaaaagactccccccacacacccctgttcctggtgctcttattaaaggtgtaaaatttcataaaactttagtaaaacattatgaattctctttttgtgcaatacagctggtatttcttccagacatatatttccataattaaacatcctaaaatacaaatcccattattatttgttatgtctagtcagtaattagacctcagctggtagggcaatttcagaacagagtttaccaatttacatactaatccagcagagtctggtgggacatgattagcatagattcagtcaacatcttaattagccctaatcccagcatgcactccgaggtgcctttaccccacccccactcatgtaggtcttgtttagctgactattttccttcaacaaattccagctcttccaaacatattttccagtgctctttttcacagaggagatgattacatctcaaagtggtgtgccagggaggacattttgtgtaaagccagggaaatgtgaggcattgggccaggcgaggggtgcatacacaagtctgaagcaaaatcaaggtaccagaatctgttcttctagaatgttagagtatacccacttccctgtcccacccccaactctaggtagcaagatctgtaaaccattccaaacctgtgagaattttacctattttgtaagaagaatattccttattcctgtccatgatcaggagcccatttcatcatttaccagctttcatgtcaggaaattccttatacctaaatgaaatcccccatattgcatatttaagcccctgcctttctatccatccatagtggaaacagagaacaggtggccacctatgaaaagctcgtcttatagctgaggaccgtaattaaattatctcctttaccttctcttcttcaggttggatttttccagctcctcgactttcctctgagctcccttttcttcacctctttgatctttgtggttttcctctgaactctttccaagttccccacaccccctttaattgtgctcagaactaggccgagtatctttgaaatcatttgaatggccagatttcctcaggataaataccaacacttgagtatacctccatatccaatttacttctagaatcagtgcctgctgttagttagctggctagtttcacttattcctcttccatttttcaaaaaactcatttggtgtgctattgcataatctagaggggatttcttctatttgctttttttttttttttttgcagtttatcaagggcactttgagtttcaatttcaatttgcaaagctataaactaccagtatctcctgctaaggtttgaagtcatttgcaaattcaatttgagcattaccaataaattattgcacaatcctaggggaaagacatcaatagcgactgagaagatcccaggagattatcacttgctaagaccttcatctcaagattcttctctctgctttccctgttctctgccactctttcccactttgacctttgtcttatgacatagcctttccctatttcactcttttttctctctctttttttatttttacttattctttctctctcatcgtgtcttgcgttttcactcaacactttccagccatcccctgcttgagattgttccccatccagaaaatgtgtctggtcatagggaagagacaatggaataagagaaacatcccaaacaattttcctttttggctttgtactgacctagctgaaatcaggtcacgtgtgtcacagaaaaaagcaagtcaaaagtgctgactgatggatataataaacatcagggcaaagaagtgaagatggctacttggccaggcggggtggctcacgcctataatcctggcactttgggaggccgaggtgggtggatcacttgagcccaggagtttgagaccagcccaagcaatatggcaagacctcgtctctacagaaaataagaaaattagctgggtgtggtggcgtgtgcctgcagtcccatctactccggagactgaggtgggaggattgcttgagcccaggagatcaaggctgcagtgagctaggattgcaccactacactccagcctgggcgacaaagcaagaatctgtctcaaaaaaaaaaaaaaaaagtggctatttgagtctagcagtgacaggtcaggaactgtttgcagcctcgaagcctcaagacctttctggccacacaaaaagagctagtcagagtgttgcgaggttcgtgtgtaaaagaaccagccgaattcacctccagactctagcttgacttgtcaggggccaagcatgtgttttgaattccagaaggtgtcccagcttgctttaaaagtcagggtctgtatcaatctctgtctagaggcttaagaatccttaagattataaaaggtttattcatatggttttggagatttttttgaaatagttgtacatctgtgagcaagaagcaagtgtgagggctttgacctagatgtcttcatagccaaaaatatctcttgctattaagagctacaaaaacggttcaaatatctcatattgttgcactacttcaggggctacagatggaagatcaaatgccaaggatgatgttgtgaatctctgtttgactggttggttgatttggtttgttttttatttttgtatggccgcttgaattgtgtgtgtgtatttgatgcaacttaaagttttaaatttcctcaccaataaataacttacattctagatgtttaattaatatgcatatccttaatctccttgtttcccattctaatttctgatggcttttctgaaatcatgtgaggcaaatacactctcccacttttcacctgaccagacccagaagtgtgtgcaagaaaggactttgatggttagtttagtaactaccaggagccatcacggaggctttaccagctcaagttaagaaaaggattattagtggaaatgaaatatggtgcagtcactttggaaatggtttggcagttcctcaaaaagttaaacataaggttaccatatgatccaacgagtgtacttttaggtatatatccaagagaaatgaaaacatatgttcacacaacaacatgtatatgaatgttcatagcagcattatttacaatagccaaaaagtggaaacagcgcaaatgtttatcagtggatgaatggataaataaaacgtagcatattgctgggcgtggtggctcatgcctataatcctagcactttgggaggccgaggcaggtggatcatttgaggtcaggagtttgagtccaccctggccaacatggtgaaaccaccatctctactaaaaatacaaaaaaataaaaatagctggacatggtggtacatgactgtaatcctagcttctcaggaggctgaggcaggagaatcgcttgaacccgggaggtggaggttgtggtgagccgagatcacaccattgcactccagcctgggcaacaagagccaaacactgtctcaaaacaaacaaacaaagaaacaaacagatacacacacaaaacaagcaaacaaacaaaaaccctcttttaactccatagttaaaaccatagttttgcattcctagctgtcatgagtgaagctgagatttaaaaaagtaatataggactatcacaaaccaaagttacatctaacataaatgtccattcatatttcatttggctgtgattgtgtatttgtggcatgtatatgggtgtgtagggaggatgcgtgtatactcatacaatgttagcatcaacaggaccataggaatctcctaattcaagctcaatattaacacattcaatatacataggtttgatatttataatatatactgctgattgtgcaataattcttcacattcccatggccttctttaagaggccatcatagcacacatctaattttatcctaacataattctacgagcttgctagagggcattattattattctactgagaaaatgggcagctaattccaaagaggtccagctttggctcagtcttacacggcatgtgaatggtgaggttgaggattaaaacccagattccacatccttgctcagagtacttcattctggcccacaatctctaaagctacaactgtctaaatacaaacaaacaaacaaaaaacaaacaaaaaaacaaatgcaggatatccatgcatttccgtacaaccggatagtattcagctctaaaaagtattattcagctgctgatacatgctacatcatgctcagagaaagaaggcagtcacagaggatcacatattgtaggattccatttatgtgaaatgtccagaataggcaaattcatagagatagaaagtcaattagtggttgcaaggggctaggggtgaagggtagggggaaagggagtgactgctaatgggcacagcatttcttttattggggggataaagctgttctaaaattagatgttgatgatggttgtaggacactgggaatatactttaaaacattaaattgtccacattagatgggtacattgtgtggtatgtgaattgtatctcaactaaactttaaaaaaaaagaaaagagaaaggggttatgatacagagccgtgttcctaggtcactcacaaaatgcttttaattgttacagtttaaaaagaattaactaactcctattatcattttaatagaactctccctccaacatgcactgtttcagatattatacaagacagtgtagacagtgtatttagacagttgtagctttagagattgtgggccagaatgaagtactctgagcaaggatgtggaatctgggttttaatcctcaacctcaccattcacatgccgtgtaagactgagccaaagctggacctctttggaattagctgcccattttctcagtagaataataataatgccctctagcaagctcgtagaattatgttaggataaaattagatgtgtgctatgatgacctcttaaagaaggccatgggaatgtgaagaattattgcacaatcagcagtatatattataaatatcgaacctatgtatattgaatatgttaatattgagcttgaattaggagattcctatggtcctgccgatcctaacattgtatgagtacacacgcatcctccctacacaccgatatacatgccacaaatacacaatcacagccaaatgaaatatgaatggacatttatgttagatgtaactttggtttgtgatagtcctatattacttttttaaatctcagcttcactcatgacagctaggaatgcaaaactatggttttaactatggagttaaaagagggtttttgtttgtttgcttgttttgtgtgtgtatctgtttgtttctttgtttgtttgttttgagacagtgtttggctcttgttgcccaggctggagtgcaatggtgtgatctcggctcaccacaacctccgcctccccggttcaagagattctcctgcctcagcctcctgagaagctaggattacaggcatgcgccaccatgcccagctaattttgtatttttagtagagatggagtttctccctgttggtcaggctggtctcaaactcctgacctcaggtgatctgcccacctcggcctcccaaagtgctgggattacaggcgtgagccaccacaccgagccaaaagagtttttaaaaagagcgaaaaaggcaaaggaaatgagatccaattatgcctccagatttatgagaattgtaaatactgttttaataacttctagaagagcgtctgaaacagtaaaagtaagtagatttctcattcataactgtttacaaattcttttctgaacaagttgaaaattcggggtaaagagattttctttgagaaagttaactcattgtctaaaattcctttgactccagatgccaagacaaatattgagagtaatgtcatatggttctgtaatagtaatattctaagctctactgagacagcatattcttctacaagtagaaaaaatatatttttattaggtatgaaaaatagatttttgatataactttttttattatgaaatagttggagacacaatgccgggtgcggtggctcatgcctgtaatcccagcactttgggaggccgaagtgggtggatcacgaggtcaggagattgagaccatcctggctaacacggtggaaaccccgtctctgctaaatatacaaaaaatcagctgggtgtggtggtgggtgcctgtagtcccagctactcgggaggctgaggcaggagaatggtgtgaacccagaaggtagagtttgcagtgagccgagatcgcaccactgcactccagcctgggcagcagagcgagactccatctcaaaaaaaaaaaagaaatagttggagacacacaagagtttgcaaaactaatgcagagagttcccccgtaccattcatgcggcttcccccaatgaaaacatctttcataaccacagtaatgtcaaaaccaggacattgactttgacacagtattgtcaaaaatagattttcatatggcaaaatttcccttagaaattggactacaaattatcacatcatttcaagtctcaagtgtcacagttggatcaagcttttattattaaagggtataatttgattctttgtgtaaacaagcattgccctaagtgtttttttaattacatgcattgaaacctgaataatagttcatttcagcttacatttgtatctaaaaatactaataagctccacttcaaaatatatagtactatttttaaaaactctgtgtcgctttcaaacaacacttagatcattaaattagatcctcattgttccctcagaggtgacaggcattattaaaatgtattctgcatattttgtttctgtaattatgtctaatcagtgtgaattgatgctgtggaaaataattaaaaacacatatttgagctataagtgggaaacaaaggagaaactctcatagttggactctaaatgacaagaactgatagaaagttgaaatattagacaagaccagcagcccggaaaaaaaaatgtgttaataggtagaaaatgcaaaatgtctatagaaatatcctgaccttaaaacaaaagaaagggctttgtcattgtgtattctttttcccctgcagaatcgattctgaaagatgtggagatctcataaacgtctccaaagaacagttcacagcacccagggagtgaggctttctgaaagaaatgccttcccatgccgtgtaaatggcatgtgtcaagggggaaaggccccagcgctgtggtgattgagcaggggctgctgtgggcagcttcctttgtgtcctgatcatttacatgacttaaacacaacaatgtgctccatcgtcaataacacaagacgctttgccatagcaacagtttcagaatgtggcacagcctcagtggtgtccctgaaacagaaaagttccctaaagaaacactccttatgaatatgttcagagatttctttatcctactaggacttgtttcaaattccattgggtttaggttttatttgcacagcccatctttcctttgctctgtgagaaccagctttggggagaagttgggagagacacgactgtggggtcagagggtgggaatacatacatggctgtgatagaaatggaattcttaagaacattctcagaaaactgttaatgctatccagaaaatcatgtaaaattcaggaatgcaacatacatcccaaagtcattgttggtttccttgaaggtctgtaataaatggcccttttattgtttgtacattttgcttctttccatcacaacatgtgcatgtactgtgacacactttagacaatcataaggacatgaaccccacactcaatggcattgtccaaaagacacagcacatacgttatcaaagctgtgattaaactccaatacctccctctaatttcaaggtcattttctggcaagacacaattttcccgttaagaaagtacccatcctcccccaccccccttttttaagcaatagcgctttctacaagtttgaatctaagagttgttctagtgaaactttcacctaagacagcatagaagagaagaaaaacataaataattttaatgataagtgataacagttgaattatatttggctatgtaacatacagtggtgttttacctttaggggatagttagagcactttatagtttgtctggctcagtgagaaggaaattgtttaccttgatatgtttgtgtttctgaaagatgtgccttctgtggcatatgtgccatgttgccccctttcctcatctgttccccttcgttgatttctgggaagtagccatcccttaacactggagctgcctatagtgatagatgatactctgaatctgtgcacctgactccatagtaatctataaattattgatgagctggtaataaaaaatcctaaatgttcctgcttctcagggagccacagaccccaggggtcgccaagcaatgaaagatcaaactggactcaccagtgaaaacacaattaattatttacacacatcagcatttgacattggtatcatttgaatcaagagatcctttgttggctacattgctacattgatttgtgctccaaagactgtaagtttggatgcacccttgttcaggcaaagggagatgagtagatactgagtgatgaaaggtgagcactgagtgtcaaattttatgcacatgttaatataaagaaattgatgtcatatattatagtgatattttaaggagttttgaaaacacaaagattgtgtgtgggtgcaaagtgaaaaggaaaggggatagagaagcaattataattatcttatctcagtccagtaaagccaaattaatttaaccagagctggggagaagtctcaagagaaacaccttctgaataagaccccactggagaaacttaagcaacaccagtgaggagtagctccctctcatgtctcttggttgctctgctgtcctctaaaatgatttcctgagggcagcagggctggtgagtttcattgcagaaacttcgagtcctctatcataggcattttatgggttaaattgtgcgagtaaaacacgtcctcctgagttggagtgcctctaatatttagcctactcaaaaggctgagcaggttcagttctttctgtgaacctggggaagagaaataaaaatctttatttttgtatgttctgtaattttcaaggcttttttttttttttttttttttttttttttttttttacagttgaaggactgccattttaatgctgtggattttgtgggccgctgctcaacaatggggaaatttcattaagctgagccaaagctaattttgaagcagttctgagacattccctattaagtagagaaaggatttgattccttatccttcctttcatgcttgagggatctcagaacccttgacaaagcaatgactgcaatactgactgaaagtaaaggaagccctattcaaatggttagcattgcctcccagatgccaaaattcccaattttttaagaaagttcatcattcagaactattaagaatttttccactctttggtagaagaataataggtcatagatttatagagaggtctttcttcaatcagttcagacgcctcaattgctcactgtctcaaaagatggagtgtaaacatgtgtaatatttaatttctatgtacaagcaaagactcataattttctggaccacacagaatctctgtaaaagttttggatctaatctctgcttctgtactaattccaaaaaagtcaatgaagtctgaaggcatttggcaatagaactaaccaatttaaactctgtgctttagcctacaacccaaaagtcaatgtttcataaatatttgaacatagctattggaagtcccgctggttatcttttaagttgtactttgcttttggacgaagaaccatatcagagtatcattctcccataaaaatctgtaaaataatgtttaaatagtcacacattacaaaaaaattaaattccacaagtttattgccctgtggatattgggcaaagtgactgatgcccacacccatggattaatcaggttataaccaaaaatttcccttatattcatccttggttcacatactctactatcaggaaggtcacccaagactaagatagagggcaaatggggcctggtagcaacactgattttgctcaccatctaagtggctggttctgatcatcatcatattattgtgctgtttttccttttaaattgttaccatctccatagatccagctcctgtcctatagagtattcagttactgggtggattattatcttggtttgggttctcttggatgcagaccttgagacaaaatttcaagggcatgtaatttatttgggggagagagacaaggaagagaggaaaaccaataaagaataggttatcaggtaagttaccactgtgggcactgaagcttaatcttattggggaactctgagatccagtggaaaacatactcctcagagatatcctatctgagggacaagggagcgggggtattaatacaccaattctggccagtcactgcatgaggactgcacagtggtagaagtgggagacattaattctccagcacttctgggctgccatatgcaagcaaagctggctccagcaccagagaaaactctctggtaaaaaaattgtagagactggcagttggatgtcaggctactgggcatagaaatggaaaggcctaagggaatatgagcagagaattgacctatctggttgatattgagaatcaatttcattgtctacaaccccaaaggcaataaacagactccacgggtgcctgcaagagccttgtcaatattcttccacgaggaagagaatagttttcccatggcttgtttttttttttaaaaaaaatcaccatctacttctactgtatgtgatttgtcatctgaatatgagagcttaaagagattcacttaccttcccagacccagctctaacccagacagaggataaactggaagagtaatcgtatgggaatctcaatctaacgaaacagaataggccagaaagggttcagatctaggctggaaactgactgttggcatttggcaggtggatagctctcctatttgcaggagggagtgaagtctgcacagacaagtgaagagggatgacagtaggtccagcaattagtgacagatggagagtcacattgtcaagctgttggcattgaaaagagccaacaggaagtggcagtacagacccttggcaaaaggccataggaagggggccaacctgacaggtgtgggcattgaagaggagggaggagaaggttcttttgtagtttgtttatccacaaacggtagtgtctttatcctggacaaagcacaggtggataatgtcaacattgagattggaaggagaagcttggaattcaggggcatagttcaagtcacagaataactaaattaatgaacagggcaccaagtcaatgacacaagcacaagaagctctatgattttagttagaacttcttttgattgcaaatggcaaaaaattgttttactttaagaaaaaatataaagtgtgtgtagtgtgtgcatgtgtgtgtgtagagtgtatcagttatccagcgctgcataacaaaccatcataaaatttagtggcttaaaacaataatctttagctatgattctgtgggtcagcaattagctggattcagctgggcaattcttctgcttggctcacttggggtcactcatgtgtctgcagtcagctggcaggtgatgagagggctggtggatctagaaaacaccagctgagatgcttctacatgatctacatgatcaatcgctgctccacctcatctctcatcctccaggtggccagtctggcccactttatatattaatgaaaggttcccagcggccagcgagcacaagccccaaaccacaaacactttttagcctctgcttgcttcgtgtttgctaatgtcccattgaccaataagagtcatgtggccacacccagattcaaagagtgggtagatttcacttgttgacataatttgtgaccaattcatgtgatctactatcagagggcatttgaagctgcacagaaacaggaatacaatggtagaatgacctgtctgcttcttcctgtttctattctttctctctaccaacttcagtctcatgggtgagctgtcttcataaggcaggaggtccgggtcacttttagctcttgggatcacatcctcactgcatcataacctgagaggaaagtactctcttctgtcaggcccaatttagaaaatcctgcaactaaagcttattggcctggcttgcatactgggggatgatactggtggctcatattcaacccagatgatgggagaggaagggggaagaactgttcctcccatgttttctttgcctttctctggcttaattcttgtgtttcctagattccattttttctctttcttggttttctctttcatttttttctggaacacatactggaaaatgttacatggaaggcaacttttttgaggtcttgcatatccattcttccgctgtccaacttgaaggaaaatttgatttatttccccatagggcttatcctctaagatattatgtaatttccttgttcgttgtgtttcttgtctatcgtttttatatcctgctatgcaagcacatcaaaggcagagttttttgtcagtttatttcactggtgtgtctcaagcatctagaccagtgtatacagcaggcactcaatcaatatttgtggaattactgaatgaatcaggctgagttttctgtagcacatgctcctaatgtcaccctttgtccctccagtccccactgcactgtgggtttttgagggttttgtgcattttcacatctccagtgccttgcccactctggcatgtgtgggagtcccataaatcaggggcccccaagtccccaggccatggactagtaccggtcccagtctgtggcttgttaggaaccaggctacacagtaggagatgagtggccagtgagtgagcattatcgcctgagctctctctcttgtcagatcagcggcggcattagactctcataggagcgcaaaccttattgtgaaccgtgcatgcgagggatctaggttgcccactccttatggtaatctaacgcttgatgatctgaagtggaacagtttcatcctgagaccaccttcctcccacccatcccggattcatggaaaaattgtcttccatgaaaccggtccctggcgccaaaagggttggggcatcactgccataaattgttcttgaatgaataactgaattaccagggaaagcaaaactagctaatgctatttggagggaaagttcttctcaggacagaagtgttttctgtaatatttaaattatattctcgaggtagaggaagtacatgaataaacttatagaataagaccaaatttattttgcttgctgctatatttatatataactataactatattagtatctctatatctagatgccctagttaaagattcagttgacccagctggaattccgtctttgccaggactatctctgctgtgaaaaatcttctcttttcaaatcctgtgtataaagcaagctgcctataaatatttgttgtctgaataaacatagaaatgatgcatacatctttctaatgtttcacagaggggtttagttaactgaagctaaagaacagttctattaaaatcttggtagaattttctgttattcaagtagaatgcttggcagggacaaattatacaatgtaatcttttggcaattttcttttgcattcctgtgaagcacagcctttaaaggtattgctgggaagagttttgttttccaaaagtgatgatagatttcggcaaaaggccataaaacttatcaatgttttttaacctccatcaacaaaataattaaattttgttatgttttcaaatttgaggggatttttatttttcatatttcaactctttgagttttcattagaaaagcaatgttttccttgttttaagaaatacaggtttttatttctacctttttgaccaatgatgtataggaaagtttaaggaggcacagacctcatccccaattattaagagcagatgttttctgagaaatgtgctgtggatgattttagcattaacaacacccagtgtggacaatattgtcttggagagaactttggttaccgcaccagagtttatttctaagtcgagaggcagaaatacaagacaagacatgggaattgctgaactggttttgcccaagttaacttagagtctcaactagttcatgccttaatgaagctacattttactcattaatctacacatttgaagggtaacacataaagctaggaaagcagctaatactttgaaatacaaatttaggaaccaggggatgatctgtctctgcaaagagcataggaagctacggggaagtgtatgaagctgggggaagcaggaagctggggacagtaaagcatctgtgccttcttcagccaatctttattgagcaccagcagcacatctagtgctattctggatgctgaggccacaaaagtcaattaaatgagtccctgcccttgttcagtttatattctaatggagggagatggacaataaaccaatcactgtcagctagtgaggggtgctgcaaatacaaataaagcaggatatacaggaaccaaggccctccacaaaggagaggagcaaggaggttaccctttcgtgtaaggtgtctaggaaggccttttgggagaggttaagaattgagcagacacctgaagaaactaagagtgcaaatcatgctgatatcctggaggcaagaactatgggcagaaagaacagcaagtgcaaaggcctgagatgggagcctgtggcgtctgtgaagaactgacggggcctcagagtggtgagggcagcgggagtcaggggcaactgggagaggactaggtcacagcaaggacagcctcttagagctttgggagcattgcgtggactttgtcttttactcttgtgaaatgggagccaacgaagagtcttgagcagaagagttcaaaagaatgacagctttgaaataggctgggaaggagtgcaggggaatgcaaggtaggagcaagcacccagaagaggctccagcagtaatgcaatcaaaagatgaagcagaaggacaggaagagaggccatcagattctgggtgtgttttcaaggtgaagtcaacaggattttcttataagattggatgctggatttgagagacagaaaaaacaacaacaacaaaaaaccatggataactacaaagattctgatctgagcatctggtggtccttatggttggctcttaaatgccctctcttttaggtatgggcacatctgtttacagggccagagatgggacagacacgagctgaagtattataattcagctagtgatggtattcaaattcaacaaaatgaaatgaagaaaatatcaagacttccagtaataaactaagtgcaaaaaggaagaaaatgtagcttagcagccaaattagctaaatcatttagaaggagtaagttcaatatgaattaacagaacctaatatggtaatttgtagtaataaatttacaatatctcaagctggggtcactattggagtatctcattcagttttcattcaaactgtaaagcaattggagcttaggaaaacaaaaaatgacctggcacagtggctcacacctgtaatccgagcacattgggaggcagaagtgggaggatgacttgagcccaggagagcaagactaacctgggcaacatggtgggaccccgcctttactgaaaaaaaattttaattagctggatgtggtggcatgtgcctatagccccagctactcaggaggctgagatgggaggatcacttgaacccagaaggtggaggctgcagtgagccattatcgtgccaatgcactccagcctggacaacagagcgagaccctgtctcaaaaaacaaacaaacaaatcatgaggggatgtgaaaactgatgatatgagaacaagttgactaattggatgaatagcccagaagcaagtagacgtagaggcataatgactgtcttcaaatatctgtggggctgtcatatgaaagcagaattaaacttggtcaatgtgacccaaagttaagctgggttctataggtagaaactactgcaagaaacaccttagctcaatggaaggacagttttccataacagacactgctagtactctccaacatctgtgaactcatctccatcttggttaccctgatagtctatatattttaaccccttgctatctaagtggggccatgtgcctatgtcagtcaagccaataaagtatgggtgagcttagtatatgctacttccagtcctgacctctaaagccccctctgagctcttccacatattctctgttcccctgctgctagtcagatgcagagggtcctggggaggactctgaggtcctgtaagatggtaggtgaaagaagccaagatctgcgaaaagagccagctgagcagaactgcctggtgcattgtgatatgaacattaaataaacctttattgtgtcaagccatgtagatgtgggggatcttttcttgtgcagctagattcacttaccctgactaacacatctactaacttttagagctgtccagctataaggggattgcaagggagagaatgagttttctgtccctggatgtgttcaagaacccccacttagacatgaaactctcaaggttgtaggggcaaagggaaagctttcccttcgcccttggaaggtttgttgaaaaatcaactcacaaaaagggagattaagagaaaagccatataaaggtattactaccgtgggcagggggacaatcacagactgaatgcccaatatcccaacagggtacagatgcttatacaccctgcttcttaggagagcgggagatggggaagtgtggatgattttagggattagtaaattatttttagggagattcaatgggcttgaagaacatacaatggtctggaacaaagtttgttgggcctgcagagcagacaatggtttgtgacaaaatctgtccaggtttgttaatagacttcagccttccttcctgcaataatgaaaactcaggggagggaccagaggtaattgttttcttctttgttaggtccggactttaggctgaaactttagagaacaacttcagcctgtgctttgggagagatagaggattcagagatgggaggggcaagttgcggggagggagaagtaattgttcttcttggtgggtctgtccaatccttatgtagatggcggggagctctcttcttttatctgttgatttctaaaggcctttaattcgaaatactcattataccagggagccatattttggggaagttccttgtgctccaaggttaaaatcaagctagagataagtgacctgaccaaataattcgaacagtacttttcaaaactttccactgaggttcccttatcaacagagagatgtggctttttatccccaagtgacaggagttatatgtctcctgtgaattttctttgaactcttttgttttcataatcttatcttaaatatgaatgcagtttctgtgttcttatctacaacctatcagtttattttcatatactttttaaagttataaagtacatactattactgaacaagactttttcttttaaatattacagtcagattgacacgttaagtgttcaaaaattaatattttcaaagttaagctatgccaaaatcaataaattcatatgtgagcactgttttaagtgaaatataagatcagaattcaaatgaacacatacattatttttcaacaaactaaagtttgaagatcattccccatgccaaatcaacagtattccacattgcacggttcatattaaaaattataatggtagctagggtcctttgaaaaacgctagagacttctttatcttctaggtttcttttatagaaatgattttcattgcttattttcttacttagatggatacaaattgcaattctgttattgtgcctgcttacaaaaagaagaggttgctataaacatgatatgattcacaaaacgaaaaccatgctgacgttagtgggcacacacattttgcttgctcacatgttgtaatgtgatccaactagaaggagaggtagatttctccttcagcatattctcacatcttcccttcaaccagccccgccagatggaatggaaatgcagagattgtgttaaaagctgcagaagataagatgtctaggctgtacttgaaaaaggggaaaaagatgtaggtgcctccagacatcattttcttaatgggctttctctttagtagatgtttaggcatgtataatacccacttacatgcacctacttagaggggcctcatttgtactgctaggagtagctgctttgcttctatggagaaaatttgcctatagatttttgtaaactttatctgatattttaaagccatttccccatacttattttaatataggttttgagctagctttcctaattattaatttatatttcctttttaaagggaaagcaagaagcatgtgtgaaaaagcatgaacaaagttgtgaacttaaggaaatcttcaatattttaataaaataaaactactcaatgtctatatagtggccaatatgaaggcttgatctcctgcttgtagtggttagaccttcatattcaaacgtaatagtaacatgacaccaggaaagaaggcagaggatcatgtgcaacagtaataaaaaccaggccacatgtggctttcatcactttttcccacagctcagatctcagtcacatgatcacagcctaacaacacgggaagctgggaaataatggtcttcccgtgtgcccaggaagaaaaacaaaatgtaacaggagttactggacatataacattgtctctgccacactttctaatgcaaaataaaatagtcaaataatgaatccttactatggacttacgatctcaatgaggtagatatatcttagattctatttagcaaatgaagaaaaggaagatcacatatgttaaggagtttttctctcctggcatcactcatcttcttcttttattggtctgaaataaatttgctttctcacaatattgtttggcctgtgaatgcgttaaaaaatatttcaaagtatcataatgcagagttttggattgcatgttttagttagttgattatagtggctttaaaaacacagatttccttaaaacacacacacacgcacacagagagagacacacaaattcaaacacagttccacagttgactacttctttggcataatgatgtcatcaagaatcctggtgtgtctctgttttccactctgccatcctcagcaagacttatccaagttcacagtcactggggcattgtaacaacaccatagctacgaaaatacatactaaaatatacagatagaggaaagcttcgtggaaatctttcttactgttggtgttcatgtgtacatatatgaaatctgtgaaaactggatttatggcagtggaatctcatatttttctgccagaggtgatggttttaaaaagtcagaactggaacagttggagcctgtggctggagattattgaggaattttgtgtattcctttttcataaagatggtagtcatacagtgatgtgtataagatgaaagcaaaatttaattttgatacctggaggaaatgcctaaaatgagaaatgaaaaattcttattctgggtaatttgtggtagttctgctcttcttttacctacgtatatgatgattctgacgctcagagatttcaccctaaaccacacttgaatggcgatgactgcattttccatgctttcccacacaaagggctggtattgttctgagttggctcactacatgctagggacacgtggaatcaggtacatctcaacccactactaacccccaaatagataacttacttatttgtggcactgtgagcagaatatgccctttattcttccattttcaaaatatcatgttattttttcagggttttttatttttaatttttagcactctttaatattaacccttctagagtctaattctccatttgaagttagagttgaaaggcacacaatactcttaatagttttccagcagtgatgttgacccttctcaacctcatatgtttcattttgtgggagtagtattggggaaagatcaaatcacaactagaaataaaaagcaattccccttctatagaatgggatgctaaataaataaactaataaaaatgtcaaaatatagatgtggtggtggtaacaatgctggatcgggagctggaagacatagatctgatttcctggctctgcctcccccatcacttaaatataggtgaacactgaactgttttctctatcaaagagtaaaggttcctgttacacctacctcctggatggttgtgtagcttgagaggtgtgggtgagatggagcaatgccatatataccctaattcaccataaaaagatttggtcatttgtatatcttatgccacaagtactgtatcaggatcatagtgagagaagcagccttgagtgtttacctattacatcctccaattaagatattgttaaaatcaagcaaaaaagacagccttcttttcgtttctctgatataattagaaaaattcctgtttcacaccttctttttctgcaaaatggcctgtggaaaaatggttaggtcaaaaaataaattaggtaaatgctgttttctcagcctccctctcaaagaatcacaatatatgttactattttcaaggctcagagaaaatttgccatttattttataaaagattacttaacttattttccaaacctaattgacaaagaatactctttttccccctaaccattattaatgtcccttggctgtgttctaaagggagaaatggcacacttccctcattttgggcaacatgcaaaaatgtgcttctcagacatttttctcctgaactttaaaacttctgtattgagcagaaatggaggcgaaaatttccttcccctatggttttccttaacatcagggggtggaaagagagaagaacagttttggggtctttctcattagcctatttctgtttaaattactctctgttatacctcctttccacttatattaggttgctgtgtgatatagccaaatataccctgggactataccagagtcttatacccggtggcctcttgaagtcaggcaaaaagctggaagtaattttcagttatcctggccactcagcttcttcccagtctgttcttattacaaggaccactgggcagaattgaactctgccagcaagcaattgcacacccatcaacatttaaagcgggaaaggatgaagatgtctgatatggagtaggtgcttgtcttagcctgtgtctgcccacagcagatcttgaagcaaggcttccttagaggaagtttgtatgggaggtggtctcagggagtggcagtgtggttcggggagtggtggcgaggagagtaaaacacagctgtaaagcccagacaagggcattaccaacttggcttctcctatggacaactgaggttcatcccagggagtgttctgaggagcttatcaaatctgtctcagaactcccctgttctgagggaaaagaggctcctgtggcccatccatcttgggtggccccatgaaagtcaactccctgtacatctgggttgccaatccaggagagttgagggatgggtttcctttgccctgtcagaaaagcctcaaggtaggaatcaagaggtccttggtacaaccaggggcaagacactgtcagactgcacccaagggaaactggttaaagccaacatagaaactgtcaccacagcagtggctggaggaagagttggcaactagaagccttgatgtggtacttaagaggtgtccaatagggtgcttagtaaaccctagtggtttatctgcacaaagcccagcccctcactactgttaaatcaagtttagcctaaagctgcctccttacatattttaagctcgacctaaaggtttctctgtatatcatgaactatcacctaaatggagttgtaaagagactgtagtctactcttgcaccaaccactaagttttggccaatcaaaggtgaccaactgttcaaaccatgttcaaataagacaaaactgagctgtgaccaattcagctgtttctgtaagtcatttccgttttctgtatgtcactttcctttttctgtccataaatcttaccatgtggctgcactggagtctctgagcttcaggaggctacctgatttgagaatcatcctttgctccattaaactcttaaatttaattcagctaaagtttttcttttaacactacccacctcaggacttggagaccctgagaagttacataggttgccccaggacacaaagcatgctggtgacagagaaaattgaagagagccctcctgaccccctgttcacttggactttcagccatgttgcactgccccggctcaactaactgtacttaccactatggtagaaaagcttgagaacaaagtgccatgctgtcgcacctacaacatttaggaagaagttcaaaagatgtctgacttcaatcacggcaatgacaaagcagcaaatgcaagaaagaacaggatcaataaaagtcccagtggaattaaaaagaagacaagagaggtttaaaaggaaactgggctttggatacatactctttctgcttgtaatctgtgcttcttacactttctgagtttgaaaaggagtaatgtttttgtgtcacacttggaaattttgccacatgactgtcatcatgggaactttggaccctgttctggagctaagaatagctgagatactaattaggttgcttgaaaagtgctaaagaactgatcaagtccagagaattcacaatggaacttcatggccagaccgaggtctgttctaactaggattcttgtgttgccatcagcacatcaactgccccttgctttttcatatgaaaaactaatacctgtaatgatctcaaaattcaaatatttgagtatcagaatatttattctgatactcaaacatatgaataatgaaaaagaaatgtcgtggtgggaaccaataaagacagggtttggaggggccgaagatcctagggacggataaaatagggagatggctgagaggaaggaggaatgaaggtctcctactgaaatttaagcaccacacttctggacttgttttcttatgaattggttcttttttttaatgagagcaggtaataatattcctttatcaatgcatttaaagggcacaatttaatttagtttctgtagttaaggtgtgtagttaagtgcctggtacataacaaacaacagtgattaataacctactgtttttttattatttttattatactttaagttctagggtacatgtgcacaacgtgcaggtttgttacatatgtatacacgtgccaggttggtgtgctgcacccattaactcattatttacataaggtatatctcctaatgctatccctcctccctcccccaaccccacaacaggccccggtgtgtgatgttccccaccctgtgtccaagtgttctcattgttcaattcccacctatgagtgagaacatatggtgtttggttttctgtccttgtgatagtttgctcagaatgatggtttccagcttcatccttgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttatagtcctttgggtatatacccagtaatgggatggctgggtcaaatggtatttctagttctagatccctgaggaatcgctacactgacttccacaatggttgaactagttgacagtcccaccaaccgttcctatttctccacatgctctccagcacctgttgtttcctgactttttaatgatcgccattgtaactggtgtgagatggtatctcattgtggttttgatttgcatttctctgatggccagtgatgatgagcattttttcacgtgtctgttggctgcataaatgtcttcttttgagaagtgtctgttcatatcctttgcccactttttgatggggctgtttgattttttcttgtaaatttgtttaagttctttgtagattctggatattagccctttgtcagatgggtagattgtaaaaattttctcccattctgtaggttgcctgttcactctgatggtagtttcttttgctgtgcagaagctctttagtttaattagatcccatttgtcatttttggcttttgttgccattgcttttggtgttttagacatgaagtccctgcccatgcctacgttctgaatggtattgcctaggttttcttctagggtttttatggttttaggtcttacatttaagtctttaatccatcttgaattaatttttgtataagatgtaaggaaggtatccagtttcagctttctacatatggctagccagttttcccaacaccatttattaaatggggaatcttttccccatttcttgtttttgtcaggtttgtcaaagatcagatggttgtagatgtgtggtattatttctgagggctctgttctgttccattggtctatatctctgttttggtaccagtatcatgctgttttggttactgtaaacttgtagtatagtttgaagtcaggtagcgtgatgcctccagctttgttcttttggcttaggattgtcttagcaatgtgggctcatttttggttccatatgaactttaaagtagttttttccaattctgtgaagaaagtcattgatagcttgatggggatggcattgaatctataaattaccttgggtagtacggccattttcacaatattgattcttcctatccatgagcatggaatgttcttccatttgtttgtgtcctcttttatttcgttgagcagtggtttgtagttctccttgaagaggtccttcacatcccttgtaagttggattcctaggtattttattctctttgaagcaattgtgaatgggagttcactcatgatttggctctctgtctgttattgctgtgtaggaatgcttgtgatttttgcacattgattttttatcctgagactttgctgaagttgcttatcagcttaaggagattttgggctgagacgatgggattttctaaatatacagtcatgtcatctgcaaagagggacaatttgacttcctcttttcctaattgaataccctttatttctttctcctgcctgattgccctggccagaacttccaacactgtgttgaataggagtggtgagagagggcatccctgtcttgtgccagttttcaaagggaatgcgtccagtttttgcccattcagtatgatattggctgtaagtttgtcataaatagctcttactattttgagatacattccatcaatacctagtttattgagagtttttagcatgaagtgttgttgaattttgtcgaaggccttttctgcatctattgagataatcatgtggtttttgtctttggttctgtttatatgatggattacgtttactgatttgtgtatgttgaaccagccttgcatcccagggatgaagccaacttgatcgcggtggataaacgttttgatgtgctgctggatttggtttgccagtattttattgaggatttttgcatcaatgttcatcagggatattggtctaaaattctctttttttgttgtgtctctgccaggctttggtatcaggatgatgttggccttataaaatgaactagggaggattccttctttttctattgattggaatagtttcagaaggaatggtactagctcctctttgtacctctggtagaatttgactgtgaatctgtctggtccttgacttttttggttggtaggctacttattgcctcaatttcagaacctgtcattggtctattcagggattcaacttcttcctggtttagtcttgggaggatgtatgtgtccaggaatttgtccatttcttctagattttctagtttatttgtgtagaggtgtttatagtattctctgatggttgtttgtatttctgtgggatcggtggtgatatcccctttatcattttttattgtgtctatttgattcttctctcttttcttctttattaatcttgctagcagtctatcaattttgttgatcttttcaaaaaaccagctcctggattcattgattttttgaagagtttttttgtgtctctatcttagttcttcagttctgctctgatcttagttatttcttgccttctgctagcttttgaatgtgtttgctcttgcttctctagttcttttaattgtgatgttggggtgtcaattttagatctttcctgctttctcttgtgggcatttagtgctataaatttccctctacacactgcttaaatgtgtcccagagattctggtatgttgtgtctttgttctcattggtttcaaagaacatctttatttctgccttcatttcgttatgtacccagtagtcattcaggagcaggttgttcagtttccatgcagttgagtggttttgagtgagtttcttaatcctgagttctagtttgattgcactgtggtctgagagacagtttgttataatttctgttcttttacatttgctgaggagtgctttacttccaactatgtggtcaattttggaataagtgtggtgtggtgctgagaagaatgtatattctgttgatttggggtggagagttctgtagatgtctattaggtccgcttggtgcagagctgagttcaattcctggatatccttgttaactttctgtcttgttgatttgtctaatgttgacagtggggtgttaacgtctcccattattattgtgtgggagtctaagtctctttgtaggtctctaaggacttgctttatgaatctgggtgctcctgtattgggtgcatatatatttaggacagttagctctgcttgttgaattgatccctttaccattatgtaatggccttctttgtcccttttgatgtttgttggtttaaagtctgttttatcagagactaggattgcaacccctgctttttttgccccccatttgcttggtaggtcttcttccatccctttattttgagcctatgtgtgtctctgcacatgagatgggtctcctgaatacagcacactgatgggtcttgactctttatccaatttgccagtctgtgtcttttaattggagcatttagctcatttacatttaaagttaatattgttatgtgtgaatttgatcctgtcataatgatattagctggttattttgctcgttagttgatgcagtttcttcctagcactgatggtctttacaatttggcatgtttttgctgtggctggtacctgttgttcctctccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttcttcaagaatgttgaatattggccctcactcccttctggcttgtagagtttctgccgacagatcagctgttagtctgatgggcttccctttgtgggtaacccgacctttctctctggctgcccttaacatttttttccttcatttcgaccatggtgaatctgacaattatgtgtcttggaattgctcttctcaaggagtatctttgtggcattctctgtatttcctgaatttgaatgttggcctgcctcactaggttggggaggttctcctggataatatcctgaagagtgttttccaacttggttccattctccccgtcactttcaggcacaccaatccgacgtagatttggtcttttcacatagtgccataattcttggaggctttgttcatttctttttactcttttttctctaaagttctcttttcgcttcatttcactcatttgatcttcaatcactgataccctttcttccacttgatcaaattggctactgaagcttgtgcgtgcatcacgtagttctcatgccatggttttcagctcagtcaggtcatttaaggacttctctacactgtttattctagttagccattcatctcatctttttgcaaggtttttagcttctttgtgatgggttcaaacatcctcctttagctcggagaagtttgttattactgatcacctgaagccttcttctctcaactcgtcaaagtcattctctgtccagctttgttccattgctggcaaggacctgcgttcctttggaggagaagacgtgtgctggtttttagaattttcagcttttctgctctggtttctccccatctttgtggttttatctacctttggtctttgatgatggtgatgtacagatggggttttggtgtgaatgtcctttctctttgttagttttccttctaacagtcatgactctcagctgcaggtctgctggagtttgctggaggtccactccaggccctgtttgcctgggtatcaccagcagaggctgcagaacagcaaatgttgcagaacagcaaattttgctatctgatccttcctctggaagcttcatctcagaggggcacccagctgtatgaggtgtcagttggcccttactgggatgtgtctcccagttaggctacttgggggtcagggacccacttgaggaggcagtctgtctgttctcagatctcaaactccatgctgggagaagcactactctcttcaaagctgtcagacagggacatttaagtctgcagaagtttctgctgccttttgttcagctatgccctgaccccagaggtggagtctacagaggcaggcaggcctccttgagctgcagtgggctccacccagtttgagcttcctggcagctttgttcaccttctcaagcctcagcaatggcggacgcccctccctccacctcgctgccaccttgcagttcgatctcagattgctgtgctagcagtgagccaggctctgtgggtgtgggaccctccgagccatgcgcaggatataatctcctggtgtgccgtttgctaaggccattggaaaagcacagtattagggtgggagtgtcccgattttccagttgctgtctgtcacggcttcccttttctaggaaagggaattccccaaccccttgtgcttcccaggtgaggcaacgccctgccctgctctgtgggctgcacccactgtctgacaagccccaatgagatgaacctggtacctcagttggaatatgctgggagctgcagactggagctgttcctattcagccatcttggatgacaaggccaatatcctactgttattaaacttttcttctgccagagaactttgtccatcttttcccacttcccgagtgtatttgccgacattactctctgtactttttttaaaaaagaaactcttgattttggaacattttaagatttacagaaagttgcaaaggtagtacagagagttcctgcatgcctttcccccagcctcccctgttatgaacatcttacctaatggtggcacatttgtccagactaagaagttcatctgtacattactattaattccttgtacttccaaatagctgctgtctctttttcaggcattaattaggagcccagataattctaatgttgatatttgattgaaccaggatacttccttgtgaataagaagtgggctctataaattcaacattgtacacacaagttatcataggtctttctttctttcttttttttttttttagatggagtcttgctctgtcacccaggctggagtacagtggtgcaatctcggctcactccaacctctgcctcctgggttcaagcgattgtcctgcctcagcttcctgagtagctgggattacaggcgtgcaccaccatgcctggctaatttttgtatttttagtagagatggagtttcaccatgttggtcaggctggtcttgaactcctgataccatagatcttttgtagggtccatgtggtcctaacaaaattccatcacctctggcaggcccagagaactgctggttaattactaaaaaaaaaaatacataaagcagactcctattgaaaccaatttaaaatatgtgtttgagtattcacaaacttaccctcactgtgtttgaaaccttcaagttttttttggtgaacacagaatatctgtttttgaacaaaacattctaacctgatgtgtaaatgtgatatgctcatagaaagggagctgaagattgcagcactcttttggacatgatatttgatacaagttagattataagactcaagattttgaaaagggccccttggaaacttcccagatgagatggttcaatggggaacataccagatggaatgtataggcctctgtcctaaacagatgttgtacagctgggaaagctgtgacaagaaaatgcaccccaaatgcttctgatggacagatctctgtgcacacatgcacacacacacacacacacacacacagcgttttaagaatcaaaatattcagattgcttaaaaattagaatttcaggtgtcagtcaccagtggtgtatatatatatatatatatatatatatatatatccccattgttggaatggcccagtttgtcagcatcaaatccatagtccatctgtgattgcccttgaaactgatgaattcacttcaattccaacctaatcaattctgaactagtgccttgaagtcatttaaatagtaacttcctttgcacaaaatcttaagaccgtggagagtggaggtcaagagaacactagtaaggtggcctctgacttcttgagcttttgacattcagccaccagaggctgctctgagaccattatcctcttttcactccgggtccaaatcccaacggtgaaacctgtaaggactgattttgtttccattgctttgaattttccttcctcaatgcagttccctggaggtctgctgtttggagaagatgattaattatagttaaagaggaacagctgaaagaagaaaaaaactacagattactgttttgccctcctctctatttttaaactcttaatcttgttctgtttcttttaaataaaagaaaattggtcagggtggaaagagaaagtgctttcttactggcactggctaatttttcttcatttttcccctctgtgttgctggattttcaaagaacatttctgaagggttttaaatctttattccacaatacttacttccacatggtttctattcttccagattttgccagcattttatagttgctttcatgctgttccctctgttttatgtttttaaatctttgcctttctcctttctctctatctaacaaagcaaatccaaaattaaatggaatatctatagttaggtaagaaggattaaaaatggttttgttgcctctaacatattttgtagtctgggacaactaagcactgatttaaattgttaactgaagaatgaaaccagtttcttcatgtgacattgctttcaatcttcacgagtgaagacatgactgtgacagacaatgaccagcctgtcaaaaataagtgtttttatgttattgttacatacaccaccctaattattatacttccatatttatgaaagtaagttactatgtaaagaacttaagttctaaagccatggcaaatactaaattaatagttttgcagcagacaaagtaatcaatgtgtaaatgacctggagaatttcagcatgacaattctttcattctagacttattctttttttttcttagtaaaattccatgtctgattggaaaaggtataatttaaatgtatgcattcttatagaaggcatatagaaaacatgctcattttctacagattacagaaaaatcaattgagttgcaaggaaaatgaatacttattttattaatttctatttgcagtaaaagatggaaatgtaaagatttccttttgctctgaaaaggaattcttgagataccatgaaacattcctaagtggtatcatattcatagagtggaactatcattagaagcatttgaaatgtttggtatttcacctcaagtgtaatcataatggtaaagattcttaatattggtgactaaagtaggatacatgtgggtttatattttcaggtagaatactggcagctacagtatgtcaactggagcatatttcaccaaatgccttgacaaagatggaatgacaatgaaattgctagatctcttctctggggcaggttatgcttttcaacttgcccctactaaggagagtaccagaagccatttgcccatgagtaataccttattaaaccatcatgatttaatgtggcatatttttctctcaatttgcatgcctgacagtcgacttcctgaatatcacattcgagctgagccacagaagaaaaatagacccactgaagtagcattaggtcagcttcgcgggatgcattagcaacctgtctgaacaaagacgggggactcaggcgcagaaaatcataacgtggccccaggccctgggaggtggccccattgccttgcaaatgtatcgcatgactcattattaaacacaccaagaacagacgaattccaggcgagtgaagcatccactgattcaattgcagttaggtgggttgtacgatattcgtcttacttgcttttccttaaagaacacccacaccatctcttacgctcttgaacacggcacgtcaaatgcatgaagcaagtgtattaagataaaaattgctagcattaaatacaggcacttaaattagtataaccctctggccagatatagtgcactaaattgcacaggctttaaaatgccagcactcaatttaaaaaaaaaaaaatgtatccatagcaacctctttgttaagggaatagttaccaggaaggatacacatctttccagagaatcagagataaaaccatattagttaactggatgatattacttggatttaaatttaactagaggcatggttcaggagaaggggctttttaaaaactttacaacttatatgcttatttccagtaaaatgtgttttcatatctttcttattaccaaaagattcttacatatgggacttttattaaaataccatggaataactttgggtttcagatatttagaaataaatatcaaccatcctgttcttcctgcccacagcatgcctatcattttttttcttagcattttcttttagcatacacataggtattattctgcaatttttgctctatatgcatctttgatggtcctttcatggatatttgttaccagaaagggcacagggtcttgtaataacccacaatccttctattgtgaggtcatctgacttaagtcatcctgtttccaagagactttctctctgtctaatggagtggcctttcgtgcagttatgtcatgtgatgtgggctgtaggggagggggaaatgggggatgactaacagtgaggtgaagagcctgcaaataacaatgtctcacatttcttaggcaacgagtattggggaggaaatcttttcatctaccttcttctgttcaatccctgggggcctgcaaactaaactaacaaaagatagattaacaggagaaaaggcacacaattttaatcaatatttacatgtacaaggctgtgtttggaagctctagcctgtaattccagcactttgggaggccaaggcgggaggattgcctgagcccaggagtttgagaccagcctgagcagcatagggagaccctgcctctacaaaaaaaatttaaaaattagccaggcatggtggtgtgcacctgtagtctcagctactctggaggctgaggtaggaggattgcttgggcctgggaggttgattgaggctgcagtgagccataatcacatcactgcactctagcctgggcaacagagagagaccttgtctcaaaaaaagaaaaaaaagtacatacacaagagttcacacaaaaggagcaaaacacaaagaagcagctagactcaggggcttttaacatacccttttaacaaaggaaagagggtttgggcttcaagggataataaattatgggaaaatgactaggaaatatataggggaactaatgaacaataaggactaaggtctatttatacaaactcttcttggtatcaactccccatcttctatgataaaagtcattcttctctctctggtacagggggcaccttcttcaaagggaaatgtatgttctgcttttaggcagatagagggagggcagagaactcttccgacagctgttgattttcatttgactttagctcaaaataattattatgccaaagaggcatatttggggttggcatattctgatccccttcaggaggtaaacacatcaagcttggagcttaaattagtcaatgtcagtcagagccagcttcttgggcatacaacctgtgcagttacatgaggtcccacacttggtctaatggtagactgaatgggcatggctgcattccaataaaactttatctatgggcactgaaattttaatttcacatacttttcatatgtcatgaaatataattcttttgattctttcaactatttgaaaatgttaaaaaaaaaattcttaactcatggaccatacaaaaacaggtggtgggcaggcttgggctggagtacctgagtttgccaacccctgatatacagaagcatttccaaaaccaacagcatcggccctacctgggaacttgtcagaaatgcaaatttctaggccccaccccagactgctgaatcagaaactctggggtggggccctgtaacctgtgttttaacaagccctctaggggattctgatgcccactccaatttgagaaccactgatctagacctgtggttctcaaccttggctactcatcaaaattccctaaggtagcttttaaaaactctgctccaaggcccagcccaggtcaattaaatcagactttctgggggtgggactcaggcacccgtatcttttaaatctcttccaggtgatttcaatgggcagccaaagcaactaatggttccattgtacaaataagggaactgtagctcagagagtttaagtgacttgcccaagatacacaacaagaagaaacaggtacagcacagctcatttacgtttgtttttttagacatatgagggttagaatagtacatttggtaatggaatgtatttgctagaagcttcaggggtcaggttaccttttatttagcaccaattaatttaacacatctgaaaacatgccctaaataaaatgaaaactagctttggaaactcattaggccagacaatgcaagcgtaattgaaagaaataaggtgcagacgctcagcaaggtcccatctgaaagcactttggggctgaagggtgagctccatgattcaaaggaaagacaaatatggagagctaatgtcagacattgttgcctgccctggagctacttagaagtgtgtctgaacaattgcttcctgttcggtatctgggacataggtaaatatgttacagtcctaaatgacattaatgacagaaaaaaagtctccatgcttgtgatggattttatgactcttaaggattcctgtgccttgggcatttttaaggcgaactttcaaatgataaatattttgttctgattttctcagcaaagacttcatcatatcaaggaaggaagaatatgggctacgtacccaaaatagagctggagaaagcaatgcacgatggaaactgagtcatgcaatgattacaagtggagtcatataaacatacaactgactctttgacgtttttgttttatgagttacctgatcataatacaagctactatttttgagtatttactatgtgctgtgttctcctcatagttctatggttaagggcatgttttcaggaactggtcagcctgagtgcacaaactagtatctatggcctcctagctgtgtgactttggcaagttactttgcctctctgtgcctcagttttctcctctggaaaatggggataatattagtaccttttctcatagggtgaaggaagattaaatgtgctcacaacagtgtctggcttctaataagcattcaataaatgttaaataatattatttttaaacaaatcacctcaattctcacaataactttgagggatattaagcagatgggccaacttatcacaactattaagtgacaggattgatatttggactaaggctgtttccagcatcagtgctgccagccacagtgctatactgcattgattgggaataataaattaagtatttatgttcaattttttccatgtatagtataaacttttgggcatgatccaaatatccctggaccttcttgttatctggatgattttacaaagcctccagactgcccctcccacaggacactgaagcaaggttgtggtccctcctatcaactgctcctcctgcagttgtccccatctcagtaaatagtgacttcattctcccagctgtcccaggaaacaacctggaaacctcgtttctgctctttatctgacacatacagtccatcagcaagccacactcattgtactatcaaaatctatccaggaactccccaagtcaccccacttccagtgccacccccgtcccaatccaccatcatctcttaacatctcctgccttgcaggctgctctctgtctagcagtcagactgagctctataatatcaattggatattgttactcctgagctctgaaaccttcccatctcactccaaggaaaacccaagatccttctagtgatctactagaccctacaggatctgcaaacactgcctcaccaacacccacccacaaccactgcccccgccccccgcacacatacaccctcagacacattcctgagacttcagctcctactactgtagtgcttcctccctctgctccaacctacataggcttcctgcgttggttgagttcaccctggcctcacagcttctgcaatcactgtttcctctgcccgggtaactctgcccccatccatcactgtagttgaaagtcttgcttcctcacttccttaggactttgctaaaatatcaccctataaaatatagaaactcctcatcccattgacactccttaccccacatacaatagcccctatcaccatcagacctactttctacttatttgttgatgtgtttgtctatctcccttcactagaaggtatgctcatgacagcagcacttaacctatttgtacctgtctgtatcgtcagcacctagaacaatgcctggcacatagtagacacccaataaatacttactgacatgatcaggcatgttcagggtgttatagctgtagtccataaatacttactgaatacctatgaccgttctggcataaagaaggtataccatctttgttagcatatggttaaggcatgagagtctctccgattctttttcttatatgaagcacttgtctctatgcttgagatctttggattccctgggagtgatgaaaatcaattcatagagatgtacagatatctatctatatgttgctaatgaaatcgatggctagaacattgatgcaccaattagctctgaataaagaaaagtgctctaaggctgcattcctaactgtggaaatgaatcacacaaacgtattccactaggaacatcattcagcaattctgaatggaaaaggaaaacctcattcacagtcctagacaaagagccctaaaatccaaatcctcctctgcatagcacaataccaacatctttttccatgagggctactcccttaacagacaaatgcattgttttttcctacctctggttgattggatgaacacagcccaaatttggagagccatttaaggtgattaaaaatcattacagtgctggccaggcttagtggctcacgcctgtaatcccagcactttgggaggccaagactggtggatcacttgaggccaggagtttgagaccagcctggccaatatggcgagaccctgtttctactaaaaaagaaaaaaaaaatagccaggcatggtggcactcacctataatcccagccactagagtggctgaggctggagaatagcttgaactcaggaagcagaggttgcagtgagctgagatcacgccactgcacaacagcctggatgacagagcaagactgtctaaaaaaaaaaaaaatcattaaagtgcttcagtttgcttccaaatgtaatggcaaattcctgactcatcttgaaggtgcaacatgagagacttttggaggtagattgtggttggggatcttagaaccatctaagtggtaaattccatcacccccattgaggcacaggaggtgaaggagtgtttgtgatgagtcatgggcatactgcattttgagcctcattccaaaggggacctgcatctgaactagggtgccagcaccacatgctgctggaaagagtatgggttctcgagtttgagagatggattccgatgtcccatataccaactgtacacttcctgcatgtccaaaaagggactgatgtataactggtccatgatagatacgagagtttttcaattgcctgccttttaattcagcacaaatacctcctggtgggttatattatatcatattatattgtattgtgcatctctgtaatgtaggtactcgtatttttatctcattagacctctcagtgtgtggtgtatcagctggttttaaattcccttaattgggctaaattaatttgcccagttgaagaaaagtccacctatttgcgaattggttggtttctaaagatgaccataacaaaattatcttttttttccacacagatatagtttaggacaaatatcactagggcactgtggtacaacttaaataatgctatgaaaaagaatagttattttgttcattgtatgatgctatttaaatcactcacattaaaataatattaaatagcattgctatttataagataatgtagacaggcaatataagcccttccttttgtaaattaatgattcaaaggagaaataaaatgaagcctcatttgaatgtagtttctcagatatttagatttctttaataaatatgggaaaagctgaggcactgatacccatgtttgcatttttttcttgccatgactaaatatgtttattttgcatcaggggaataatataagaaagcctatctcagtatgtgttgattttcataagtggttctcaacagaaaaaaaaaacttatgacaagttacctagttataaggaaataagggtaaatattatttccttggccattaaaaatgttaaaaaaaaacacacaccatgatctgtgtgtaacaaaggaaagtgacacataaaccatgattcctaagtagtttttatctttactaccatcttagatccaggtatgtgtgaagtgggagaggattttcaccaatcagaaataacacaaccatcctggcaatctttctgttcatttaagtaccaatctaaaagataaagcattgactttttgtaagcaaggagcgcaaatcctgttcaaagcttcttttgattaaaatttttattcacctccttatgtccacatgcttatcaatgatccagcctgatttgcttgtttctaacatacaaaaaaagagatctgattcataaaagttaatatttttaatctctaagactaatttaaatatcagctttgtgcattaaaatattaaaggtttgagggactaatctttctcgtatataaggaaagtgagataaaagaataagaagtaaaatggttaaatatgaaggacagtaaccagctattcctagtcatacaaaaacccacaaaaaatggatttaaatcaagaatgataccaattaggaataagaacaaaaggtggttttcgattactctaatgaattattaaggtgtcttggatatagaatattcattcctggagatctaaaagaatgtccaaaacaatttggatcagaactgtctatatgtatctctggttacatgtggaaaaactatcataagccttgaacaaattaaagctgaaatggtggaaacaggaaatgccaatcaggtcatatgtgtatgacgtgatcacattacacttgggtttcagaatggaccattaggcatataatttctctgaagctctaccacgactctggtcatctatgggccagatgataataaaacactgctagttcataggaagtgactttaaggacaagaaattgatttaataaccagagagtatctttttgtttattttaaactaattttaattttatcaaagtaatacatgttcaacatacaaatgtatgaaagactcttaatgaaaaacagtaatccctgtcccatcccactccaccctagggacaatcactttcaactggcaaatatctcctctgctatgtatctccatatttcccataatgtgcctttactgctctttcctggtttatgaattttggatattattcttaacattctacatatgatcaaaaaggaattagccctcctcatcccaataccacattcttccaatataatggtgtcaggaattatgttcacccagtaacacagatcccaaaacattggctcaaacaaattagcaatttattttttcatagaacatgaagcttagggctcatttggaggctccaggatgtcatcagaaatccaagatccttctatcttttctgttatccagctttactaggtgttctgtcctcgtcattgttacagaaaggccccagtccctcagacattgcaaccattcctggtggagaaatccaggaagggcaaagagcaaacagtgtgtgttccctttaaatagctttcccaaaagccctacatagcacatagcagcttctattaaaatttcataggcctaccagacatggtggtgtgagcttgtagtcccagctacttgggaggctgaggcaggaggatggctcgtgcccaggagtttgaggctgtagtgcaatatgagtgtgcctgtgactagccactgcactccagcctgggcaacacagcgagacctagtctttaataataataataataataataataataataatagtttcatatgatcacctatacctgcaaagggggctgggaaatgttcttcagctgggcacatttctgccccaagtaaactgaggttctgttgaaaagaagcaaagggaagatgaatactggattggctaccagtagtctctgccataatatctatatcagaaatcactgccaagttaaggactgttctataacaatgcttcctttttttgtgcattcttttgttttgcctggagttaataatagcctcacatattgcttatatttatgtgtaactatttgccctcaaatgttacctatagtatcatttttcccccagagtcctaactccaggactcctccatcctcctgctacaatttagatggggcctttctaagatgctgcacacaactgcatgataattatgtagttattatcctggactttccttacttctttttatgttggttcctctattttctgggtcccattgacttatctttcttagtttaacactctcattttgctaaaacacatctttgagtggtttccaaagaaagagtacatgggatgcaaaaatgttgagccttggtatgaaaacaattgcattatattctgacatttgattgatagtatgacttggtaaagaactgtcagctagaaatcacttaatctcaaaattaaataaaatggagctcttaacttccagcactgcagttgataagtacataataaatcgattagcaaaatttcattattgataaagaagacggccttctactaatggagattttaaaattattaatattattattagtcacaacaactcagtaaacatttattgactgaccacacactctgtgcttgttgttgcaatggatatacaaatgtttgggcatgggccttgtgacggtttatgtgttaacttggctaggctgtagtacccacttattcaaccaaatgttaatcaaggtgttgccatgaaggtatattgaacatatatggtgaatatctacaatcagttgacttcagtaaaggagattatccttgataatgtaggtgggccacaccccattagttaaagcctttacagcaaaatcgaggtttccctgaggaaggagaaattctgcctcaagtctacagagtccgcacctgccagcctgccccatggatgtcagacttgccagaccccatagttacataagcctgttttatgtttctctggagagccctgactgatacaggcaatcacttaaaaaataattaatttaaataattttcctctttaaatttaaataaaaaattatagtaaaaaataaatgacagaaattgaagaattattcttgggaagtatgatattattgtattgaaatgaagtagaaagttcaattgggagtggagattttgaccacaggaggaggatataacaagcccttggtaaattcatgcataaaccatttttggcggctgaagcaggaggatcacttgagcccaggagttcaagaccagcctgggcaacatagcaagacccccatctctacaaattagtaaaaaatattagccaggcatggtgacatgcacctgtggtgccagctactcaggaggctgaggtgggagaatcacttgagtccagacggttgagggtgcagtgagccgagattatgccactgcactccagcctaggcagcagagtgagaccctgtttcaaaaaaattttaaaaaagtaataaagttaaatgaaataaaataaaaatcttaaaaattcatgcataaaccatttaccagattactcaagggcagataatgaagaatctgctatatttaatcttaagacaaactagatgctgttaaaatatttcacctttaaaagcatagaattattaaatagtaaggtttaattaacattaaaaatgacatgatttgctttgattccttaattttctagtgaggaaacaacaagcttagggtacatttctgactacatagattttttcccttctttccagtgttggtcatccaacacatttacacaacaagcaatagcgattgcactgggcacacttcccaatatatgaatttattcaagctgtgcaattgtcccctgagaaatcttgggcttagaggtatcaactggcttatctgaggtctattagccagttagtgaccaagtcagcacagaaaactgactccaagtcttatttggcccatccttgtggtatgccacattgtttcccttaaccaactgaaagaaactaatttaaggagtacctgtacacaggaagtagaaacttttttctctttttgtgactttctataagaattatagatgagatttttttttctaagtggggactcatgttgttgtcaacttaaattacctttactaatcacttcgaacacggtattccatacatttccctctgtcccgataataaaacaactggatttctgaaacctctgagggagaataaacatgctcttttcatagctcccaaagtctgtgcacttgtactgggcactgtccaggtggctgcatagacaacttcagcttgattttcattgacttttgatgtgtcctgacacacattaaaataacctatgtgaaattgctgatattcagccattttttacttacacaaacattcactccatgttctttgatctatgagatcactgagagaggtggcacaaatactgttaggtatcgtccaagggcgccacagcaatgcctgtccatgtctgagtagcgctgcctgtccaggactatccacccagaacctatgttaggtttgctacaaggtctgttaataaccaaacccgcacataactaacaagattatcgactaggctgctttttttgaagaagagctttcaaaacttccaacatcccttcagctaatatttgcaaacatgtttaatcacagatttgggaacagaacatctgttcgtttggtagagcaagctcttttactcacttcacctttcttttctttttcccttccttccttccttccttccttccttccttctttctttctctctttcttttctttctttctttcctttctttatttttttttcttttttttcggggtcttatttgtcgcccaggctggagtgcagtggcacaacctaggctcactgcagcctcgacctcctgggttcaagtgatcctcctgtcttagctccccaagtacctgagactacaggcacacaccaccatgcccagctatttttttttttttttttttgtagagacagcatttcaccatgttgcccaggctggtctcaaactcctgagctcaagcgatcatccgccctcctcggccttcaaaagttctaggattacaggtgtgagccacctcaccgggcctcactgtttctaataggtggatcaaatcctcactcaatgaacattctccaaaggaccatttatttcattcagaattttaaacatttccatttgtttatttgtaaatgaaaaagactttgtgtatccccacctttcattttttttagaggttttctgaaacatggaggcagcatattttatggcactgtgttagttcaggctgctataacaaaatactgtaccttagactgggtcatttataaacaacagacaattatttctcgtagttctggaggcaggtaaatccaagatcaaggtgccagcagatttggtgtctggcgagggctctctgcttcatcagtggctccttgttgctgtgtcctcacatggcagaaggggcaaataggctctctgaaacctcttttataagggtattttgctttaagggcatagaagatggaagggattaatttttcttggggcatttggggaaatcacgaatgagtggtgacatttgagattgttggatagttggtgagtgagtcaaaggagaataaaaatggaaggaacattaaaagggctcagtccttgagagaggaaatcccagctcatatttacctttgaggtgatgaaagcagaaggcagacgcagttgtagcttctactgaaggtgataaacagatgtgccatgggattaagctccagtatttaatggcaggagccctgggtagcttcctgtgtcctgtggctggggcatacctagggctgggatagacgcaatatttctcaaagtaaatcagagtcctttgtcagtgggataaaatgctgattctcaggctcctcagcaaacctactgaatcagattattttggtgcaggggcctggagatttgcatttttaacaatctccccagaggtttccttgcaccctcaagtttaagaaccaccctttcaaagcgtgatttcatcacccaggagacatttggtaatgtctggagacattattggtcatcacgattgtgggggtgctactggcatctagtgtgcagaatccagggatgctgctacacatcttacagtgcacaggacagccctcacgacaaagaattatcctgcccaaaatgtcaatagtgctgagattgagaaatcctgaactccatcatatgaagggctctcaaggaaaagtacaagaagtggactgaagtcagtttgtgtcactaggtggctccttaggctactcaggcagggggctagcgttatgggcttccaggcccagttatcggaccaccaaattttcacagaactgggcagagctcacatgtattgaacccatgcagctgacactcctgaagccaccaatgcattatttgctaagtaattttttttcctctgataccaacacatttaaaatctttattgaattatcgtcacaaaattgcggtcatttcttgggggaaaatatgccattagttctacacaaagtactctttgctcaacttgcactttcttgaaatccagaaggtagatttacattaaaatcatgttggctaagagttgaaaaaagttattgcttatatggagttaagaaagcaaactttggaaattttttttggtctgagtttgtttctaagaagccaactacttctccagctctcctgcaatcctgccaaggtgatgtccagcttgtccctgttaataagttcaacagatcaaccctgtagggaagccaaaccatagagaaaggtggatgcactaaatttttttttttctgaacaaaatgtcagtgtgtattgttctatgacaatagtgttatttgaaattatgcctcgggccttcagtaggtaaagattcttgttcatttgctgcatttcaaaaaaattgtgtgcacgttcccattaagatttatttttcttaaattgaatatacagttaatctatatgcagatgaggtaggtaacaccctcctttctggattgttcgttttagttaaggtgttactcataacaatttggtttcctttccagtcttttgcaaaagtagggcttcagtgcaagatatccttttaaaaatacccttgggtcctgagtgttgaacttttctggctgaaataattttgcaccttccaaatgttttaatgctgttagggagctcttaaaatgcaaggatttaaggcccttagctagttaagcttttagcagaactagagctgttagataagaatagaactcatcctttacttttggagctttggacattgtttccagctgcttccagtcatttgaatcccgaaagcgcccctaatcctcgcggaggcagcctttctggctcccaggacccacccccttgcttctgattggcgaagctcctccgcggcccaagccagccacctacaacgtctctgagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcaggtaagctcaggcggttgcgctggcggcggagggggcgggcgccgcccgggacccctgcgacgtgttactgcggagagcttgctgggttagcaggcgcctggccgtagtcgatgcgtttggcggaaagacggggctgcattttcctaagacaaccaaagaagcacattttacctgagccaccccggtctggtcctcgccacccgcccccacttttgcctctaattgtggttgatgtcaggcagtcgttgtaaagggcttacaagcagtttgtagaatatatgtaaatcaattccagtttgcggccgctggaatgtatcgtgcaggatgtatctcgagcttttagtgcctctaccctatgctttgggctagaataaagacagctgaatgtcctgaaaaagaatttcacggggcctcttatctcattttggtttcgcattctgagcacttactgtgtttctggcggagaaggcggaaccagcttgaaatgagcacagacagtccttccagaaaaatgcaaatttgtttttctgttctagcagtttggaaactgtattgcttctggacgtgagaaggcagccctgaaagtagtgagcggagaaagggctgggggattacttaaatgagtctttgaaaagaattctaaaccaacagcttcttctgtggctctggggcatgatgataaaattccttatcagtccaggaagaggtttatagctttgctgttaagcaagaaaaggaaagaaaaagtggatgtaggaagccaaggagagggtgtgatttacaactcaatcaaagttatggaagaattttatgtcaatatttaaatatcaagaacaatactcatataaggagaaaacaaggctggaaaaacatgccaataggcttggaagggcagggatttcaagaggaatgctattgcttttaccagctctgaataaatctggatgggaaagttagcatctgtatcgcaaccggaaaagctcttcactttttcttctaagtgggttgggtgctcgccaccctgcacactttgggggaagtgagctttccatttaagagcgcaggggaggggtttcgaactttctgtccctttcccacagccttgggagatgaagcagagcccccttcgaatggtcagcgcaaaccctccgccttcttgccccctcgcttgttcgctcagcaagcaggcttggcaagtttcagtgagtgcagaaaaacacttgcggaggagcaagtgccgtctgcttgcaatgaattgcccttgccttggtagggactgtggggaggacgtctttaagttctgcaaactcacagtccaacctcatacttttaatgtctactaaagtgggatgaggaaaaggaaggagaagggtaattggaaaggattgaaaaggaaaaagaggaacgcaaaacatttttgacaaaggtccttagctggaacaaagaagttatttgatcctgtgcagagccacctgtcctctcctcggtggtgtctgagctcaatttccagaatccctgttcccacacaattcctcaggaaccatggcagtctccgtgccttatgcctaaggtttgcttcccccagcttggaatggtttttcccatgcctagtttgttgtggcatttacgtgaagttggaaaacagcccagtattgaaattttaggggtacaagtacacatatagtgaactccttagttatttaatgaatgggcaacttttcatctcacagctacgtatgtctactaatttttttggcctgttcagaactttgaaagagggtgggatggaacaggggaggagatgaaggagagagacaggatcattgttcatccaaagaacgaggacagtttccagaatctagcatgttgttccactgcagtcagaacaagaatgtagggaggaatgagatggcagtgttattggcatgggttaatccctactttatttgagtttctcttggggaaacctgactgttgcatccaggcagggtgagtcgaattcaccagccaatttgtcatctcagcccggcagctccagctggatttacagggttaactatcaaacagacctgtgtgtcatcagctcagcaatgaaattggatctctttgctgatgagtgatctgtccctagggctgcacaaatgttgtacactggtgtggcagcccagaagagacccctgcctgccactgatagccagaaattctgggtagccagaaattgcccgcagaattagaaggctgtttgcctagctataagattcagaggggtttgggcttctgccaggttggcagaaaaggaacattcctgaagccaccacttcaggtgtagaaggatagtattctttgagggttcctaaggccacggctgagttaggccaaagaaaagtgtaaatctgattcaccttgatcaggaagtaattttaaaatatgtgccaacctgtctctgccctctgatcataaacgggaaacttttatgaaccttccttgagaaggaatttgctctgttcccaggcaaaaggaaaagcatggccacctgttctagaagcctggccgaaaacaacaggtttgcctgtggcattcccgcaactgcatatatcctccccacatggcaagccacccattgtccctacacacaagaagaacaaatagttcattcttgagctgggggaaaaatcagattctctaggcaaaattgcctactagacatattttgtgtttttaacatcctgataactttagaaaaaaaactctaagggaagaaggtgcatgatgtatttctgatctactaaaacaaagtaagtcacgtagctgctaaattcttgcaaggccaggatgctgctgtttcaaggaagccgtgaatctgtttggttagcccgttctgcattctttagattggaattaaaatgcccaaggacatctggcttaataatgaaagtcttcgtattaatctttcctctgaggattagaaagtcctttacaaacacgatctatttattctctgccacatccccaggagagaatgaggtggcaatttgatcctcattgaacaaatggtgagacgaaggcagagaaaggttaagtataaagagacacagcaagttaggggcaagtctggggatgaatactcacccacccagaaagactacctgtgcaggtttaggatctcaaatggcattctagggattaaaacagaatctctcttacgacattctttttcttatcattctgtaactggcaagtatattgtgtcccaagtatgttgtatggtttccttcatttgaaagtccagactcttaacagttcaaaaggcagttctgttctcatttctcccaacattgagatcaggcagcttttatgaaatctaatagaaagatacagtaactaactggaattttaaatatgcatctgagaaatgttccctttcaacagatgttttaagtttttgcacatggtttatagagctcagtgtcttcaacatatgttaaaattttaatttcttctctgctatctctctttcagcaaatgttataatcataagacttgctgtcagtttaaagatccttgttggtcattttgaaataatttttttgagtcatgtttttagttcgcttggctgtagaccgcataggctacaagcaaatccgttaattggtagttgcatgttatccacagacattccagcaagttttaaggctaagtgcatatgtggatgtctcctggctttgatcgtttgtgtggtaaatagacatccaaggtagctatggcaacctgggctgtgcgttggtgaaaggaggggatttagttactggacaaagagtaatttgtttgattagaaaaaggtaggggcaaatcaggacatttttaacccacatgatttgaggatcccagttcaatcaaatcatttggatttttctcaataggcaaaaagaagtaatggctaagcgcaccagagtatcttgcagacgtaatttaattatttttaaacaagtggttgctactttccaaaagcaatttatacaatgaaaaggaagtacaatatatcatataaatatcatcaatatccctattgtactaagtatgaacgtttttattttcagaacttgatgggactttgaaagaccaggatctgattagaggtgtgcatttcagttatctacctgcaggggtcaggcttgaagttcccgtggtcggaagatcaggcagcggacttcactgcagggagcccgaggcagagtcagagagaattgctctgcttatttggaacaattagttagcgattctttaatcttgtgaccaaagctactatgaaaatgagttcattcaaggaagagaatatcaaatacgctgtgattaaagaaagggcgataaagccaggtcaaacagcaatctaatctccgtttacatgtaaggcagtttatcgggaagattctggctcattatcaattcctttgatttcacacaaaagtgagctcagcggttttgttctagaaatttgtttgcccagttttatgagctggcatgttataaaaatttctttaaactaaaaaggacacaatattagggagccatctggatccgaaatatttttccccctctggaggaaaatattccattgacacaagatcaggatggttaatggcctccaggaggtcaggtgatagtaggagcacagaaaattgaggcgcagaacaaaatgccaagaggggactttcctgaaaaaacaaaccagaccaaagaaaataacttacctgctttgcgctatgaaagagaggttctgagtaaacatggaagaggtgctgatcatttgtagtacaagtggatgttgaaggtcttatattcagtccagtgtttatgatgaatataatataaaggctgtccttcctttcttatatcattcaatgacatttactgagcactcacagaattaatatattctgccacattatacgtgattattaatgtgccagggcactttctgggttccaaatatgactttggtaaggcccctgccctcaaagaacttttgatctggtgtacaatttattgtaccagtagcataatgtaggtttttccatggtcaaaatggatgctcattaatatctatatttgtatgggtagggatccacttgaaaaactgatggtatccaaaaccttactgaacttaggagacttgagaagtgatttgtaattgtgaaatttagttgatttttagcccacatgtccatttgtagaaatttatgacttcttacataaagcagatttctcataattattaaatagtaatttatttttctcaatagagaaaagtaactcataggtagtccccaatctaggaatactttatgttttaggagtttgttgtttgaaacccagagcattttccagcgaaaaataatcaatctgattaatgtgagatcaagttctgtgttttgaggacatgccactgtgttatacaggatggaaacagaaggagaaagaattggcatacttttggtaataggccagtcatggcaatatttgaaataggaagttcgtactagttttcacctttctttctccatccttctgatgtcttctggtctcactggggcatctcccccaggcctgtcctaatatatagtgaattcataattgttcatcttcccacccttcccttccccacctccaaaccactctcctgtttcctttagtcaatggtctctaccacatggcaggaaagaagtaatatgggtgagccaaagctcatgactcttatccctttaacccttaggatgaatctttaattggggaaatttcaagcagtggagcctggagctacaaaacacatgattttcctttcagggacaatatttgggggcagggccatgcctttggcagacagaacttgctggtgtgtctgcccgtgggtcagacctcttcatttgttctttctcagcaacctgcctgaacttctggacccactagggtctttgtgagtaacagccagggagccacaggcccccagttgagagggaattatggcgtttgtgggtttgggttgtttgtaagtatgctctttgtatgctgagcactgtctacttggattagaataaatggaaagaaaatagctgtagcatcctcttatccacacgagtatttgagttggtgtatatatttctactcgtttgtctgcttatcttggaactgagttactccagagcaagagtcacatattaattacctttgaatccccagacccaagcccagtgtctggcacacaataagaatcattaagtgttctacaggcacatgctgggtgaattttagtaaaaaagagaatggaaaatgctccttaaaatccgaagggatatgaagaagaaagggcattagaaaggtccgggaaacagcaaggactaaatagatcagtagtagagaaaattagcataggttatgattactgaactatatgtatatggttttatatatatatagtccatttatatacacatagtctctctctgtctgtctgtctgtctgtctgtctctctctctctctctctctctctctctctctctctatatatatatatatatatatatatatatatatatattcctttcagttgtgttctgggcaagaacacaacccaaaacatggtaagcagcttggcttatcctctgtttgattgttctgcagaaatgattacgaaatgggtcatgccctccaatagctcaaagcctaatcgccaagatagaatctgctgctttctctcattgaacccagcctgatagtttaggccttaggtccatgtgcagttgtttaattttgcaggtgagtggcatgcccaaggttactccagaactgagatagcgtgtctgagagaagactgaagccttctccatgtagatggtggccacatttttcatagtgaagttcaagatttgtgccggacaaagcattttcattgctggtaggtgtaacagaccagaagttatagttaaaaatgacaaaatagaaatttcagggacatttaatagtttatggaaacaacaggactaatatattaccaaagggtctatgcggtagactgtggtatctgtcctatgtcaagttttggagtgttgctttggttgtgtgtatttagaagtggtcttccccaaacaattcggaggaagggggatgttactgggaaaatggaattcattgaatgccctgctgagttaataataagtagatgaatggccaaataaagcaatatatagatggacggcaccaccaaatattattaatagagatttatttacttacataggatcaagtcttctgtacgaaatacattaggaatccagactaagaatactggttaaagtttagcatttctgggttgacgttttagcacaagaaacactttaccctccatctgggagcaaggtatgagggagacttaggttctacacctagaagctaagtcttctagactccccatctcattctcttttgtgactgtaccacatgccttctactaagatataatttggatgttttcaggtcatgtgctataattcaatatgctaataaattccaaggcaatttgaatggaatgttggtttataatgaggcaactcaggaaagactacatcatctttagtggaaaatactgtccaaaaaatccaaatagttaaatgatcttatatttgggttttgtgcttcttttatgtgtatattctttgctctgattttagttaagtatgaaaatgtcagacagcaaaaactaggaggattatatttatataaaagaaagtttagggaatgagatgagtcatttagcccatgaattaatcagctgtgctttgaggaaatagtgcaggaaggtaaaatggaacaaatagacgagagaagaaagcgtgacttcttttagtcaacatatgatggggaaagcggtagagaaaaattggctatttggtgagtgattcacttgagttccttttcagtggtcaatgtttaaagtgaaatcctaatgagattgttgctgccctttttgtacggctctgactaaaagagggaaaacagtcataataattaattgagaggggtatgactttctgagtagataaaaacatgatagactattagataatgaatatttattgcttgatgcttctcagtctggaagagacactttctgaatatttctccgctttctaacatttcagctgtcagaattgaatggttcacatataaactacattgttttggtttaactaacaaagagtgataagacatgaattgtttgtgacagccccgaacattgataacagaagacattaatgcctgcagacacagcctacatggtaaaaatctggaaacaaaaatgcttattatgttaggccatcgtgctttgacctagttttgcttttctgcttggaaattatgtcaatattagttacatcatcccttcggatgagcaattccacattcttgtttatttcagtgtcatattattagtttttgtatatttagttctgacctctgaggagccaaactaatcctcattgacttgcattttccttttgaaatgagacttctgcatgataaagagagaggattttatgtattaacaaaacaatctaagatgcctctttaaaggcattcatttctccttgatccggagctactgccctcttgaaggttcctagaggccatccagttttctgctgatcagaattagtctttttttctttgtcttatggggatggaatagattactgggcctagaactgccatagttgaataacaaaaagtaaaactgtgaggctgatgggacatttcccagcccatcatccttaaatttgcccttttcatgtttctgctttacttcttcatccagcagaaacgggcttagcatatttttcccatttaacatttttattgaatacttttcaaaatgaattatttccgcagttgatttcgaacacatttttttctgtcatttaatactttatatcactagaggaaagaaccatttaattctttcatacatttatgaattctaatcttcaaagagtgtgagttcttcaagtgatcaacttacatcaaatttacaagtataatttactaccaaaagaccttgaacgctttttggtgcacatgttttggcattccttattaacaaatgtaatgaggcaaaagcccacaagaatatgtattcctggttcctctttaaaaatgtaccatttgctcttattttctaattaaggctttgaaggttaaaaatccctttgttgttagctcctttacaagtctcctgcctgagtgcagaaaacataagaagggagtgtcctcttcagagcataaccaaaccaactaaattttaaccaggtaaattgttgattagcattggatcatgtaaagaaacagtatgaaagtaattgagataggcacaactcctaattgtgtgatcccagggggcttcaaacattgtttgaaacattcacctcagagattatattccatgtctgatccttatgctaatttgaatactaggatcctgaagaaaaactttataggatttcttgagtccctaattggtatgtaaacatcgtcattcccaagctgcccaaagttgtgaattatagtataccatgtgtctcctgttgtgatatcaatttctacagcaatttttctgcttgttgtaggcaaatgtaaatatatttccctcctcttacacaaatagtggcctttcacatacattattcttcaccctggcttttttctgctttagagtataccctagagatctttccataacagtccacagagagcttcctctttaaaaacaaaacaaaactgcatatcattgcactatgacgatgtaccataattgatttgacccttcccctactagtcacgtggagtgtgtccaatattttgccattaaagcaatgtgcactgaaaaacgttgtgttcatcagtttgtatggggcggatgtatctgtattaaaaatccccagaagtgggattgctgggccaaagggcaaatgcagtttctaattttgataaataaataacattgtctaaccagcctgtgtgagagcactgccccagagcctcatcaatagagagcattgtccaacttgtgcacctttgcctatctgatatctgaaaagcggcatctctgtgtagctttgcattctcttctgagtgacgttgagtgtctctgcatgtgttgaaggtctatttgcatttcttgtgcaatgtctgctcatatcctctgtttagaaaaacaaaaagaaggccgggcgcggtggctcacgcctgtaatcccagcactttgggaagccgaggcgggcggatcacgaggtcaggagaacgagaccatcctggctaacacggtgaaaccccgtctctactaaaaatacaaaaaaattagccgggcatggtggcgggcgcctgtagtcccagctactctagaggctgaggcaggagaatggcgtgaacccgcgaggcggagcttgcagtgagccgagatcgcgccactgcactccagcctgggccaaagtgcgagactcagtctcaaaaaaaaaaaaaaaaaaaagaaagaaagaaagaaagaaaatgccaggtctagtacaacgatgtttgatgggtttttttgacaatgataaaactactatttagtaagagaatcactcccggcagtagacttagaagcacactatcagagaccctcgagtaaagaccctaacgtgccacatcttaactctgtgaccttgggttgattccttaaacttcccaagtttcctcacctgtaaaattgaaatgatgtggacaactcacagggtttatagaataatcactaaatgaaggattatatatataaatgatatataaagcacttaacagagtattggttacatactaggcacttaaaaatgttaggttaacttctctttttttaggtacaaacttaaggtttcagagaaggctgggttttatggacatttctacctcttaccctctgaatgaatacacatccacccacacagaggcatgtaaatatacacatatgtacacacggtggaataatatctgaaatggctgtaatgattcaaaagcatctctttagacaaatgtgtgtgtgtgtgtgtgtgtgtatgcacgtgtgcatgtatatgtataaatatccctgtaatgtaagaaaactaatttgttgctaaaaatgtacccttttcggacaaattatcctaatatgctaaaacaacaccaaatagtattaaatggacatgatcacttatcactacctttcatattataatccaaaaaagcatatttttccttcatctatcttattctttacaacaattaaactcttttacaatgttacacaccttatacttacagctatacctagaaataaaattacacttatactcatgtttatgtatttctgtctttaaaacaaaaaaataaacacagcagtaaatacaaaaggtagaaatggaaaaaatgcattttagagggcatggtgctgagggctgagaatataacactggtctttaaaacaactctaccactgtgaatgagaccatttgggtgatcttgtttcccagggctgtgttgttacagaaacataattttaaaaattgtattttgaaataattacagatccataggaagttgcaaaaaaatgtactgggcagtctgcaccctttacccaccccttaccccatccctaacccccagaaaccagtaatcatctgttctccatctctataattgtgctacttcaagaatataaacgtaatcatacagtatgcaattgtttgagattgacattttttcccgctcacttaattttctagaggtttatccaagttgttgcatgtatcagtcgttttttcctttttattgctgagtaatgttccttggtgtggatatatgacagtttaatcatcaacttgtttaaggactttggagctattacaaacaaagttgctatgagcatttgtgtgtaggattttgtatgactgtaagtttgcatttctctgggataaatgcccaggagtgcaattgctgggtcatatggcaagtacacattcagttttgtaagaaactgccaaagcgtattgcagagtggctgaatcattttacatccccaccagaaatgtatcagtgacccagctttctctgcatcctccccagcatttggtgttgtccctgttttcattttagccattctggtaggtgtgtagtggtgtctcatttgtattggttttcaaaaagtgcagaagatacttcataatccagtttgggtgtgttcaatacctcccaggtaaaattctcacacataatatgggcctatcttggtacatgactgaattgtcaaaaatatctatgattgctgccttttttgttgaaccttaactgaaatattgagagcaaaaaagaaactgtgttgtgcaaaatatatccgaacattagactgggcttcaatttatactctgagacactcagagaattgttacttgctcaagacatggcagatgcacgccccaacacctaacttcactttaggaatagacacattaggtatcaggaaaaattgctaagactatttaaattcctctccccttttccaacatattccattgcctttgcatttgcataaattaaataggggcatgatctgtcttcattgtcaatatacatgtagatgtgtgtaaatctacaaacatacatatacacagacatacatacactggctctgtgggcgtcaatcccaaatgttccccaacatccagtctagattctcccgggtcaggatttctcaactttggcactattgacatttggggtttcataattatttgtggggctgtcctgtgcactgtaggatgtttagctgtatccctggccttaagcaactggatgccagtaacactcccatgcccccaaagtgtgacaaccaaaaatgtctcagcacattgcaaaatgtctactgggggcaaaataaacctccctttgagaatcactggggtagacagaagagaaggagaatctcaggcttcaggttacctcactgggtttgctgaaacttgataagaatctccttaccagcggggatcaggttttggtgcccacctgttcatttctgataactaccaatctctaaatctgtttctgcaagttatggctgaagattagtggttaacagagaacgatatcagcctttgtttcttaaagagcttatattcaatgctttaaaatacaaattggatctggcactgttgtggttcacacctgtaactccagcactttgggaggccaaggtgggaggattgcttgagccagggagtttgagaccagcctgggcaatatactgagaccccatctctacaaaacaaataaaaaattagccaggcctggtggtgcaaacctgtagtcccagctacttgggaggctgagtcgggaggatcgcttgagtctgggaggtcagttctgcagtgagctaagatggcaccactgcactcgcctgggaccttgtctcaaaaaacaaaacaaaacaaaataaaataaaacacaaattgaacacacataattgaaaagcaaacttcatgcatacctggttttgttttacttttaatgatgttttatcacttatattagatatcatgattattttaacagatacaaaatttaataggtaataaaatacctcataaaatagggtatatctccatatgcatagagaattttatagagaaattggcacaattcctggatcttcctctgattcaatgtgtttatctttgaattctaataggttttaaaagacatttaaagaattgcaaaacaggcaaaggaaaatatgatagtgttttataatttaaattatgtctacatggcaacaataattattatataaattatagaaaatgttatgtattttttaactttataaatttacccctacttgataaataatatattttgtatttattacatttggtatataaatatatttctactttagaattaaaataaggtgaaaatagttattttttgaaatactgttaagttgcatattcttacctgtattagaattaaaatatgtatcttatatttatatataaattacaaattacctgaaaaaagaataaattataaccgcatgtaaaaataaaatattcctgtatcagttgtgcaatttaaattccggttttagttttcattctttaagttgttacatttggaagatttggatagtagttatcatgaactcactgttatctatggctctgacagtaaaatacgccattgagttgtactgtaatatgaatctcccgggaacgctaagccaattcagaatgaggcattcctgtctcaggaatagagatttataaagtgaccggaggtatcactatttctagaggaaggtgcaccttgaagtattctcattcttttctatgcatttatgatcccagcctactaaactcaagcaacacttcaatacagcaaagcctcttggaagtatatgagtttaataagaaaatttatgaagaaagaatacactgaaatgcagactgacccccaaaataataggatactttttaaaaaatgtattagtttcatagcatggcaaataatactcaaaaatactttgaaaatgcacattttaaaaatgcccaaagggtttagtagattatgttgagagaaggcattggaggaagaaacattatagccataagaaccaggaaaatgatcctcctttgtttataggattacaaagaggaattttaacttctaaagtgaaaatacaaattacttgtgtaggctaaaatcacccttcttagaggaaatggtacaaattttcttcatatagtttatgttcctccagaaagtctctgtgaagtgataacattataactgcatgcattctcctggtgacttcatttaaagtctgtgatgtagtaacatcatgcacacttccctttcctacagagcccttatgttctctatagaccaagaggttaattaatttttagagttatatagcaaagagttgccagaaccccaaataacatatctctaatttccaaaattgcctgacaaactatattttaaagaagccatgttattcttaggataaacctaataatgtcactttaatccccagtcatgctcatctttgcctttcttccaatatgtgcaaggaatatataaggtgaccttttaaggttacagtatcttcttacaaattagagttgatgcactgaggttataacagcagctgagcattctcaaaagctgcagattgagccgacaggcagattagcaagtacataaaatgttagtagagaaaaaaaatagacttcaattttttggcaatcctgttaaacaactctgtgaataagtctttgaaacttgtacagtggaaggtttgaattttcctcaatgcctggcacaaaacttacctatctgttgcatatgtgcattgctgaattaattaatggaaagtaaaattttaaaatgtaaccttggttatttgggataaaatggcacttccatgtaatggaatgtcataactgaaattgtagggattttcagatactctagctggcactaaatctcatcagagcccttcaagttataacataagatagcatattcaatatgagaaaatatttaattgtcagccttaaaaatgtatatagcagaggcaatcccttttttttctgacaacaaagccttctaaaagcttttcaaactatacagctttgagatttataactttgaaccaagaaaacataatttcaagaaatgaagagaacttctgattaattctagtctaaggcagtgaagtcctgctagattttaaagtattatattcttcataattaatgtcaagataggttcctccctgtggctcattattttcttgtaaaaagtacatactgcctgtgtttttaaatttcaggttttctcatgccgctcttgtctaatgatccagcaagttcaggcatataatacttttgaagaatctatatttaaagactaattatttatgcatgtgtgtctatgtattttgaaatatatatatttcaaaagactgtttttagcctttggctcaaatattttttttttaaggaatataatattgaatatctggacaggttaaaaatctccaacatttaactataaatgttaactaatgctttccttttcatttgttaaattgctgcataaatgctttaaaaagtatgttaccgttggcattaagacatcatctcttttacttaccaaagtgcaccaatctttgggattgaaccattgtagctgctttaagccaaaaattctccccagccgggttccttatcatcacccttgccacagaatctatatcgttgggagttaaagatctttggtctcaaaccttatcctggttgaattcctgtcatatcaccagcaacccctttctaatggcccccaggaatgctagcacaacaggggatcttcaggaggctcattccaatgagagacatcatttgcagtgacaaagtttgtccttagatgaaatctgtatctctctctccctatagcttttacccctgtttggccccctctctacaacacagaacacgtgcagttactctgttctctgacagctcttcaaagacaaagctaacatggccttctgggggcattttttccaggttaaatatgcccagatgtgcttgatttggactctatcctttaggatcaagccatgttagtaagtacaaatgtccaacatttaaaagaactgttcataagagagactcaccagattagaggaaagagataccattcagtttctaatacacagtgaccttaatgccactattttaagctctctctgcctggattgtagagactttgcctagtttacctctggaatagaaattctgaacctttgctagtgagtgagcaataacaatgatgacagacatctagctagatactaagaaaaaaagtcatgaatgaccaaagtgtgaattttgtttctttgcttgtctgataccccatggctatttgcaatatcttattgtcatgtgctaaaggatttaggatattaatcaaagagaaaagcggttctaagatggaagaaaagacaaaaatgtgggcagataagtaggaaaagaaggggatgaggattcaggagctttttccaggtacttggaaagttgaaggcaacttaaatcatttttaataatttaagaaatatcatttttcatttttatataaaatactaaaagtctggaaaatatataggcaggcacagtgtgttggcaatatgctgtttacaggttggcaaaacaagccagtgtctaatgaaaaggaaggttgcgaagagcttagatctgaaactgagaggcatgtcttgttccacaccttgagaaacacttggcatataccaggtgctctgtaaatatttgcttagtaaatgatagaatgagcatgtggtggcagaatgatgccttacatggcattacccagactcataggcatccctagggactgtaagaaaagtttgtgggcttttttcagcgttttgaaaaacccagaagatattgtataattactttttcaatgattgttttatcaaatacttctaaacctgaggatttatgaagttaaaagtgaaaaggttttttaaaaaatgttatgccaaatgagagaagccagtcacaaagggccacatattgtatgatctttttatattaaatgtccagaagaggcaaattcatagatccagaaagtagattcgtggttgccgggggataggggaggggagaatgcggagtgagtgctaatgggtatggggtttcttttgggagtgatgaaaatgctctggaattaagtagtggtgatggttgcaaaactctgaatatactaaaacccactgaattatacacttgaaatggatgtttgtaatgtgtgaattgtatctcaataaagctgtttttaagaatgataagcatagcatccaagcatttaaaaatttttttaaaagtggtcattggtggtaaaaaaaaaaaaaaaaaagtcagaaactatttgcttaattgttacagagattttatcccagattaaaatactccaattccgcactttgggaggctgaggcgggtggatcacgaggttaggagatcgagaccatcctggctaacatggtgaaaccccgtctgtactaaaaatacaaaaaattagccgggcatggtggcgggcacttgtagtcccagctactcgggaggctgaggcaggagaatgggcgtgaacccgggaggcggagcttgcagtgagtcgagattgcgccactgtactccagcctgggcgacagagcgagactctgtctcaaaaaaaaaaaaacaaaaacaaaaacaaaaacaaaaactccaattccatttcgccaaagggaacaagcagaatattcccacaaccctagggaacaggggtaggcttggctattagtcattctccttcttccccattcccaataattggaaaaaaaaatgtgtgtgcacacgtacgtgtgtgtgtatgtatatgtctgtgtgcatatgtgacaagggcagtagtcagagcaggatcatgtgactaccaggatctatggacagccccacactattaggggagaaagtgtcaagctatttgtacggttcttatagagcatgaatctaggccaggggtcagcacccttgttcataaaggaccagacagtaaatattttgggttttgtggccatgcagtctctgtccaaacccctcagctcgacatagactatataaagcaattggaggtaactgtgttccaaaaaaactttatttatagacactgaaatttgaatttcacataattttcacaagtcacaaaataatatttaaacaatttttttttcaaccacttaaaaatgtaagaaccattcttagcttgtgggccacacaaaaacaggcagaggcctggatttggtacataggcggcctgtggtctatagtttgcagaaccctgctctagggtaatgactgagaaagggactctactaatcagcaggttgttgggaagcacgttacttaccttaagccagtataaaacttaaagcaataatgctacattatgtctaaaggctaagctagtgagaggctaaattataacactcaacttttttagcaaataattatgaagcatcagctaataagaccttttcttaagagtattcagagtataataatgctaccttgtgtggtttggggatttttattttaagttagggaagctatgaatctcttgaactttgtccattaagaagtctgccaaagctgtgaattttaaagccatgggaatttttcattgcgcttggctgctgaattttaacagcaaagttattcattaagtccacatttaaaaaaaaaagtatcaacaatgcttctttatactttatctgcatttgacacacttccagatagatgatctttaatttgactaatgagtgcatcctttgttattttaatgacaagtaatttacagaaagagaaaagcttttcaacacgcaagtctcttaaatctggaatttaaagtccctgatgttcagaagcaggaagcaacagttggtgtaagacagggccactaggacactggaaatgcatcctgggtaatgagtgggaaatacaaaaggaagaaaacagttggaaatatgttggccattttatatgacactttctgggtttattttcaggttggagcacaagtcagaagctgaagaacttggagattttggggagcatatgtcccaccttccccaacccccaagtatccaaatatcccctttggttctatcagagaagtattaagatttattaattagaagaaaaattaaagttataaatgttcaataggaacataaggagaattcaaaaaaataaaatgttgagctcaccacagttttcagcagaaattttactcttttttttttctttgttgagatggggtctcactatgttgctcaggctggcctcgaactcctgggctcaagcgatcttcccacctcagccacccaaaatgctgagactacaagcatgccactgtgcccagctaaattttactctttaactgatttttcaatgcataaataaatgaataagtgggtaagtacttactgaggacacagttttcaaccaaaccctgtagatactcaggatgaattaagcatgggccctgccttcatggggcctagggtttactcaactttacagaaaacccagaaatatcctaacaaatgtggcaactgaagaactttattcctaatcctaaaactcactttctttattctcagagcaatggatacagcattctaatgtcaaatcattgtttccatgttacacaatactctaactgtcaaggctaaaccctgtcttaaggaagggtgacaatggctttgttcttatgataatagaagagataaaaagattatttacaaagctacagcctctgaaaaattggaagtattttatacaaacaaccacctcaattcttctcacagtgatatttaagtgtttgtgcgtgctggtttctgttatgtgggtctttaccattttcattcctccttgcagctctatgagttaagtattactattattcttttacaaatgaggagcatgaggcctggaaaaatttaaaaacatgcagaggtgataaaatactgggaaagtttcacattcaaccatgtctgatgcttaatccttttccttctctttccaccatagcatatgatcatggcatatcatcactgtttctgtttcccctatagaaaattcaggaaaattaacacatggaagagtattcagactttcacttttcttcttacataatctttgagcagcccattataggaaaataagggcattggagatttgaagaggcagaatgaacacgttctagatgtagaaagaaaagttctaagcaggtaaaagacaaccagagtgaaatacaccagatggatgcttgacttggagaagatgctaagcactaaataagccaggtggtagagggtgtgaaagcggagagccctgagaaattgatcattaagcggaaggtgattaaaatcttcctaagggacagttggtcagagcagaggtcaagagctaggacttgtctggcaagacttattgtggattcttgaagggttaagaagtcagtcagagacccgggattggatactgtatttgaactgattgtcactcaccagaatctgtgatctaggagacagacattgccaggatcccccccgtcaggatggtcatagagaagggaaggtgtgttcatttactattgctgcatagcaaattagcacaaatgtacagattaaaccaacaccccatttattagctcgtggctctgtaggttgcaagtctgggtggcccagctgtgttctctgctcagggtctcacaagactgaaatcgagctgttggccagacgaagctcttatctggaggccctagggaagaatttgctgccaagctcgctctggttgttggcagaatttactctctggcagctgtaagactgaactccttgatagctataagctgtggtccactctttctaagggacatctgcattccttcttaagtggccatctccaacctcaaagcaacagcacattgagtccttcacacacatagaatctctctaaattcctctttcatcagtcaggaaacgttctcagcagttaagggttcatgtgattaggtcaggcccacctgcatcatctccctttctaacatcaactgtgctctgtaacacaacacaatccaaggagtgatgtcacattcacaagttccagggcttcaggtggacatctttgggctgccattttagaaagtctgcctaccacagaaggtgatgaagaatctcagctcctgccttgctccttggtgagctgtgtgacctgtaataacagcagctttgtggaaaattggcccaccctttcctagggttaaagggccaaagcgaagttttgtgactttttcttcctcttctgacactggcttcttcctctaaggaaatctgctgcttttggtgttctcttctttccttcaccatctcctggtgttggtgccaagaagcactggaaggcaggtggtccatcaatttagggcaactgaaggttttgagatcaaggcatactggaggcccagacatcacaagagggcagcacagagcaagagctgataaatgttgagatgcagacttagcaggccctagctctttctgagatgatgtgttcatctgccctcaaaacatcctctcactcaacatgtgcctcctaacccagaccccaaggagtctttagtaagaacatggcagatatcacatgtgctgaccatggggttatcacaaaacattaactctccaaaaatctgctgcttggaaccttggtttctgcaactaagaaatgagttaaaaatgtattcaaggttgataaatttaaaatggaaaaaatcatcttctgaactctagcaatatgaaggccactttttacaagtctgatgctgtagtgcagtgtttacaacctattttcattttcaaccccctgtcacaaggagcctgttgaaacattttttgctaattgctccttgcatgaaattttaataccacaaatatagtataaatctatttatgtatatctgtgctttgtgcataaaaagagtaaggttttttgtttgtttgtttgtttgtttgccactgagaactagttttctcgctcttgggggcaatattgcccctattgacagtgcatgttataatggggaaaaattgctaacattttaatatttagtaaatcttcagcttatatagtctatttgatttggaaggtggctgtaatactttagttgtactaaaaggtacttgaaattaatcttgaaaagtcagaagaatctttacacatgaaaaatcacccaatatattatatttaaaataacaacttgcaaaacaaaacgtaaagtctgatcccatttttgtggctaagaggtacagaaaatgactagaaagatcaacctgtggaatgttgcttctttgcggttagatccttctataggtgttttgctctttgggaatgttataaatattcaccaatatacattatacatatgtataataaatacatattatattcatgtcaagaagaatactatttaaaaagttagccattctctctctctctctttttttttgccttcaacatttaggattaatgggcagtataaattcaatcattcacatgtagcaaaaggagaaatatttcacatggcccattcatgactcctttagatctctagagggcttcaagcctcaaagtttattgttgcattcttcttaattctggttgaatgcatgtacattattttctgcaaagaaataccacccactaaagactgttccttctcttctaacagggttttggtgtccccagggctcccttagtcctatttactttggatatttcaggagttactgtaggtttaactgtggtgagtccttaagccctctttttaaattcataaactgtctctaatcttagcaaaatgtcaggttacacttttgagaggtttgggaacttgacattttgtagcccagttggggtgtaggctgcttctattctgagcaccttgttccaatttatgtcaggaggaattatatacaggtcagggctgggagcaggttataattaatggggtggacaagtggatttttaatgtttcataaaataaaatggaaatcacatgttcttggaactgttgtatgttttaaaatatttacatttattctagtaaacattaattataactgatatatttctcctatgaactcgctaactgtgaggtcacaagccattgttcactgagtagaaagaatgggtgacaagctagttacaagaaaaaagacagtacttgggcgggtatcggtgagtgaactcgtggaagtaatccagtcttaggtctttctcctaattttctcttatgtttaaagcacccccttgccaatatgatccagatgtcagtccttctaagacagaactgggagggtttagcctgtgaaatttctgaatagctcctggtgaagaaggaacacatgaccaatgtttaactatttgtcttttcaaaattaaagtttagaagtagttgaaatactgccagaatctacagcgtccacgttttattcatattagtttatcaaaaatttccaattccttgaagctgtagcagcaatatgttgctgaggaaagaaattttttttaaaaaaaatttgtacttataattgacacctaataattgtacatatttatggggtacaatgtgatgtttcagtacatggatacacagtataattatcagattggggtaattaccacatccatcattttaagcatttattatttctttgtggtgacaacagtcaaaatattctcttctagctgtcttgaatatatattacattgttatttgctgtagtcaccctactgtgtgatagcacatcaaaacttactcttcttgtctaactttgtgtacctattgaccaatctctacccgttcctcccttcccccataccctcagcagcctctgggaaccactgttctactctctactgctatgaaattgacttctttagattccacatatgagtgagatcatgtggtatttatcttttttaatgtttttaaattttattttattttatttataatttgaatttttattttagattcaaggggtaaatgtgcaggtttgttccatgtagtaattgtcttctgtgcctgacttattccacctaacataatgtcctccaggctcatccatgttgccaaaaatgacaggatttcatcctttttatggctgaatagtattccattgtcctaatcatccccataaagaaatatattttctttatccttttgtctgtagatgggcacttaggctgattccatatcttgactattgtgaagagtgctgcaataaacatgaatatgcgggtgtgtcttcgacatagtaatttcacttccagaaagagatctttaagagtcagaaaaacccagattctaaactggtctctgccatgtgccagttgtgtggccctggagaagatgctttaactctgtgtctcagtttcctcatctgcagaagggggaaaatgatacccactatttagggattgggtagggattagacccaatttgtataaagtgcctggcatattgtaggtatttttttaaatgccagttatggatatatgaaggaaagctccaaaaaatgaaattcaaaggaagccttatgtaaattgcatcacatgtcaaccatttgggtgttaggaatattgatgcattctttattttgcctagaattcatcactccctaaataaatattatttccattaagtcaccaaattttatatatattctttgtcttgtatggtgaagaattaatacaagtgcgctactctattagggtataacagttacctaagtaatgtatcatgagacctttttgcccttttctaaggaaaataagtatttattggaaggacaacttcacacacagtcagcaggtaataatccgcagtacttcccaatgctgcttctatgggctggaagagtgtttggtggttctatatggcacagggctacttgtccatacccttgacccaaggatgtcacgtgcacccaatcaacctggaaatcactgtggtgacagaagttggggcccaatcaccctcagggccttgacactgattttgagtataccagtttggaaagtctctgcagaattccccaagacattaagtttataatatcccttgaggggtccttagaaagaaaaagtgcctatgttttggtgtcattatcgttcttcagggcaaggcttggtgaaaagatactgagagaagacagtacagatagaaggacaaagcgaacaaaaataaggacccactgattttatctttgcaagctctaaactgagttacagattgagatctaaaatatatactcaatacatgcatcctcaaaatgttcttcacacatttgtgcccaagacatagtagttgataatattaatacataaatatatatacacacagatatatatgccttacaatacagtcctatttttagtgtgtaacaactgtactattttcaaaatagtcatcggcacaaacaccagtaccacggctaaatctgacattattgatcttttctccctctaagaatatcttttgtaggcccataagtgagagatggcagatctcctgagcttcattcagtcctttatggaaatatttatgaaaaccctactgtgtgctcagtagctatcagagttcttggcatataaaagatttcaaaataaatttgcctagtattgctttgggggatgaggacttggtgatatcttcctctccccaaaagaaaaagtggtgtgtgtgtgtgtgtgtgtgtgtgtgtgtgtgtgtgtgtgtcagagggacagagacagaggtagagagacagagtgtgagagtgtgtgggtattcagagagagaacatgagtcccagtcttatccttatcttccctcatacaatgcaagctatttggaattgtagagctggaagtgatcttagctaacattttcccaatctcctacccaatacaggagcgtcttctacaataaccttcatcaaagggtggaacgctaaaatgtaagactagaggtctctttttgttgggcaataatttgattcaattatggtgtcattatttggtaactcaggtggcacagtataaatttctgtgggaaattggaatggggagcccaagctggactggacatgactgcaccatggaaggaggacatttgggaccagtcttgagctgccattgtgttccactgggaaactaaacactagtgctttctcaattagtttatatatttctcaaagtattccatagtctttagtttgtgctaacaaaattgatcggaagtactatattaaaattatcattcattttttactcttactgaacagcagtgagaaaagcaggaatctttgtcattttgtttagcatgtaaatgcacaaaaacctcagcttacctgaactttgctaaaatgtcaaacctttattaaccacaagttttctacattatacttttcctaaagatttgtgaaatacaaggaagaaggtgatattatgaattactgtaaaaatccatggtcatggatacaattatacattcaagtcaatctcctacgtcatctctatttatgatcaaatgaaaaaaggtctttttaatgatgatctcaaggaaaaataagatttgaaattacctcaaacttttcaattagatccaatatgtgatttgtagttatgcaagtaaagtggactcaagcattgtagaaatgtttcaattaggattttttttaagttaattgagatttgatcatatttttattgtcatctttgttcccacatggaaattaattccatttcagacttatttcttggagggtgtttagcatagttatcaccttaaatgagtagggtagggtgcgtagggtggcttttcatttttggaatttaattattactctctctatatatatacatgtatatatatatgaaaaagaaagagcttgccttggcagaagtgtttaaagaaacatgagtagttaatgccctcactgtgatttgacttccatcttcctttttttaagcacatttttcattttttccccctttaaacctgccatttagagctgaaaagtatttttcaagaaatggagcaatgctttctatcccatttattaaagtaatgcacagaaggaaatgcaccgtggtaaaaacaatttatacgagaaatgataatgttttgctaaagataaccaggaagtgaggaggagaaaaaaacccctcaaatagcagagagaggccagatggtctttttttttttttttttttttttttttttaacgcagtccctaagcaggaaattttgtttgattaagaagacactggtcttgattttcattcagcagttttgaggaactttttttaatggacacacacacatatacacacacacacacacacacacaccacaagccattttcattcagccaaattatcatttgtgctattgtaagcaagattctgctgatgaaaatgtgaagtcttaatgataaagaagaaaacgagttcccaagtctcagttatgaaagaacttggaatttacccactaccctaaagacgctcgatcattaccatatccatcatattgttgtaaggtctggtgttttgttttgttttcttttgatagcctggaatggaagaaagactgtgtaccacagtggctaactagggttttgtgagatacagggtagacccgggggaaaaaatagaggttttggagttcaacaccccagggggctaatgtgcataaagcgactgctccaaaggacctgagtttaatccttggagctgccagtcaggatcaggatgaagaagcacccatgcaaagaattgcttctggatgctgataggcagggaggtgaagggggggaggtgggaagggggaacggagcacccctctttggactgtgatgttttggcagtcggtgcttggaggagggtagctggcagtggctccggcacaataaagctcccttcggtgaagtcaccagcatccttgccatggtctggcaccctttgcccagcacccctggagtgtgcaatttcccagtctgtattctaaggatgaaaatgactaaagttgtgaaactaactatttgcatctgtttcaaagagaaagagtcacttggaatttggaatggaaagaatagatttagacaactggcagaattgttcggaactatgccctgaatcaagagaccctgttgacttatataaggacaagctaaaggagctacgtaaaagagagaaccaacatatctttaccatgaagatgacaaatcaggcattcaaatttgttttttcaaaaatgaaatgtgttctcatatagttgtgtgatactttctctaatcagtattcatatttatagtcaaaataagtataacttcactttaatatagcttagccaccttgaaagctcactgttcttaaagctagatttttttgtaagtgaatttttaagccctagattgcatcttaagtactgagttattttaattttgcctttttttttaatgtttaaaagccagcttcttgtctaatttgattcaatggataaaatgtacaggatgaaactcacacttaaaatgcatttcaatgagaattaaattgtttaaaatgaaacttttttcctttaaattttaaataaacaaataagatgcaaagcaaaataacaacaaaaaactcttaagtcaactcccttggggataagggataaccttagggataaggtcataccttttgatattaactccaaactcatgccttgtattcgtgttttacaaattacatttataatttatctcaaagataacaaggaagcatactttgataatacaagaagaatctctcagactttagcctgccttgagaatatgttttaaaagccattagaagcttcctagcgtttatgggatttgttcttatatagagtacatttttttttacatatattttgggcagaattctcaagtctccaaataaacagtttaaatcttggcttttaggccaaaaagtctttgggctgggaataactcaccctcagaagactacttgctttataacccctcccctggaatgctgcgaccctgtcttcccacaaaccttatttgcttcactgtggaagagtggcacagggcacccaccacccagacttcccaagctcttctcttggtctctgctatagctacaatagcaactttattctcctacaactgagagaagagagacagaccctctcatattgttgtatattgttttatactcagaaaaggaaagagaagcaaaactaaaggcaggtagcccggcgcctaagaaccagacgcgaaaccaaggaaccagacctgaaaccaggcctgggcctgcctgacctaagcctggtagttaaaattccacccctgacctagcaactgatgttatctatagattatagaaagacattgtaaaacttcccggtctgttctgtttcactctaaccaccagtgcatgcagcccctgtcacgtaccccctgcttgctcaatcgatcacaaccctcttacgtggaccccccttagagttgtgagcccttaaaagggacaggaattgctcactcggggagctcggctcttgagacaggagtcttgctgatgcctctggccaaataaacccctttcttctttatctcggtgtctgaggagttttgtctgcggcttgtcttgctacatttcttggttccctgaccaggaagcgaggtgattaacagacggttgaggcagctccttaggtggctttagcctgccctgtggaacatccctgcgggggactccaaccagccggagcgacgcggatcctgagagcgctcccgggtaggcatttgcccaggtgggacgcctcgccagagccgtgtgtggcaggcccccgtggaggatcaacgcagtggctgaacactgggaaggaactggcacttggagtccagacatctaaaacttggtaagactagtctttggaacttgcccactccatttgtgtggaagcgtggtctgatcacccacggcatgcctttatcggcactttggttttggttttgacttggtttgaattgcttgacggaactggtcttgggaacttgcccgctccatttgagtggaagcgtggcctgatcacccacagcgtgcctttatcagcactttggtgttggttttggttttgacttggtttgaattgcttcacaggactggtcttgggaacttgcctactccatttgagtaggaacttgcctactccatttgagtggaagcatggcctgatcacccacggtgtggcagtaccggcactttggtttttgtttttgacttgacttggattgcttgatacttggattgcctggattgcttagttttggttttgacctggcttagatttctggatactctaattttggttttgattctggtttggtgtaaactgcaaaagtgtgtgtgtgccctttttacctgttctttgttttgtggtgtgcgtgtggtgtgagcatggtgttttgtctcaaagaagcatgggtcaggcacaaataagcccaccctactaggaactatgttgaaaaatttcaagaaaggatttaaggaagactatggagtactatgacaccaggagaacttaaaactttgtgtgaaatagactggccagcattagaggtggcttggccatcagaaggaagcctagacaagtcccttgtttcaaaggtatggcacaaggtagcctgtaagccaaggcacccagaccagtttccgtacagagacagttacagctggttttagatccccttccccccacagtagttaagagaacagcagcataagcggctggcagaggcaaggaaagaccagcagacagaaagagagaggcagaaagagaggaagaaacagaggcaaaaggaaagtcagagagagacagagagacagaaagtcaaagagagaaagaaaaagagaaagagagaaatatacaagtagttaaaaaaaaaaacaacagtataccctattcctttaaaagccaaggtaaattaaaaacctgtaattaataattaaaggtattctcagtaaccctgtaacactctaatactactttgttgtcagtgtaaacaagggcatatcccaagagcactgaggccttcctatcaaaaatccttaacccagtaacccgcgaatggcccagatgcattcaatctgtagcggcagctgctttgctaacgggaaaaaaaaaattatgcaaaaaatgttgtataatttaaaagtactcagtactattgaagaaacagtttatgttcaaggtgtataagaaaagtaaaatatacctttggtaaaaggattataaggaggcataagaatgtggatttttacctacattaaaaggttaaaaaaattattgttttgaaagtttaagcgagttttgagacgttaattgtaaagaaaattctgtgtgtaaacatattagctaaagttaaaaaggtatcatccagtttttctgtgaactggacattaaaataaaaatgcaacaggtttttcttaaagcaccaacctgctctttaacaaaaattatgaaaggttaaaaagagtatataaaatcttgcttatggtcaaacattaaaaattagataaatatgtctacaaggttttattaaaattaagtttaacatcaataacactaatataaaggtaaaatttggcttatctagtataaaaatcatacagaaagcattgttaaatgtaaaatggtatttggctttctttggtctaaaaactaataaaaataggtgctaaaggaaacattcattttactagaagatcataaaagttaaaaacttaaaacaaactttggcaattaagacagcataccaagatgcaaatgcctggttggaatggatcaaatattccatgtgcacgttaaacaaaagcaattgttatgcttgtgcacatggcaggccagaggccctgattgtcccccttccactaaggtggtcctccagtcgacaaggcatggactgtgtggtagttcttttccaggattctacagcctggagtaataagtcatgccaagctctctctgctatatcccaaagtccggcaccctgcgggtcagcccccgagggctgtccagcctccgtctcccaacactaagttcacttcgtgtctctcacgacagggaggaaacttagcattccttggagacctgaagggatgcgatgagcttaagaattttcaagagcttatcaatcagtcagcccttgttcatcctcacgcggatgtgtggtggtattgtggtggacctttactgggcactctgccgaataactggagtggcacttatactttagtccaattggctatccctttcaccctggcatttcatcaaccagcaggagaaaaaataagacattgtaaagcgagagaagccccttgtaggtctttcaactctcatgtccatttagacgcaattggagtcccatgaggaataccagatcaatgtaaagcttgaaatcaaatagttacaggatttgagtcaatattttggtagatgacagttaataaaaatgtagattagtaaactacatctattacaaccaacagcagcaagcttttcatgagttaaaagaaaaactcacgtcagccccagccctggggctacctgacctaacaaaaccctttacaccctatgtgtcagaaaaagaaaaacatggcagttagagttttaacccagactgtaaggccctggccaaggccagtggcctatctctcaaaacaactagacggggtttccaaaggctggcctgcatgtctaagggccctagcagcaacagccctgttagcacaagaagcagataagctaactcttaggcaaaacctaaacataaagtccccccatgctgtggtgactttaataaataccaaaggacatcattagctaatgaatgctagactaactagataccaaagcttgctctgtgaaaatccccacataacaattgaagtttgcaacactctaaaccccgccaccttactcctggtatcagagagcccagttaaacataactgtgtagaggtattagactcagtttattctagtgggcccaacctccaagaccatccttaaacatcagtagaccgagagctgtacgtggatgggagcagcttcgccaacccttgcaaagtgactctgaagaagacgacaagccctgcttcagtcacacccagaagctaactggtccatgcacggccgaaacatgaggaaactcatcgcaggactcattttccttaaaatttggacttgtacagtaaggacttcaactgaccttcctcagactgagggctgttcccagtatatacatcaagtcactgaagtgggacaaaaggttgctacagtcctattattttacagttattataagtgtactggaactctaaaaaaacttgtttgtataatgttactctatacaaggtatgtagcccgggaaatgaccaacctgatgtgtgttatgacccatctgagcctcccatgaccatagtttttaaaataagattaaggactgaagactggtggaggctcataaacgatacaagtaaagtgttagccaaaacaaaacaaaacaaaaaaagaagtgcccaaacaagtcaccttgaaattcgatgcctgtgctgtcattaataataataggttaaaaataggatgtggttctcttaattaagaaagaggctatatggcagaaaataagtacatttatcataaattaagactgtgtaaaaataaatgtggatactggtcttgtgtcatttaggctacttggataaaaaaaaaaaatcctgtccaccttcagcaagggaaaagtggcccttcctgtaccagtggtcagtgtaaccccttagaactagtaataaccaacccccttaatcctcactagaaaaaagaggaacgtgtaaccctaaaaattgatggagctggactggatcttcaagtaaatgtcgtggtttgaggaaaagtttataaacgctctcctgagccagtatttcaaaccttctatgatgaactgaatgtgtcagtaccagaaattccaggaaaaacaggaaatttgtttttgcaattagccgagcatatagcccagtctctcagtgtcacttcgtgttatgtatcagcacaagtgtaaatatgtgaatcattatcaatctattgcacaggaagacataagtagcaaaaataagagtgagaactcccactaataaaaagtgagagtctcaaaggggggaaatgagagaagagagacagaccctctcatattgttttatattgttttatactcagaaaaggaaagagaagcaaaactaaaggcaggtagcccggcgcctagcaaccagacgtgaaaccaaggaaccagacctgaaaccgggcctgggcctgcctgacccaagcctggtagttaaaattccacccctgacctagcaactgatgttatctatagattataggaagacattgtaaaacttcccagtctgttctgtttcactctaaccaccggtgcatgaagcccctgtcatgtaccccctgcttgctcaattgatcatgaccctctcacgtggacccccccaccttagagttatgagcctttaaaagggacaggaattgctcattcagggagctcggctcttgagacaggagtcttgccgatgcccccagccgaataaaccccttccgtctttaacttggtgtctgaggagttttgtctgcggctcgtcctgctacccaattttctctgcgattattttccttctaaccctttcttaaagtgatgggctctaaaaaatcatgattcagctgctattgcaattttacctagccagtgaatttatttattttgagatgctttttgatattattgtcattgtcaaatgacattatgacatttcaaaagacattggctgtcagccagtgggatctagtcttaactcatctttggtgctcaccggtcataaagctgtagtcacatgtgtttatttcccccagcactcttccctcatttccttcctttccttcctgaaatttcctcttccagtggtgcaaaagctggtgagtaagtactgacaaaaccaatgcctcttccaatgtctctattcatttccttcctgtccatccctataagcttaactgtacatccatggttattttcaactttgagttaacatcgtagaatcaaacacttaagatattcaggtaattctgaataccatatgctatggtttgaatgtgtctcccaaaattcgtttgttggaaacttaatccccaatgcagcagtactgggatgtggggcttaatggtaaagcccttacgaatggattaatgccgctattaaaagggtttgtggaagtgggttcttcctctcctgctcttttgccatgtgaggacatagcattcctcccttccagaggacacaggcttcaaggtgccattttggaaacagagataccaggcccctaacctgctctctgttcttcttttttttttttttagatggagtctcagtctgtcgcccaggctggagtgcagtggtgtgatctctgctcaccgcaacctctgccgcccgggttcaagcaattctcctgcctcagcctcccgagtagctgggattacaggcgtctgccaccgtgcccagctaatttttgtatttttagtagagacggggtttcaccatcttggccaggctggtcttgaactcctaatgtcgtgatccacccgcctcagcctcccaaagttctgggtttacaggcgtgagccaccgtacctggcctaaatcgctgttctttataaattacttagtctcaagaattctgttatagcagcacaaaatggactaaaacatcatggttcctgcttttttggctcactaagtgttcgtggcttttctctttcaaaattttattgctaaaataaataaagatgtcactactttacaataattcatcacattccatttttttgtaagaaatagtaaaagttggatttctatgcccttgaaaaagaactctatccttgaggcaatctgaaactaagcatttaacaacttgaaaaattagatcacaaccctctgaccaaacaccagaaagttttatactgaaattcagatactctttgcttgtttattggcagggaaaaagccaaaatatcaagaaagccagcacaaatatgagtagtaatatccccttagctaacatagatttgcaccacccatctaccttctatcatgtcatcctttttatttctttcattttatgtatgagtctttgaaatgtttgtgtttttaaaaaccttttatttttttatttccttcattaaaatgtaagctctccaagggcaggcctttatgctcatatttaccaccaatttgctgctgcctagagcagctcctggcacacagaatgacctcaaaaaataccagtggaatgaaagagtaatgaaagaaatgactcatctggttttactccaaaagaagtagttctaattttttttaatgcttaaagaaagccaaatggatatacatataggatttccagtgtcataaaagtaacaaaattagcttactcttccaaactcttattttattaatattttttaataataaaaaattatagaatgcttcatgaatttgtcatccttgcattggggccatgctaatcttctttgtatcattccagttttagtctatgtgctgctgaaacaagcaccaaactcttaaaattagcttaggttcagagtgaagagctgaagttgcagaccagacccaagctgttttgggactatgaaggacattaagggctctgtttatttgagcaaaatctatgggtgaggcttacctgctttctgccaattttccttgtacaacagctgatgtcagagggtggttggataaggagcttggagccgttggtaaggaagttcttatcactttcttgcaggctccttttacctctagtcttctatgactcaagggtcattcagtgccaaatgaaattctgcctctgtggtaactgctagaaagtccagtgatgatctgatttctagtaacaactattggccatatccccaggaggagataagaattgtgtctattaggaaataattttccatggatctatcacctttttgtacctcttgtgagctggagcactgaatgattttattccagactattccccaggatgtttgtatagcaaacagtcttgggagatagaggtagtatctcgcgccaggggagaaggcaggtttgtttgttgttcattatattaaagacaatgtcttcctccagggcaaaagttgggcaggctaacttgcagtccattataaaagattcagatttcctaagcttggagttgcttaggtatgatgcaaatctcctgagtgtgcaaacatggacctaggatgctccgtaggacttcgagaacaaggggaaccaacagaacatgaaacacataccatttgagtaaaaacagcctttatctttgattcaggtgtcttctgccagcattcatgaaacgaaactggcaaatagcaaaaatctgaaacatttcactgttcttgatagtttcacatgctccatccatgccagggtcccttatttcctgcaaaataaaaaaattctgacaaagagtgcatatgggacagggtgaccttcactgggaagcggaagtgaagccccaagttcatggtgggagatcagtggtaatgaacagaggtatgtcatagtgtaggaaacagatgaaattgccaatgtgaagataagtcattagtgttaagaataaaaatgctagttcatttcacattcacatactgtttgttcacataagatgctccataaatgttattgaataaatggatttatatccttcttgcttgcaaaaatggtatgaagaggtttccagtaaaaaacacagataatgaatttattcaaagaagagtgggaagaggcgattcaggacaagaagggaagaaggaccccaatcccccatcccctaccaccctgtccttccataagagtgagaattttgtcaggcattttaaaaagttcacctcactaatcctcaaaggacccttaagattgctctcagataaggaaactgcatagaagataggaagagcatctgtgagtataagatatgtacagtatctggctccgatctgcctttgcaaggaaatggcagagccaggatttgaactcaggttatctggcttcaaggtactacatgttttttgtttgtttgtttgtttgttttttgtttttgttttgttttatatgactgagtttttttactctatcacccaggctggagtgcagtggcgcaatctcggttcactgcaacctccgcctcccaggttcaagtgattctcttgcctcagcctcccgagtagctgggattacaggcacccgccaccatgaccagctaatttttctatttttagtagagatgaggtttcactacattggccaggctggtctcgaactcctgacctcaggtgatccgcctgcctcggcctcccacagtgctgggattacaggcgtgagccactgcgcctgacctctacatgtttttttttttttttttttttttttacaggacaccacattgacagtgtcagcccaaaactagaccaagaacacttgggcacactgagctcagggcttagcccaaagttttctgaaagcatgccagagggaaagctggatgaaatgctttggtaaagaagaaagcacatcagctcatcactcatctgacaatagaaaggactgatcaggaagtggggaaaaggagaatagtggcaaaacatagaaaagagaaaaaaaaagactgaaatttttaatggagcgcaaaatcagacatatttttttacttttttgaacttctttagagactacaataataattcttatgtgataagtccaataagctatgatgatgttttattaaatgtaccatcatactagcagcttttgcagaatttgcatcagaagaaaagtataagatattaccaccatgacttggcaaaagcggtatactatattaatgttagccacttagttgctgtcattgtttctcagcacagtacccattgcctagtttccctgggagttcttgaaagctctattgaaaagttatatttaaagtgtaagttagagtgtgctgtgaatggagagaaaattgtttttctttttgtaaaaaattcactttccttgggactatatactaagttagctcagttatttgacagaaccagtatcttattttacaaagagaaaaacatagatctagaaatttccagaagcagatcactggttgaaagggcggggcgggggggggcatgtgattgaatgtgatttgaaggcagttttaattttatgacactttacagtgtgtgtgtgtgtgtgtgtgtgtatgtgttttaatgataacctaattttattgtcccagacttaaagatctgtgccacctggagaaactacagttcatccattagcatgtaaatctgttaagagtatttttgcttgaatttctccgagaaggctcccggctttgttctgtacagacacacagtcccgacgctgttcttaatatcctgttttcatttgtcagcgctgttgtccttttcattgccatgttcccatcattcctcttctttcatgtggtgctttacaataacattcagaacaaaagagtcactcctctttctgttgcctttaaaaaaaaaaaaaaaagacttcttcccctgactgcagagcttcagtgatcaggggaaatgtttaaagcatgttattcgtaatagttaaccaggagttgtgaataagggttcgttttccttactttttaagatcaggaggtagcttcagggtattgtgagcaaaaggtttttgtgtgtggctgactttgaagttgagggaaaaagcgattttctttgagaaaaggaggcatcatatttgagagaatttccaatctgctcacacaatgggaatcagttactctataacatcgtcattacctccatgagtcacgagactagtatttgttcttgtctttgaacttaagctttccagtgttcagagaacagttgtgaaatgttgcattggccatcatcaataactattttgctcctggttggtaataattgggaaggggagggtgtgtactttctctgccttctaggagagtattatataaataaagtgagaaaaagtttccccaagcggcaagcttttctccagggcacaatctattatacttgctgcaaaaatcccacttgactggtctttcagagaatagatcacttgcgtcattttgctcatttccaggtgaccttttgcagatatgagcaggcagttgtttttaaataaacattatctacaggtttctgtttctgcactaaggaaggaatgtttctgtaatgcagaagggatgctatgactgaggggtttgtgaagagtgaattctagccagtctcaaataattctgaaaaggtgcttttgtatatgtatatgtgtacttatgtatacatgcacattgtatataactacaaaaactaattccattatggacatatataggactttatacagacatagttatatgaatatatatagaaatacctatcaaactataaatacatttgagaaagcattcagggacagcagtgttaaaagcttttcatctgtgactggtttcacagaaattagtgacttccatttctgctaccatcacgctgttggtctgttcaccaggagggttgatttagacttctgccaggagactaggtgtggccatctctcaccctcttcctctctgtccagtctgctatcattgccttcagaaccaaattcttgcatgatacccagtacagcatagacctggaaaacatcggtcattttcaatataatgtaaaataggttctgtgtgcctttaaaactaaatgctttatttcttaaactgtaaaagacatgaaatgtctgagacattcagatagtgggaaatttcatctgcaagttgtcagattatgccctttagaagattgtaattttttttgttgtttatcattttctcttgaggggtggagtaaatatttctttcctgatgtttcaacttcagatgttcaggctaattttccactacagtgccaaaatagggaaaagttaggcctgtagaattttgacaatttaaatgttgttttaacaaaagccatgtcttgatgaaaagttctttagaattctacttgatgatctatgtgtgtctcttccgaggacaatgagaacttcttaaggaagtcatctatatgtgaaattgagtaatccttttattcattgttaaaagacaaatgaagttataatttggagagacataagccaaaaaatctatgtttgcatttttatgtcctaacatgtgaagcatgctttgatttactgtgaagtgttgcaatggcaataaagtagatgttgagacgtgcagactgggcagcccgaggaagcagttcttgcctctgcttcccctttatcatgaatgttccttaaacacctttggtggagtccaaatgtctggattatgaattgaattgtgcaagattctttttttaaacactttcctgatgatttactttacttgcagtttcttgtcttgcatggtgataagcaatatccttcaaagaactgcagcgcaggactttttttttttttttttcttttaggaagactacttccccttcctcctttagtcaatcaaattttaaaagattacttctttccattctcagttcaccctttctttgccattctggagactgaaattttggacacccatcacagatttgctattatatatataccgtgtatgtaatattaaatatatatatatatatacacacacgatgtttttatatatgtgtgtacataatgtatgcatacgtgtgtatgtgaaacctgtgtgtatatacatatattttaaattgtttatcaggatgatagattgctatttaggtcactatttttggaagaaataaatgactgttctttgtgtctgtactggagattgttcttcctgatataactttgaagaaaacttcttccagacattatacattaattcagaagataaaggcacaaaataatgtgtatattatttttttaaatgaacaagccagcatgcagagcataatgtgatcatgtgctcagtacgacactgaaaggccccaaaggcaaatgagtctagtgcctgttcccagccccaggagctgggcaggacggctcctattggtggcattgaaagctagcattcagccttctgccacaggacagtgtctcattcggccaagctgctgctggtccctgtaaggaatgagagtacagatcccgttgccaagtcctcatttttttggaccaggcagtgggtgttgagctgacctgagctacctttccatttgggttcagttgaacattgagtaggccagaggatagggaagttgtggcgggggccgtggaaaaggcagttgattcttcaactcgggcaaccctggcggagtggatgaggtggagctggccttcctggaattgttggaccgattttcctgttgtgtttcactgttgacgcactcacagacacacaggaccgctccagcactgcctgccacccaccgtctggtctcggtggcctgtctatcatttcgtgggtccccatcctctgcctacggcgatgtttcttcaaaaagaactagtgtgcagtccattggtgggtattcaaggtgatctctttgtcagaatctagagaggtgctcaaagaactattaaggaccaatgtactagttcctgtttttaacctgtttatcagtctttcaattgaacaaattggatttctgaaactgctgaggggttttctgcactattaggacagaacaggatagggtggttgttcctccaggaatctgggttgttcttttgcattgccatttgtctttgtgcttgtctgcttgtataaatgaacctcgagaaggagtgtttaagtattctgttaagtaaatttggaagactaggtttcaattaaaataaccagacagtgtgacccagcttccatttccccttaattttgatcattaaagccttcatatccccacagacatctgccatgcttcgaagtgattcttctcaggaatgttcattcattattaatcaggttgcatggtcaggcgagtatgtgattattttaaagaatgtcctagagatccagttactaagaatgagcatgttataggcagatgtgaaagtacagaaaagatttggttaacagtttaatttgatttgcatgaattccaccaggtgggtgtttggcgaaattaaaagtcttccctggttctcacttcagatatgaggtaaaaaaataataataataataataatttcagcacttcttaaagaagaaatgtcaagttattcaaaatatctattgtattaattattttaaaacttgaggctagcatctcagtgctcatctgcttgtcacttttttttttcaaacagtccctctggtcccctacaattttcttggcagaaattcttagttgtctgttactggttgagcaaatgaatttgagtgtgctgacatttggaggctaaatgcagtgataattcagagtaacattctttacctataaaatgttactggatcaccttttttcacctgttcttacttgatgtattatttatactgttgtttttaagaaccactttgcgtttgtactgaaacagcctacattatgctatcaatttccagtctttcagaatgcagttaaatccaactggatccccttctcccctttttccatcagttcatggccctgttttactgtgcctttgctaacccacctgcttctcaaattggccagagtgctaatcagtaaagtaacatttgggtagtgtctttattcggtggtctttatcactcaaagtcaaatactaaatggcataattgaatatgcagatgctgagtgcttgtattatgttattcaaaataccctatgatgaattcatcttggatgtagcagccagtttttattgagtttgtgttagacaagtttttgagttgagaaattatgcttatttaagatgagagcaagtcccttctgagttgggtccccgttgcaatctgcctcccaaactcaggttgatttccagtgtttcacacttcagtagttttgagtcctctgaaagtctgtatttctgctggtccaagatagaaacatcactctgcagtctttaaaaaatatttcacctatagttctataataaagataatctcatagcaaaaatccaaacagcaatagtcaactaaatctaattacccaggtgaataggggttaagaggagcggacaatcaagtaaattgacttgatttcgtttctgaaatttaggactctcaaataattcatttgtacattttcaatgctatttgttgtttgaaatacttataggagcttcctgttctgaaaccattttcgtgtggcttgctgtaacatcgtgcaattttaacagtgtgtttgtcatctcagttatgttttggtaaatttaacaataaagttagtctctatagtccagaggatatttggaaaagaactagaggaagtgccttgggaatcatctgggcagtggctgacagccacgtggtattaacgattaatcacaggccacccagtgttggcatacaagtttattccttggtctaatgactcactaatttccctggtagtgaaggctttagagttgtacaaagtgaggggctggaagtaaaattattgatagaattgatagaattgcatgttctttttcatatactccaaattagaaaaataattgtatttcatggagtatgcagacataacctagaatacttgtaggaaagcattgagaggtgggtttaccttatcattaaaaaggtcaatgcctccattaagggaaatttgggataaaaattatggatgatgtgctgatgatgggcgatctccttattctaatggatgctgtaacaagttagcacaaacctgatggtgttaaacaatgcaaattcattatcttacatttctagagtcaaaagtctgacacaggtctcactgggctaagagtaaggtatctttagggctgtattccttttgggggcccttggggagaattcatttccttgccttttccagcttctagcctgcattccttggcttgtggccccttcctccatcttcaaggccaggcatggctggtcgagtctttgtcatatctcatcattctgactctgactcttcttcctgccacttccacgtttaaagagccttgtgattcctttgggtccacctagatgatccatgctgctctccccatctcaaggtcagctacttagcaatcttaattatatcagcaacagtcagtcccctttgctctataacctaaaatattcacaagctctgaggaggaggctgtggatatctttggggaccataattgtgcctcccccaaagagggaggagtagaaactgtggtgtctgctgtctggtgaccaggaggacagaagccctgtgaggagacaccaggagccctgtagagaagacaaagacaggctaatgagggaagaggataaatcccacatcatgtgcattccaagtctgaggcacttgcagtacatgaagcaaagaactgtcagtgctaaaccgggttccagaaaggggttctcgaccatcttgggatacaagcctagcagtcattctcagagaggcagtacatgaaacaaacaaaaaactggatggccctgtcaaaggaaccatagaccatcagaaaacacttaggctttgattagcaagaggtagaagtcagcagtggttagacagaggaaaactaggaaagtacagtttcagtgacatacagtgatgtggtttgtttgtccccaccaaaactcatgttgaaatgtaatccccaatgtggtggcattgggaggaggggcctagtgggagatgtctgggtcatggggatggatccttcacaaatcgcttgatgcccttcttgaggtagtcagttcttgctctcatggagactagattggttctcacaggagtggattagttcccatgagaatggagttgttataaagcaaagttccttctcttgagcagatgccagtaccatgcttcttgtacttcccagcctgtggagccacgagctaaataaacctcttttgtttataaatcgcccagcctcaggtattctgttatagcaacacaaaatggactaagatacatattatgagagaggaaaggaaaggaagaagagggaggtgtgaaaacatttacatcattattttccagcaaaacatctacttattaattttccattttaaagaagtactttcctcataagtcttgaatctataagaaagttttttcaaaagatgtatccaatgcctcccacgatgtggggcttcactgtaatctgtcactgaagactctcctgcctaggggagtgattagagtgagtgctagagggactgtagggaacatctgtggacactcacccatggatactcagacagctaataagtagcagaactgcaggatgtcttagattatcccgtcacctgtccagctctctcccctttcattcattattctgtgctgtgttctagatgtttaaaccatggacaggcagaggtgtgagctgtgatttgttgccattcccagtttgttgcaagggactctcaagattatctagatcctcttctcaatgaggaccaatctgcccattcacaaaaatgttaagctataggatttcctgacaacaatatgcatgtgtgatttccttttattgaagtagaaatgaagaagtttttttttttttttgaggcatggaaattacattatgacagttaagaaaaggcaaaagctgctgttttatgatattggggtttttgttgttgttgtttgtttgttttgagacagagtcttgctctgttgcccaggctggagtgcagtggcatgatttcagctcactgcaacctctgcctcctgggttcaagtgattctcctgcctcagcctcccgagtagatggaatcacaggcgcacgccaccacacccagctaattttttgtatttttagtagagacggggtttcaccacgttagccaggctggtctcgaactcctgacctcaagcgattcacccaccttggcctcccaaagtgctgggattacaggtgtgagccaccatgcccggcctgatactgttattaatgatataaataacaatgtaagctatatatatatgtgtgtgtgtgtgtgtgtgtgtgtgtgtgtgtattagatacatatatatatagagagagagagagaaagagagagagaaagggagagagaaagagagagagagagagagagagagtgaaaagaaagataacattttgcataaaattcccacccatgtaccactatctgcttggtgaatccctgttcatcttttaaaacccacttcatactttacctccttcaggaagcttctccctgtctcctctccccctatatagagttgattattccctgtctgtctttggcatgcatctttttttatgttgcattacaccttgttcatttttttttctcgatatgggctcactctgttgcccaggctgtagtgcattggcatgatcacggttcattgcagcctcagcctcccaagtatctgggaccacaggcatgtgccaccactcctggctaatttttttatttttattttttggtagagatagggtctcactatgttgcccaggctggtctcaaactcctgggatcaagtgattatcccacttcagcctcccaaagtgctgggattacaggcatgagccaccacacctggccttgttcatattttctctctcggaatgaaccataagatcatggagacaggggccagctgttaccagtacttgtctcaggaccaagtacatagatgaacttaagtatttggtgaaagaatgaatggcaaaaaaaaaaaaaaaaggaatgaatggcattttaatttctccaaaaagatattttaaagaaagctagaaaataaaccatactaagtttcttttagaagaaggaatggaatgagtacaaataagatactgtagagtcatttaacaaaaatgctatctatgccattgtaaaatctgggtaaaagtggaaaaagtgggatgcactatagatatcaaaccaaaaccccttcctttttggtagcatacaggcaaaagatttagaaaattggctgaaattcacctaccacatctgagtattgtgtcttcacctaatacaattaaccatttacagtacagacacttgcataaagcactatgccaggtgctatggcagtaaaagaaaatatctagttttgagcagctactattaattcgttcttacatgagttgcccctaagcactcgagtcacataatttccattgatgtcagattcaaagcccattgcatatcatttcccattagcactggaaacttgtaagtgcttgttcaagtcttgctccgccatccttgctgctgttgcccacacagcattttattcatacctctctgagaatgattttcatttatgttctggttatctgtatatgcctctatcttccaatacatggctcaacaaaataagatgtgcaggccaatgctggcctgtgacctgtttttctaaatatggttatgttggaacacagccatactcattcctttatgtattgtgtctgattgcttttgcactacagtggtagattgagtagttgcaacagggcccctttggcccacaaagccaaaaatgtctactattttaccctttatagaaaaagtttgttgacctctgttcaaatatattgagagatccttaaagtcaagggctgtgtttgattctttttggttttagctgaaaagtcagtacatttaatggaatcaatgaatgtttgagtcattttgtgtgctgagtgctgttctaggtgttggtggtacgttcttcaaagagcaaagcaaaatctctgctttcacagagcttatattctagtgttgaggacagtggggacagaaggagcaataaacaaactaaaagaatatgtcagtgataaatattataaagaaaaataaaccgagatgggggaagaattaccacgatgggtaggtggtatagtggtagaaggggaattggttttatgtgggttcagagagaaagtgacactggagcagagagtcatgtggattctgaagaccttgcaggggcgagcaggggattgatgtgcttggcatgtttgaggagtcagaacgaggccatgtgctcagagcagagaaaggagtgggtagcgtgggaggaagtgagctcactgtctgagtctgtgttttctggggctggtttattctggtgaatttctctctgggtgaaatgggaagcccttacagggcagagcaaaaggagatgcatgttctgtcatgttttaacaacaggctctcttgcttctgagtggaggatagactatagggggaagggcaggagtgaacagaagccaagagaccatttagaaaggtcttatgatagtccacataagagatgatgctggcttggcccatgataatagagatgaggtgatgtgaaccccagattctggcttcttcatctaactcagtgcctggcacacagtaaacatctgttgaaggaatgaataaaatgtcagtatttccactgaggtctccccagtggaatcctttctagaaattctcatcacacctctctgggatggaatcctggcacctgcattaaaaatatagtcatcatagctctccagacataatttgatgctcatccttctattcagattcattggtaggcattcttgttttatctgagaacagagcagaccaaaagggctacatttttcctttaatttatatgcttctgatgagaaggtaaaagaactttgatttaaagataattctacattttttctatgattaaccaaaataattattaataggtaaaaacctttccatttcttctgagccatctgtaggaagaggtgacagaccaagtggggatgatatgtttcttacaacagcaaccctagggtttccattgcaggttgtagaaagatgtacaagctttaatatttcaagtcacagttgctcttttattctttcctatataataaatgctagtgaatggttgaagattttttaagataccaggcttttatgaagccagtagctgtttaatttttaacaggctcgggacatactttatacttttaatgatcagttaccattcagttggtagcaagatgagcattaatttcaccaaagcaccatattggtatttctgagggatgctatttcagaaggggtcagggtattctagaaaccgtgaattttgtaaataagcggaggtgtgaatacaaacgattgattgtcagaatcactaaacatagctttggatgtgaagccttcccataaatccggctgagaacgctctccccaccacccccgtgggtgatttgaacctcccgaccactgggtgaactgcactgttctcccacagcctgcaatgggctgcatgtaatattcccatcactggtctgcagacctctgctaatggtcttgaaagggagaaggttcaaagcggcttggttcccaggcctgctaatgagcatgaggcctcttcacccttaatgaactggggtttgtgtggaattctttctactactctttttgatgggaaggcagatgagagttcacaaaagcactcaggtctttatggcaaggggagcaggcagctgggccaccctcgggtggcctggaggagagcaacatagctagcagaggtcgtacccaggccaacatagctctgagtgtgaggctggacctcctgccagcctggcctgttgctggcaacagtgacaagcccgtggtgggagttttttggccaaaagggtccctcagcagttttgtaagcctccttaaattgctttctcaactgtaatcattatcattgtcataacataacttatcacatgaatatgatgaccactgaaatccttgttctaattaactaaatcattgctctaaatattagtcattggtactcaaacttactgcagccactgaaaaagcccccagatatttttctccacttcgttctgcctacccacgtcccactgctggattaaacaatagaattattcagaaacataatgaacacatgccaaaaatattgcctctatcacaatcatctttgtgaaagtcaatgttttttctcaggaatatattttggaaaatgacatcccacacttaaacacgatcatctctgctgaaatccccacatttgatttcatgtacatttcatgcccatttctatagttactgccttcctattgttctgaaacctggtttggtattgcagagtaaaagtccttaaatctcgtatacattaatacgtaagtttataaattcaaatttataaaagactctagtttattgatgaatatttctacattttaattttctgtgcgaggttaaacctgactctgacacaataagattattctgattaaatacaaattatggaaattacagtttcaattacattctagttttgaatgaagccttttaaaaaacaaaattgaaaaaaaaaattgcacattttcagttactgaactttgagaaaatgttaactggtatatgatggctcaggatgctttttcctccttttttccccagtgaatagaaagagaattatttggaatgtacacacacttaccctttcatgacctgtgtttggaattattctgagatgcattcaaagctgacacccccctatggttgacctccctgtgcctaatcaaatcttacattcttgtttccagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaaggttagtccgatccgccttaagccaacccctttctgccagaaaatgtcatggaaataaaaagtgtattcactgctagctacatggcaggtgaaggttttctcctcacctttgttatctgattagttttagcatgtttttggcaacctataaatgttacacaataagggtatcttgtaaaagttgactgctgcttgtaattttagcgttgtcaaggtgagggcaaattctaaaaatctggatcattttcaatccatgcagtttttctggatcattttcaatccttacagttcttccaaagagagtgctgcctctctctgagagagagggagagagagagagagagagagagagagagggagagagagggagagagagggagagagagagagaatgacagataaaatctggctttgggcatttggggaacacttacttttctcactcatctgggaaaactaattcactctcattgtacctgtatctagttactgcacaaacaaaagaatagagggaagaatgtctgtagcaaatgtgggattttagaggacacgtgaccttttattccttgtataaacgatatccagcttattggtgaaattcagtgctctgacaatctcaggtttcacgaaagaattccttttcgtgtaggctctttattcagtaaggttacagtcaagactatttgaacttcattttttacatgaaattattaacctaactccagcttgggggataatgattaatatgactatatgtgaaataaaaggatcactttctaggcagggcgtggtggctcatgcctgtaatcccagcactttgggaggccgaggagagtgaatcacttgaggtcagcagttcaaaaccatcctggccaacatggtggaaccccatctctactaaaaataaaaaaattagccgggtgtggtggtgggtgcctgtaatcccagctactcgggaggctgaggcaggagaatcacttgaccctggggggtggatgttgcagtgacccaagatcgcgccactgcgctccagcctgggtgaaagagcgagactctctctcaaaaaaaaaaaaaaaaaaaatcactctctaagtatggatagaaagcactagggaagaaataataagccaagtctccacatgtttgttcaatttcaggcaacagtgggtctaattattgaaaactcagctgagagagtttgagtgagatactatgttcatcagctaattttagatcacaagacaccaattaaaagaaaggaagtataaattaaaagctctaagtaaatatatattgaagtccttcctctcaggaaaaacacataccatgttgttgagcaaacaaaatgaatcacatgatcaaaagagtgttatcacttagaaaacagtgtcacctttaacaaatggtttctatcacctctccttagcgctaatgggtggttgtgtttactgggaccacatagtttattctgtgacagtgggattaacggaccacatctgggatttggctttgctatttcttgacatgttgagggaagccgacatgctgaagtcaattcctgcttctcaatgtcacttgggcaacaaaagcatcacctgggcagcatgtttcacttcaagtatccaaagaattactggtgcaaatccatctttaaaccatgtagaggaagtcaagcacaaggactcaggtgacacagacaacagaagacagccgctgacaggctttccagaacagtgcatggcagcacaggagaaaagtaccaccaaagttaatcatagcaaaggcaatgcatgtatgagctgtgcctctagagcaaattctgaagaaattgcgaaggctattaatttttacaaaccaaggtaatctttttttttttttttttttttaccccttttttggttggtggtggagctgaagggagaatatttaggataactgaacagagatgtttgatttttgttttccaaaatgtaaacatgccagatctttgtttctttattaaaaatgttcctttgattggatttgcactaccttttaatgattgtttgttaaaacaccacaatcataatgatgttcaatatttaacaactcccaggcttgatatttatttaaatcttgtggtcaggttctgctcaagtactcatggcctgtcacagcagagttattaaatatttacataacatctccaaatttatgaagaattcctgtcatgctctagccctctttgtgataaaaacaaaactcttcagttacgagccctgcacactttaattgagccagtggcctatcggttgttctactgtcacatggagggcctgacaattaatgatgtggtttctttttatttcctagttacagaaatataagcatataaacagcatccaatgcaccgaaacacatttacagccgttcaataagatgtacttatgagcatttgaacaaataacttatcgacatagcatgtttgttttaaaacatgccacttacgttagaattttaaaaataataattatgacatttggatgtctgatatttcagttatcgcatacttatgaacatatgtacatccttgttttatttaaaacctaagcacaatataaatgttgatttttttgaaggaagtaatagcataccaagaggaccaaaaccaaggaagtatatttctgttaattactactttggtctgaaatgtgctctgaacatgcatttttctgtagctctaggatctcatatagatgtggatttgtgatgatgtgagaacacagataaagcatggaggaatttgaggatgctttcattgataagacaatagatttgctttattaatttgcatatgtaaggaccctggtgtctttggaaacatttttgtccttctgttagtaaaagtttattacctgaagaagggaattctgcaattattatgaagaataatttcttgcaataatactaaactttgggggacatattttactcattagatctcagtataagagatgtttgtttatacaaaaaatcagaatatcattttgtacattacaatctttttctaagtgtaaaagaaaaagagataaaaattctaacatgttgaactcgtacaaataaaatcatccacatcatgtaaaatagcatcatgtcagtaatctaacgctttcggagactatgcattgagaggcactcatgaaatattgaagcaaagagaaaattaaggtagcatttcctgaactctactaagataaaaagagaaaagttttcctgccaagtgcaaaggtctctaagtggagcgtatccataatgtggatatttctttacatcgttttaattgaattttaagaagcctctcagtccttcaaacttggaggaaaaatttgatttgtgaaccacataacatataagagaatttaatataattaatgcattccagagttttcaaggaattaaaatgcagtagtcctctttttctgttccaacatacaaggttggagctcttgtttcttttctctaattatacctataaaaatatacaaattgaaaaaaactgacctttccttgcctttcagtttcagcatagccccttcaaattagctgaagctgaagttccaaactattgttttgctattcttattctaaaggctggctgaggaagtttgtttgtataatgcatgtttcaacggatcatcccattgtaattttttaatagtttgatttaaaagttcaaattaaagctcagcatttctatgtagcactttttatctggaagtgaagacatgagatttcattcttgggtttaatttatagattgtaaggttctatgtttgaaaaatctttcccagtttgcaactaggaaagttgtaagtgtatactgagctagacttctttttattataatttctataacttgtttcttctttgaaaaccagtagcaggcatagtgcaggttctagtgctatggtgtgtgatgcacacacatacttgcatatacatatacatacatgcatttatttatttatttaatattataatcttcctgaatctaagttggagacaaattcaagtgaccagtattttcattagggatatttcattctgcaggcaagagatgacaacaaacatagcaataataactatattcccatcactcaaaatattttacctgttccttgaatgtttggtagatggatacaagtcaactttggacttggtatattttttgtgggaagagtcttatcttgaaggggtttttttttgaagttacaaatatgtgtattttttaaaatgtgtctttctgtttattggtttctagtttaaatcccttaagatcagggctcaagacaattgcatatggtctcacttatggatgcagtatgctttaagaaatattagaataagtttattgtatcttcaaaatttccatgagctcattaatgttttcagtctgtgtaatcaattaatgactaggagaggtgcacttaggccttccactcagagagtgaaattttcttttttttttttttttttttactttaagttctgggacacatgtgcagatttattacataagtatacatgtgccatgatggtttgctgcacctatcaacccatcatctaggttttacaccccacatgcattaggtatttgtcctaatgctctcccccgctcgccccacaaccctgacaggccccagtgtgtgatgttcccctccctgtgtccatgtgttctcattgttcaacttccacttatgagagagatcatgcggtgtttggttttctgtttctgtgttactttgctgagaatgatgggttccagcttcgtccgtgtccttgcaaaggacatgaattcattctttttcaggcctgcatagtattacatggtgtatatgtgccacattttctttatccagtctatcattggtgggcatttgggttggttccaagtctttgctattgtaaatagtactgcaataaacatatgtgtgcatgtgtctttatagcagaatgctctataatcctttgggtatctacccggtaatgggattgctggatcaaatggtatttctggttctagatttttgaggaattgccacactgtcttccacaatggttgaactaatttacaaccaccaacagtgtaaaaacattcctatttctccacagcctcgccagcatctgttgtttcctgactttttaataatcgccattctaactggcttgagatggtatctcattgtggttttgatttgcattttcctaatgaccagtgatgatgagctttttttcttcatatgtttgttggctgcataaatgtcttcttttgagaagtgtctgttcatatcctttgcccactttttgatggggttgtttgattttttcttgtaaatttgtttaagttctttgtagattctggatattagccctttgtcagatgggtagattgtaaaatttttctcccattctgtaggttgtctgttcactctgatggtagtttcttttgctgtgcagaagctctttagtttaattagatcccatttgtcaattttggcttttgttgccattgcttttggtgttttagtcatgagatccttgcccatgcctatgtcctgaatggtattgcctaggttttcttctagggtttttatggtttggggttttacatttaagtctttaatccatcgtgagttaatttttgtataagatgtaatgaaggggttcagtttctgttttctgcatatggctagccagttttcccaacaccatttattaaatagggaatcctttctccattgcttgtttttgtcaggtttgtcaaagatcagatggttgtagatgtgtggtgttatttccaaggtctctgttctgttccattggtctatatatctgttttggtaccagtaccctgctgtttttggttactgtagcctcgtatagtttgaagtcaggtagtgtgatgcctccagctttgttcgatttgcttaggattgtcttggctatatgggctcttttttggttccacgttaaatttaaagtagcttttctaattctgtgaagaaagtcaatggtagcttgatggggatagcattgaatctataaattactttgggcagtatggccattttcacgatactgattcttctatccatgagcatggattttttttccatttgtttgtgtcctctcttatttccttgagcagttgtttgtagttctccttgaagaggtccttcacgtcccttgtaagttgtattcctaggtattttattctctttgtagcaattgtgaatgggagttcactcatgatttggctctctgcttgtcgattattggtatataggaatgctcatgatttttgtacattgattttgtatcctgagactttgctgaagttgcttatcagcttaaggagctttggggccgagatgatggggttttctaaatatacagtcatgtcatatgcaaatagaaactatttgacttcctctctcctattcgaatacccatcatttctttctcttgcctgattgccctggccagaatttccaatactgtgttgaataggagtggtgagagagggcatccttgtcttgtgccagttttcaaagggaatgcttctagcttttttttgccgagagtgaaattttcaagtcctcttcatagttctgtcattttgcttgctttaggccttttgaacctatgttattaagaacgatatggctgggcatgggggctcacacctgtaatcccagcactttgggaggccaaaaaggagcattgcttgagcttggtcgtttgagaccagcttggacaacatagcaagaccctgtctctactaaaaataaaaataaaaattcaactgggtatggtggcatgtacctgtggttccagttactctggaggctgaggtgagaggatcattgagcctgggagatcagggctgcagtgagcagtgattacaccactatgctccaacctgggtgacagagcaagaccctgtctcaaaagaaaaaaaaaaaaacccacaatgaaagttaatataggttttttgagaggtcataaaaaattaatatgtgtttaattaattaaggtaatatgaacagtaacagtccctgccttcatggagcttatagtctagtagggcattccaacagctactaaatactttctctgttgatggtggcaggaagcacattgtgcccaaagcaaaggtactgaccccagtcctgagagatggagaaaggcttcccagaaaagggatcactgcacctaccatttccaagccttgtattagaaaacaatattgaatttactagatgtctgtaaaatccctgttatcagttattcctttttaactttttaccacgtatgatgttctttgtgtaaccctatatagtttttcaaacttgttcacagtaattcccagttgattttaatctaaaatacagacagactatatgatgtttcaccatgtggtatgtgaataactcagacacatgtcttctaaaatgttgtaattttatggagtttcaccagttccaactgactccaatatgcaattctgtttgtactaattttatggcagcatttgtttagtctgcaatatagatatgtatttttttccttttatctttagttggacacttaataattgcacatatttatgagatatagtctgatatttccaaacgtgtatacaatgtgttgaaatgtatattttttaatagtttccatgtgattaaaataagatttccaaatatttgtaaaatgtattaaaactatattttaattttgttagtttggtacaaggatatttatgatagatggaataaaagaaagcatctccaggcatatgttcttaatgggaaactcaaggcagcttccttttcctcctcctcacctgtctattttctggatgagtcctctctcaactccttcacctgcagagagcaatgtattattgcctagtgatttattattgttggaatcattcttggtaagctcagagagttcgaaaaatgcacaaacaagtacacatggtacctcttcatcatgtggctgtgtaaacgtaattcttgggcaccttgttaacgttcttgtgctatattttactcgtctataaaacagggctaatgtatagtacttactttcacagaaaattgggagagcaaaataaagtgtttcatgtgccttagcattgtgcctggcctacagaaagcctgcaacacatgtcagaacgactgttagaaactaggaggcagaatgtgtaatggttaagtgtatggacattggatgtagactgactgccaaatattttttaaccactgtcttgtattatgtgtatgtgagataagagtatatattgttgctttaatgtgttttgtagttttgtttctaaagcacctgccaaagggcagagacgtgacaattaataaacacttgttgatggacatgtgcagaattgatgcattagacgagtgttttgggattcggaggaggaagagatgaatctgcttttgagtagacaataaaccttgcttcagggtggtgggatttaagctgctttgacagatctgtggattatgcatcaaagaagagtgaggtgctctgcaggagtgagaccagcagagacctgtcggtaggaataggcaagacagctttggaattttagacaatcctaactagagcacagggtgccaaatggggagccaggaaagaggatgttggaagagtcacctggagggaaggtcttgaaagtctttaaatgcaaggttaagggtttaggccatttttaccattttctatagagtaatagtgaagtgttttttttttttttttaagagagagaggttaatgtatattttctgaaataaatttcatgtgagaatataagaatggatagggttactgtgttcatggaagaaataaaagggggaagagacattcacattactttagattttgtggtctctcttttaattggcagaaagaagtagtatcacaggtcaaaaaccaccaccctgtcaacagaaacatgtaaaattgtgagattcaaggtcctgccccttaaaactaggaagaaataggagatgtcgttgctgattggctcttaggtacagacacaaatgtgattcttttcctgcttttctagtgcagtaagacacagtggggacaatgcatggttatttcttctggctttttgattcacaataaggagaatgctgttcaaacctccgaatgcccactataaaccaaaataatgttttagagccagaagcaaccttggagctcatgtcattccatcctcattctgcagatgaggaaagtagggctgagagtagtaaaagaagttttccgcaatgacctagtgggttagtgactctgaactaggactagagcacagttcccagctgtccagttttgtgtctttcctgctacttcctacagcggttaacagtgccagccagcacaggcaggattgccttttgagtggttctgaaatttctgaggtctcttctgaggttttcaggagtaaacacaatgattttacggtaatttttaaacgcctgcttggcctggcaataaaccagcatcatgggtgtaggatgatgccttaccatgctgtctgggaattattgcagagatgtggctttgcaatgatgcctccagggccaccaaaataagttgcctagaagatgcccccatgctgacattttctatagctgagccagtgtagatttggccatcttgaagggccagacttcatgcctggagctgtgttcatgtacatggacccagacaacctcggggacactgcaaaagaaagcagagttaggacagtgatgtcaatgaggaaacaaaggaattgtggttgcaacttaatgggctcactaattcccttcttaggattattgttttcctgaatgtcttaatatatagattattcttagactggtaaattttttgacattgccataaagtgggcatgagtagtctgagaaactgaatgtggctaaagatttaatttattttcagtatgtggcataaacattctggaaaaatctgatacaaatgcaattgtaaaaatccatttaaaacttaatcactttatattctggacttttgggtatgacacaacgttgttgcgtacccatgaggtatggactttaagctgacaaaggaaaacacattttgcatgtcgcatcaaaaaggaaaatgcttgtaaagtgccgagcatggtgactggcacatagtaagtgttggatgtacacgaggtattattttatctgggcatttactgttacaataaaaccttcattggtgtaatccaatggtggatttcttgacagtatcataaattactcagtggttatagggttgatatgtgtttctggctgacatgggaaactttgaacaactctcaagggaattataattgggtggaaactttgatttgtcctttctaaaccaagctaagtagtgaaatggacttttaagaagcagtgagtggtgaattgaaagaaatggctttaaaaacaaggcccaatttgaagtctggggatgcgggtggcaggggtggaggggagcggctctttcatgtttctggttaatctgattggatcagcaccacaggtgccatcagagcacctacagctgtttccaagaaaagaaaagctggcattggtttatactatggctgtcacatttatacacatctagacagatgaggaaaagatgggtgacatgatacacagtaagcctagactagtcagacgagctcagggggctagctttctttttttttttttgtagggttgcctttggtatgtgagtaaatgatgaagcaagttggccctgggctgtgtgttagcagctgtctctcttagaataggaagaggaaggaacttcggtatcgactggggctggaggaggaggaaagcgctgaagtgaaggagctgtacaagaaggcagcttccaactcctccactgtaggggccctggggtgttttgttctctgtgctctcttctgtgccagttgtgcagggtgcctagaatagcggtatcatcgtctgcctcctcccttatatctcttttgctatttattgagggggaaaatccggaaaatatggtttttatttttatttacattgggatagactaggttcttattactgaaacaatatggaaatcatgagcagcttctattccttttgtgcctttataaatattcttttccctatctgctttatcagatcctgcttttaaaaaaaaaagaaagaaaaaaccttatttgtttactcagggaatattttatgtagctactatgagataaacactgagtaaattctgggaatgcagaaatgaaaaacaaagataagtcgttgcttccatggtctagagctcattataacatgtaataagaatatatagacaggatatgaaaagagctccatggagctcaatcaatgagataatttttaatgtgaataataataaaaaaccactgacttcggtgttgatatctggaaattgcctaattccaaaagctgaagtaaaaatacatttcaataaaaagcaacatttacagagaacagtgacattcagtcatttggaattgcaaattccactgttcagtcatttggaattgcaagtaagggcaaaatatgaagactccaatccatgaaaaaagccggctggatgctttcttatgaaaggtctactgttcgcgggctggactgctagcccttctcacgtgctttcctcagaggtctccatttccttcctgaacagggctaataggtcagataaatatccaggctcacaagcagtttatgtcatttccactctgaaaggatccatccctaggaagatattatgggagcaaacttgcggaagtgctattgtgttaaccaagccagctggtgggtttgctttatctgttatggaatttttaccaacttaggtgttaggatgaatatcctgacctggtagagtgtttatttcccccttctttgacccttgacacagctgtttagagctcagtcactcttggttgacatggtcagattcaaagccaagaagagtgaaatgggcaggcttttagactcacacactgagtatggcctgtgtgagtgagtctgaaagatctaggagacatggggaagccgtatgcacttcacttaaggagcttggagggagatgctatttttgcctctggattgctgatttaagctctagagggtcccagcaaacaagggcctcacttatttatagtgtccagcttgttaactggttccagtagctctttcattctaaataccctgacttgatcattacagattctatgcatgtaacaaaatatcacatgtaccccataaatatgtacaaatattatgtatcaataaaacgttcatctgataacatattaggcaaggccatagggctgcttccatacctctagaaaactgcctcgtaggtcagggctgagtggtagtacaggaaggtggagtaatctgtcaagatgctgctttaagttgttttgagatgtggttcaagggtgtttgttgatcaaacaccaagagctagctattaccaagaataataactagcatttgtaaatctccagattgacagtttgcaaagcactttcaagtattatttgatccttggaacaaccacgtatctcctgcaaaaatatgggaatgataatacctgctcattagggatcttgggaggattaaatgagataatataggtccaagtgtctagcctagcatttagtgggtgggagcagctgggtaaataggaaccatctttaacaatgcagaacatgaggccatggaaaattcaaaagcataactgtagtcagatgactacgttttggagctcagacccagggaccccattttgcccttgactaatcgtcacctatgattaaagcagaaacaactatggtccaaacataccacccttaaaaaattagcgagaaagaaagagagagagtttgagtatggagagagcaagtatttttgccttcacttttgacacacaggctccctggactgagcaaagaagttccctttgaagtggtgactatgattgaggatgagctagtttccactctaatataaataaagaagtaaaaatacaaagttgaaatatggaaatccatatggaatcattttatttacttacagcaatattgaattatccaatactcaatagtttctctgtacctaagtgttaacataaatgaatgaatctctgatgatccctaaaatcatttcatcacttgaaatgtgattatttacttaccctggctaaaaatgtaaatttatagtcttggtctatgagttcaacatttcaaatttcttaagagaccaaaacgagttaatattcatatttagttattcatgccaaagcgtggatacatataaaaatgatcaccatgtgttagtcaataataaaactttttgatctgttatccattcctctttctaggatcgctaatcagtcagaattgtagatttaaattggtttctaaaacaaagatatctcaaacatggttgtgcacaaagccactcagggttcatacgtatatatatgtgtgtgtgtatacatatatatatatattttttttatttctttttttttttttagatagagtctcgctgcatagcccaggctggagtccagtggcgtgatctcggctcactgcaacctccacctcctgcattcaagcaattctcctgcctcaggctcccgagtagctgggattacaggcatgcgccaccacgcccggctaatttttgtatttttagtagagacggggtttcgccaggttggccaggctgatctcgaactcctgacatcaggtgatctgcccgcctaggcctccaaaagtactgggattacatcatgagccaccatttataagattcagcagatctgagacaggtttagagtctgatttcaacttgtgtcctggcgttgccattttagaattgtgcgaacttaagggaaaaaaaacaaaactaacttttcaagcctcaattcctcatcagtaaaacagaggtaataattcagtaataactccataatgcttgtcccctaggaagccctggacaaaggatagtggttcctctttccatcactattgttattccttgaatgcctctatctttaccccgttattctaaattttaagccttttctgtagttatatggacaatgcagttggccctccatatttgtgggttctgcatctgaggattcaaccaatcgtaaatcaaaaatatttgaaaaaaaaacaattaaaaaagataaaaacacaaataaaaaagtataacgactatttattgtattattaattattaataattattgtattattataagtaacctagagatgatttaaagtattgcaggatatgggtaggttatatgcaaatattataccattttatatcagagagttgagcatccatggatttttggtatctgtaggagggtcttgaaaccaatcccctgtagatattgaggaatgactgtatatgttcttatacaaagtcaaacaatacagtttatgtaagtgaatcctcagtccttccagctcttcctctaccaactcttgattattcttaaaggatcaactcaaatctcatggaggactactctaatttaacttttaataaaattatctgatctccgacattccctattttttttttttttaccactccttcataattgcatgctgtttgtgtattatttcatattctttgggccggattcacaaaggataggataaagtaataccatgtacagtggcttacgtttgtaatcccagaactttgggaggctgaggcaggagaatcgcttgagcccaggagttcaacaccagcctgggcaacatagtgaaaccttgtctctacaaaaaaataaaaataaaaaaaaattccaggcatgatggcacacgcctatggtcccagttactctggaagctgaagcaggaggattgcttgagcccagagttggaggctacagtgagccgtgatcacaccactacactccagcctgaatgacagagaaagaccctgtctctaaaacgttaaaaatgtaaaaataaacctactttgggcataagtcttccctccccaatagtgtttcaatttctcaagcccagtggctgtattttgtgttcttttatatctgattactcatttttcaacaataagagcattctgaaaagctacaaggtattttatcagtagtaaatagttgttgaaaccagttgaaaaaggctgtaatgatttaattagattacagtctgtattgtgtaggtagaagttgcccatcagattaaaaaaaaaggaaaatcctagcccaccagccattctttcaaattttaaatacatagtcaagcaaaataatgcctttcaggtctctgcacacctttctgaatctacaagtttcttctcaatgatttctttcaagaaagtcttataaagagaccatttgaatttttaaaactttaattcaggcagcagtgatcaaatatttgtgattcacaaaggataggataaaataataccatgtacatatacaatcggccctccgtatctgtggatttcacatctgtgtattctaccacccgaggactgaaaatattcaaaaacaataaatggttacatttgtttgtactgaacatgtatagacttttaaaaaatctctaaacaatacaatgtaacaactatttactaagcttttacattgtattaggtattataattaatctagagataaagtatatgggaggatatacataggttatatgcaaatactatgccattttatataagggacctgagcatctgtggattttggtattcataggggtcctggaacgaatcccctacaggtacctcgggacgactgtatatattttgtgtgtgtgtattttcttccctattgcctcagaatagagtttaattccactttgagacaggatggtaaggtatcatgaggaccatagggtaaacttagcaatatacaattgcttagttttcgaaacttgggagaggaaggggctgccactggcgcacaatgggtcaaggccacggatgctgctaaacatcctgaatgcacagaacagccccccagacagatagtcatccagccccaaatgtcattggtgccaaagcggagataccctgagtcgaagcaaagcatctttgttaatgacataagagaaatgctcagttttactcttacagacatttacttgtttgtgtgacccctaaaccaaatctactttgagatgtagagagctgagacattgcagaactcccctcccgccatctgcagatgccctgagtggcagcctggcagcctggcagcctggaagcagccccagagttctttgcacagcgggcttctctcacccatgcccccagcccaactctgagcagtctgggcccgcacatgccagccttcaggctgtttcaacagtatttaaacctccaaaggcttatgaaatattctttaatcccttcccaaaacatgatttaggtgtatttgatattatctgctatcccctagatttcctagtgtttgcagcttattttcaggactaccttccaggtgtagccgtctgtgtcagagacaggagagcctgaggctttcctccaagtggggagtctgcagagaacaggctggcagctgagactttcgcccaaatggcttatatttgatgtataatagttttaattgtgatattattaaaagtgaattatttccatagatcaaaagttaactcattaaatctgttagtctattttaagttggtcttccaaaggaaccatttatatttatatagcattgcgtctttatccttgcaaaactgtggattctaaactcctcaagtcagagacttggaatagcataaatcagatgtgagtcttcattgctgaggctgaatttattcagtcataatttccaagcatttgttcctgctggaaggtactacttatttcacaagaagttcatgtcatgaaagcgctgagctcgaagggccatcacgcatatctagtccagtggttctcaacctggctgcacagggattaccttgggcagaagcccagcccaatgggacaagatcttctggggtgcagctcaggcattggggtttccccaaaactaccccaagtgattctaatgtgcaaacttggtggaaaaagtttattcttttccaattcctcagttacaatgagtaaactgagggtcagattaattcataaaggcagaagtcagcaaacaccgtaaaggactagctactaaatctttctggcattgcaggccatatggtttctgtgggaactgctcaaaagcagccataggcaattcagaaacaaatggatgtggcaggctgccaatgaagctctataaaaataggtgactggccggatttggcccatgggccatagtttgccaacctctggtttagatctcacagttggttagtagaaacccatatgctaggccacagatagactaaccttcaacaagtgatcttccttctactagatgcagttttcctgtttgaagcagtgtctataacatacccaacttctgtagaggttaaataataattatctttatgtaagttaaggcaaatatcttagcataggtactcatagtctagagcgcagaaattttcattatctgtgtctttatgagaggtctgcattttgatggtatttaccaaatttaaagtaataatcacagtatatgtgttttactaaagtaataacccagacaataatattcctatccaagaaattttttcagctagaaagtcagaaaatgagacagcgtgatcagaccaccaaagcaagcaagaaaaaaaaatcagctaagaaaaatggagatctgattttcttttcacccagtaaaggaatcagttgaaaatctcttaattcttccttactgtgctgatgactcatggggagatactttatctcagatttcttttgaatacatctgagtaaatttgaatatgaattatatctaatagctagagatgcttcctacgagtccttgggaaacagcatggactaaggctgaagaagtggaaagaaagccatcacaattaatgtggagagttatgtgtttggtacttatgaaactttgggtatttttcactgtttgtatagcctttcttccaaagtacactcataaaaatagggttcctgaaatgttaaaaagccactggatctggtcattttccttggagattaatttatctctatttggcaattacttcgtatctatgtttttcagagaaagtcactctacctcttcccttttttatctaaataacacattcaataaaagtgcttcatgtcctgaaaaaacaaaactgtcttatttacgattataaaatggtgttcaatcaatgatttccctgaggggataaacactagagatggaaaaacaaaatcaatttgtttttcacaaattgacatccctctgtatgatgccatcattgaactgaagttattgaaaggggccttatagagagggcaccatagagggaaatcatagagaataacatcatagagaggggtatcatagagataataactgcatggagaggagcctcatggagagggagctttgagaggggacatggaacacacagtggtagattaaaataatccagtaatcaatttggccacataaataatagtgatcataatttatgagggcttcccatactaattaaaatatgcataataacaacagttcattttcataattgtacacttaagtcatgctattttttctctttttgcctagttctatggtatgtgtgatcatggccttacaacttttagaaggtactggcaaatgtggttgcagtgaactgtttttctctgaagctttctgcagtaatcctcctggcattattaaggtttccttaatcatacttggttagaggtgatttgcggtcctaccaaccttaatttgaattttctctctgcctcagataagcttgactctggggaggtttctgaacatctttaaatttgagttcccaaattataaagtgggttcagcaatgactgcttttcatggcttatttgagaatatatgagattgtgctttaaaggattgagtagaatgcctggtttgttcattagttttttcttttcttttcttttcttttttcttttctttttttcttttcttttctctttccttccttctttctttctcttcctttctttaccctcccttctttccttccttttttttttttttttttttttgagacagagtctcactcttgtttcccaggctggagtgcaatgatgtgatctcggctcaccgcaacctctgcttcctgggttcaagtgatctcctgtctcagccttcccgagtagctaggattacaggcacgtgccaccatgcctggctaattttgtatttttagtagagacagggtttctccatgttggtcaggctggtctcaaactcccgacctcaggtgatccgcccgccttggcctcccaaagcgctgggattacaggcataagccactgtgcccggcctccttctttcttttttgagacaacatcttgctctgtctcccaggctagagtgcagtagtgcaatcatggctcactgcagcctcgacctccccggctcagcctccagagtagctggaactacaggcatgtgccaccatgcccagctgatttttgtatttttttgtagagatggggtttttgccgtcttgcctgggctgatctcaaacttctgggctcaagcgatcttcccacttcaacctcccaaagtgctgggattataggcgtgaaccactgcacctggcccccaaaactttcaatgatgacaaattattccctgtagtaccattactattattctaccctttggcataacatagcctaggctgcatgttctgtcttcttcaaggaagtgtctatgattaggagaaatgcaagagggaggaacatactggaggatgattttatctctcgcacatatgtgaggacagcaacacctaagtttgctcactccaccctagtaaaacttcactactggcttaatccttgattcttgagtctcagtggggagtcattttctagtactgttgagagttatatagccctaagggattttatgaaataaagtgttcccaaggagtgttctagaagatgagtgatatgagttaataccaagggtttcttctgacagggagtgttaggtgataagacaactgctgaagattgaactgatctttatccagggaagttctgcacttgagattgtctttataggacaggcaacaggcataaaaaaaaagtgctataaaaataggtttgtttgtttcacagtatcattgagaaaacagctataaagaagatatataaaaatatataaatctatcatgtggtcattaaatgccagcgacttattgaacgatgatttataaatggctgaaattcaaagaattttcatggaaccaaaccaaagcatttcagaacatctttcgttctttcaaaattgaatcaactgttcttcattttacagcttctaaatattgtttgtgtgtgtttttgctgttgttgcacaggaaataatttttaccttaaaatattaaaaacttttttttctaaataataaactccatgcagtaaaaggcaacaatcagagagtgtaatgctagaacatttcaggcatgcccaaaatgcccatggcaggatgaaggaggcaacctcatggggcccagccatttgtcttgtaaagtcttaaactaccataggaaatccctgtaggatgttctattgtgtaagagttccatttaaaatacattggcaatatcctaaaaaaaaaagcagtgaaaatctaaactatgtcttgtagcttattcaaatctattattcatctactgcagcagccaacactgctgcatagagctaaaggagaaaaaaaacgaagataaaataagcaagagaatcatgactactatgaactgataaataaaagtgttaaaaaagcaataaaacaaaccaccagcttgttattgggctttcaaataggtatgtttccgcctcctcctcctcctcctgctccttctccttctccttcattcagaagcaatcatcataccacaagcaaacaaaccattttgaaggtgtttaccaggaatgtttccctcccttttaattttctgacctgagtattggtacaattttttctttcatcctttttgcaggcaaaggggttactggatgtgctaaaggaaagtatgattgtagagtgggaaaagggtgaagaacaatgttttatcttcttatgtcaattaggcaggacaaaagacacaggctcccaaaaataccttcagagtttgtcatcctggatcatgataaccttcaatatgttgaaagtctcgttcatctgggttcaagatcccacacttaacgaaagaaaggccgaaatttcccgtaatgttctttactttgggttttacaaaaacacttctatccaggtattttttcttgttgaaattctgaagtaactcaaggtgtacacatgtaatttaaaacttagctttgaagccgggtgtggtggctcatgcctgtaatctcagcactttgggaggccaaggtgggcgaatcacctgaggtcaggagttcgagaccagcctggtcaacgtggggaaacctcgtctctactaaaaatacaaaaattacccagcatggtggtatgtgcctgtgcctgtagtcccagctactaggtaggctgagacaggagaatcacttgaacctggtaggtggaggttgcagtgagccgagatcacaccactgcacttcagcctaggtgagacagcgagactcagtctcaggaaaaacaaaacaaaacaaacaaacaaacaaaaaacacttagctttgaaaggaaatagcctatgtttccacaaattagagttcataattatgttgcatttctactatataggacagcaacattttcacctgatctgagctcatctattagcctttccttacaaatttgaatcaaaactttcgccaggctataaatctccctataattggtagagagctagataagaattatcccataataagagtttgggagaaccttgtggtattaaagggatgctgacatggaatactgtatatatttctactgttaaattagatgcagtcctaatactgtttgtgaaactaaattaggtcaatgactcagagctggttttatttagagtgagctatatattaaaatgtagcaatatttcccttcttctgaaaagccttctggtaaggatttcaattcattgtagaaaaacatttcccaaattaaggtattttaattaagtcctggtaagaaattccaagcatgcttttttttcccctcctcaaaagaggccttccacattgtgcatttagtgtttactaagatttcaaatctctttggttctaaccagtatcacttagataacacatttcacttttttttttctcccttaagtgtaacctgggaaatcccaactttccctttgatgcactaagtctttggcatctcaatctgttaaaccagtgcaacaatcataacaggcattttctggagatgttacaagggatgaaaaaaaaaatgaatgaaatgagttgactttttaaagaacgatgccataagaagcaagacataaatttgctccagaagtcaaatggtgtgtggggagaacaggctttgaaatcaaatggaactggtttggagttccagcgctggcatcactagtcgtgtaaccctgggaaacagcctgagtacattttgtttgtttgtttgtatttttgagacagaatctcactctgttgcccaggctggagtgcagtggcacgatctcagctcactgcaacctccacctcctgggttcaagcgattctcctgcctcagcctccctagtagctgggattacaggtgcatgccaacacacctggctaatttttttttttaaaaaaacagagtctcgctctgtcacccaggctggagtgcaatggcataatctcagctcactgcagcctttgcttcccgggttccagtgattctcctgcttcagcctcccaagtggctgggattacagatgcacaccaccacgcccagctaatttttatatttttagtagagaccgcgtttcaccatgttggccaggctggtctcaaactcctgatttcaggtgatccacccgcctcagccccccaaagtgcttggattacaggtgtgagccaccacacccagctctgagttcatctctccatcactagaaatcagggtaatcatacattccttatcacattattaagaggactagagatagaatatgcagaatactgggcatgtagtatgtgttcaataaatggtagctgctattgttactgctactactacagctgctgctactactaaactgctgctattctcattgttactattatgactcctactattatttctactgccaaacaaggaggactgtggaaaaagaagccactttatccagctctaaacaaatgagttgttacctcactgtagcccacctttctagcaggaataggagaatgaccaagtgttttggaatcagataaacccaagagtaacttaaggagaatgataggaccatcgttgataggagagcctgagtacattcccagtgctgtacttgtgtggctgtgaaaattattgttccaaagttgaatattgtcaagggtgttgagatttatctcatggtcaatatttgatctttcaaagctgacctatacctaacacacttcaaattggttcagtgtatgtagcccttgttacgtggatattattgtgagcacttatataccagggaatgtgtcatgaggaagaattattatgtgtttggtatgtagtcattgaattaagacttccacataatgaactggaatggaattgcattagaaattctttttttcatccaaaataaaagtaaactcaaatataattatgatgttgccttctaatgtgacctgattgccatatctttgtaatgttccgttactcctgccaacctaatgtcagtgtgtactccaattcaattcagcaaacatttattgatcctagtcagggatgggaagacactaagattagcacaaagatacctttgtcattagtaagttactacccagtaaatctggctagtatattaaatctatggtcattttttacattttgcttttcattctaaacatgtaaaatgataataaaaaaagaaagtatttagaacagtaaaggttcaagtccaccccttttttcttcacctttttgtttagacactatttctgacgttaattaccacattaattgggtcttaagttccccttccagtcctcattatgacttccacatttcttacaactggcagaccttgctaagtcgtgaactataagttttttttaaaggttcagagcatttagtccagcaacacaaattaccctatggagacactatatacactagtagcaatgagcaaatgtttcttttatttttataattgttttggaaaatcatatgattgccaaagacagcctacacatggtcaagttggattcatcccagccttaaaaagtctgcgaaacacattaatacttgtgatgtatagagttgagggatgttttgttttgttttaacatgcttcttatatgtacattggtaatgtttaatttaggttaaaattctatgaatgatttaattgatattatccaggtttgttaaccattttaaatggccgttgattttgccaaattccattctatgccattagaacgctgtccacactaagttccgttaatgggggtaaaactcccatcatttgactcttaagtatggtaaaatagctgtctagaaataaatgaaccagagtcctggaaaatccagtggagatgcctagcaatgggggtccccaaagacttcagcgtaaggtgcttatcccttgaagcccccaccctcccacccttcctctatttgtttcttaattgcacattgttgttcagaaaattcacacttgggatttttatattttgtgatttgaactcatttttgcaatttcctttttacatttctagagagctgcttgaaatggatgctaaactacaattccagccttatgtgttaggaaatactttttctctactacaaagtgcaaagaactggaaactactttagtagagttttcatttaaaaaacctctatcgtacttcagtactggaggaaagaaaatgcttgtcaatcaacagccttgtgtttttcagtcttgatatatgtaattgatatatgatatatcaattatatgtaatatcaaaagagatggtgtgcacaaagcctgcctcggagtacattgaataatattttattcagatattcattttaaagttagtgatttcagatatggagaagttgtagtcaccagctgtgatttactggggggtggtgggagggcagggggacctattactggcacctgaactggtgatttctgtttacctgtaatccaaaaataagtaagtgtctgctaatttcacctgctaacatgtgacagcatctttccaggcaaagagtagaggtagccctgagagtgaggcctttcttttcggctcatgtatgggagagaattgtgttttttagcagagaaggagatagcttagacctattgcatttggtaccttccgtagaatgtcagtatgacaagtaactggactcttccagacagatctcaagagaacctgagtgcccattcaagagaactggaaaaactttcaactcccaggcagcacccgcatagctctgaaatttgagagcactctgcactctcaattcattcccaggatttgaaaccaaagtgccaaattgttttctcaaactctgtaggaaccgttatccacctactcacccatctacctgcccatttctttagcaaatatttgttgagactactatgcagcaaatactgtgttcggtgctttgaatccaatggggagggagagcaacctgggtcttgtcctaaggatgctttccttttaagggaattcatgagtcttttctgccctaaattgtctaactgtaagaagaggcagggagaacctcagtatgtgttactagagaacattggcactagtcgatttaattttcaccaaattgactatttggatgagatcctcattatgcacagtgcacatccaacttagatggaaccatctaaattggaataatagacctttgtgatctgtgactccacggatgaaatattgggtctcagacaatcaaagacagactgactctcactttgaagcaatgcatcaggctttataattaaactagtttagtcgcaaacttcttactatgaacctcaggacgttctgcaggtaacaactagaattatttgtgtggaatactaacagcccaggaaacagattaaagtcacaggcagaattctttagccttgttaagtacttggtgttaggaagaatatggaaatttcccagatcttgaaacattgtaaaggccctgggatatactatctaaaggcctgcaggcagtatccagaagtcttccacgatccttttttctttttcttttttgagatggagtctcactgtgtcacccagtctggagtgcagtagcacaatcttggctcactgcaacctctgcctccaaggttcaagcgattcttgtgcctcagcctcctgagtagctgggatcacaggcatgtgcaaccacagccagctaacttttatatttttagtagagatggggtttcaccatgttggccaggctggtcttgaactcctgacctcaagccatctgcccgcctaggctaggattacaggtgtgaaacaccgcaccgagcccaggtgtcttccacaaaaattagccaggcatggtggcacctacctgtggtcccagctactcaggaggctgaggtggaaggatcacttgagccagggaggtggaggctgcagtgaactgtaaccacaccactgtactccagcctggctgacagagtgagactctgtctcaaagaacagaaagaaaagaaaagagaagagagggtttgatttttttttggctattgaggaaactgtagctgtaaatagtgttaattctcagaaaaccagttaaatggtaaaattcaggagatcattataatcaactttaatcatgaagagatagttacatatgtggctcagtttctttttttgtttgtttggttttgttcttgttgttttgaattcagaagcagctttattttaagaatctcaatttatagtgaagtctcaatctctttagtcatcattatgtaaaatagaataacattgcaaagaaaaatcaaataaaagattaaaaatcctagggctagcacatgattgaagcaatattgaaggtcacagatagtataaattctctgattattaacagaggtgagctttgttatagggagatggatcattattaagtcatctgtctgatctagagccagccgcacgatctaatgatttcattcttggattatttttaatatgtagaattagagatgtttgggaagtgtttgctattatcttgatagtacagtttcctcctaaattacttttgtaaagtaaaataatgttacattggaagaaagtgtgtatttcttagtaatgcttcacaattcctcatcctacatttcaataaatcatcttatacctgtcagcacatgtagtctaagatttattgcatggtccattgtgaagcagatagctccttggccagagagcaatttctgaaactaatttaatcaaaatgtttttataatacagtgaactatggcttgatgtcttaaatatgcattgatgtcttcagaaccatatgattaaactctatccaattttgaaatggaattaagatttggcttcatatgacttctgttatagtcaggaaatctttggttgcattaatattatttatgtactgttattgagcaaacattcatcagtgcctctatttgcacagccaacccgctagatgttaagatgttgtgggggaacaacaacaaaatactagtttagtagaaagacgtaactgagagcttggaaggagcagtagacatggcacaatttattggccaaaaaggaatccagttttgctgaagttgaatgttcattttgcagggtggtggtaattatagctgccttctactgggaaagttttaaacctatagttttgatgagtttgcacgccaactcaggagtttgaacttcatcctttaagagttgaaaaattttggagttttgagagtgatgtaagcttactggaaagattacgttgacggccatgtgtggacccaactggacaaaaattagaggaatgaaaaccagtgattcatggaagattgttagaatggaaaccttgggaagaaaagggaaaactgaagtcaaggagtcttttaaaaaaacaactccccaaaatctttagagagtgattagatagaagacatgaagagcatagtaatatcttttgtaaagatcgaggccgggcatggtggctcatgcctgtaatcctagcactttgggaggccaaggtgggtggattgcttgagcccaggagttcaagaccagcctgggcaacatggcgaaacctcgtctctaccaaaaatgcaaaaatcagactggcgtggtggcacatgcctatagtcccagctacttggggaggctgaggcaggaggatttcttgaacctgggaggtcaaggctgcagtgagctgagatcacaccgcagtactccagcctgggtgacaaagtgagacactgtctcaataaaaataaataaataaataaataaagggaaggtggggagaaatttcaaaggaacagatgatgcatttaagacagttgagtttaaaataacaggggaccagcaaagctgaaagttggtattgaactgatagtgagagactaaagcttaggtcagagttgagatctgagatcaaaatctgaatcgtgtcaggacagaggatggagttaaagctgtgaaaaagaatgccattgctgatggaatatgtacatatgaagccactgttttattataattgtttggatagaacatgttctggtgggaaactcacttgcagtcaaaattgcacagtgctaaagtctgcctttaattatagtaaatgcattcgatttgagaatttgttcattacctgtatcagtgacactttattcaaataaaaacagcacactggagaaagataacagttgtggaaggccaaaagtcctctttgtgatttactatcaccatttaattattaagctgtctgatgtcatgtgacactgcctccccagagtgtcctatcacagtgatagacgaaggtcacagacatttggaaatcaaattataaaagtcacactaaaaagtcctgagagcaaagtttaacatgtttgttttcagctttatatattttctgtcaagctgaattttgaattttgaagaggtacactgagtccaaccaatggttgggggggcattattttttcatcataaacagatgagtctggatcctctgctggctggttgccctctccccctttcaataccacttaatttttttttttaagaacgacgtttataagtaatcaagaatacactgggagcaacttcagcatgactgtttttttgcgtgtgagagagggcacgttgtgaacatctgagttctatcttcatttttattagaaaaagcaatttagaactgccagtcagatgggttaaaaagcacagctgatcgaggtgcagcatccatgcctgaaccttctgtgtggcatgacattggctcataacccccttacaccttctctagctctctcttcagttctgcttcctgttccgcagtagagactgaaggaactcgggaaaggcccaagaatgggacctgattacaaagccttagtaagtaataagataacaaaatgtccacaagaaagggaaagtggggagagaagcagagcaattgcttacttcctacttagcttttcctctctttctgttttcccaggggaaggtgcccaacaatttgtatttttaaccggctccccaggtgactgctgtggttgggccaagctacattttgagaactcctggtctaccttctagattctacagaaaagatgagactttgcaatttgtaattgttataactggcaagtctccttccacttctgagtattggacagttttctctcactggattaaaagcaaatggcttggtttttaaaagtttttgaaagtaacatttattatttgacttccgctttagcaacacgttgtatatgtaaactcaaatatagttcagggaactgagagctagttcacttccaaaatacagtgacccataaattgtctttagtcatgtataaacaaatgaatgctattgggaaaatgccttagtaaatattttttgtaaaacacagcaaattaaatcactttctagaaaatctattttttttttccccaggcaagtggccatcaatcaaagaagcagaatactaggtgtggttttctttgtttttgttttgttttgtttgaggcagtgtctccctctgttgcccaggctggagtgcagtggcacgatcatggctcactgcagcctcgacctcctgaactcaggcgatcctcctgcctcatcctccggagttgctgggactataggtgcatgccaccacgcccagctaatttttaatttttttttttttttgagacagggtctccctatgttgcccaggctggtctcaaactcctggattcaagtgatcctccagccttggcctcccaaagtgctgggacaggtgtgtgtcaccatgcccagcctcagaatactttatcactttggtttccaaatattgggaatattttgcaatttaccttttagactacacaaggcttcagggcaatgctcttgcctgagttgacgtttgaaagtgaatagagctgtaaatctattcttttgtcgtcagaatttttttaatgtttttcctaaatatttaagttaaatgtgttaaaatattgttgaatgataaacatctgtagtacacttctgttgtgtttctggtgaaagtaactactgttaaggtcaacagaccaaatttgtatacaaatgctttggcaaattagaaattgaggtgaccattcagtagctctttttaggcattgggaatactcgaatgcaagaaagcattcccttatattttcaagtataaaaagtcctctaaattccttaacagcaacaatcagtgtttccccgctaagcactgttttaataaagttgctgggattttctatgataaaatcacataaatttatacttctacatacatctatatataattttattcctgtacttgttatatacatataagctgcattacaaatatatttttattctgaataaatcctaaagtataaaagtagtaaattgaataaattattgattttccttcactgtatcacagaacctgtttctccattttgagcaatggttctcgaacttggatgcacattggaatctcctgggtagctttcacaaatcctgctccctggacctcactcaggcgaagttatttatactctccggttgggaagggaggatagatccaggtgattgccatgtgtaggccagaatgggaactactcccctagtagacactcctcatcttctttccttccatgatttccacatttctttcaactcagtcgaaatcatcttgaatagacaaaggcagtgtcggtcctactaaaggttgaggaaatggctgagtaaagatgatgaagtcagggacaaaggatgcaatgaattttaagaatttgagattcaaacttcaaaacttaggcaagggtctgtttttgaaggttcagagctgaaaaacaatggcatgctttcatattcttctttgattctgtaggatgtcccaaatggggaattctcttacataatattgattttgtaaattcctgacagatcgtacccactttggatggaatggaattttaatctatttttttgagccaaagagtgtgacctcccttggccttaaatatttttttgtaccacacatgtggggatatgagtattgtgaaagctacgaacctttcctttgaatgccacaattcaagaacaaagctgatcatgtattgaattttaataatcattttcagcagctggtccagaaaagggcattttcctctaaaacctaaaaaattcagaagataaattcctatagaaaaaaaggaaatcatacttatctattcaaaattattagatcaaagactttcaactattttagcttcaaatatgtttaatatattgagtttaactgacatgaagtacctgcaggatgcgtggtgctggcttagaaaaagatttggttttcctacagtatctgaaaaacaaaaatgtattttcatccatccaaggctaagcatccactatgagactaatttgacattcaggtctggtaaaaatgtttgatggtatcagttaaaaccctgttgaagtaggaagaccagaacatgttcattagtgagtatctggcaatgttatcatctacttaagatggaagaaaggggataagatcaaaattattcaatccctgagtgatggaggaagtaaagcttgaaggggcctatacagacaacatgtatgacatccatcagtatcaggggattttatagacattaattatctagtgctctacaccctccctgcctgccttttaaggtgtattttatgattgaggaaaaaaaaaaagaccaggataatagaattgaggaagatagcaatcaatgagtaattccttatccagtcggcacttaaaactcaatgctttatatatttatttgcagagtggtaggaactaactaatcctcatgctgtgccttccttactcacttttgaccatgtttttgctatagcaaccttgatacaattgaagattgtcatttcttactcttcctcagtttgaagctcctgctttcctggacaaaagacacaaataaaacaggaatttattcaatcattgcattttatccataatttaagacatcttatctataatttttttctgagttaaaatttattttggtggttaacaaaaagagtctttagaattttgagtacctgaaggattggaatttgaggcatcctcctacactcccatagtaggtgttgaaaatgttaagttaattgaattatattgaaattttaaaatggcttggagcaacagaaaaaaaatgttatgtataaattaattaaaaactacatggactgtttttttttttttaccatccacatggataccagggatttcttttctttctctttctttctttctttctttctttctttctttctttctttcttttctttctttctttttctttctttctttctttctttctttctttctttctttctttctttctttcctttctttctttctttcttggattattaaaaagagaaggttgttttttaaataaggaaaacaattttctgcaaatggccagatagcagatattttggtctttgtaggtacaagtcctcaactttctcattgtactgtgaaagcaacagtaaacaatactttatggctacagaaatgtgagttttgtatacttttcatgtgtcataaaatgttattcttttcattttaaaaaaaattatttaaaaatgcaaaaatgagggcgggcacggtggctcacacctgtaatcccagcactttgggaggctgaggcgggtggatcacctgaggttgggaattcgagaccagcctgagcaacatggagaaaccccttctctgctaaaaaatacgaaaattagctgggcatggtggtggcacatgcctgtaatcccagctactcgggaggctgaggcaggagaatcgcttgaacccaggaagcggaggttgcagtgagctgagatcgccccattgcactccagcctgggcaataagagtgaaactctgtctcaaaaaaaaaaaaaccattcttagctaacaagccacacaaaaacaggcggcacgcaaggtttgaccagtggaccaaccatagtttgccaacctctggtttaggacattgaatatctcctgatttgaaagttttcacttgaacaaaaataattaactactattagtctgttctacaatatcctcctcaccatgtaattcttaactggcaagtagattgcctcttttgttttatttatttatttattttaaaagacagggcctctttctgtcccccaggctggagtccagtggtgcaatcataactcactgaagtgttgaactcccaggctcaagcaatcctccctcctcagcctcctgagtaactgggattacagatgtgtaccagctgtagtctacaaatttgacctgtacccaatccttggcttaatattaatttttaatttttaaaaaagtttttgtagagatgggggtctcactatgttgcccaggctggtcttgaactcctggtttaaagcaatcctcccgccttggcatcccaaagtgttgggattacaggcatgaaccacagtgccctgcctgtggcctcttttgatattgctatggcagcccagagtactgtgttgagaaggattcagaagttgaacaagggcaaatgagcagagagggctgccagagagttgcccaattggaccatccacagctcttctagctgtgttatagtcttacaaaatgcttcctttatgtcctgctgataaaagttatagacttattcttagaagcatttttctgcaggcataaattttgcaactgagatcattgtttttaagttagagaatttgaaaggattctagtaatatagcttcatgtgatatccattctcaaaaccaacaaatgtatttattggtcatttgctcacctctcttattataggcagaaatggggctggggaggaggagtgaataaaaaaggccattcacatctctaatacctggaaataactagtcgtcattggatctgctaaaattataactaaatgaatagaactatactaagatacctatttatctccattaaaataaaagctcttctagaccatacacagtatttaaaagttgttctctgtatgttattgactaccaggttagaaaaataaacactgaactcctaatgatggaatttataaatatatggaacagattctgtggtgttaatatagaaatttcaaataaaacctgacaaggtaaacactgtatcacatatcaaaatgacttaaattgtagtccatggaatactagacttaaatttatatgcagattgtattttattaggtttttgaagttccctcggcggcctgtcttgccagggcatttggaaatggtagctattataaccaatgaaaaaaatgcattaaaaaattaaaacaacctaaattacatgtatttgcggtctgtcgagtcaaacctgaagatagtctcagcctcctgcagtgcaattaaaacatctttaaaatttagttacatataaagaatttatgcttttatacaagtggcatgtgttaatatgggtgtgttttcatattaactattgtgattaaagtttcttagaagaaaatatatgggtcgtggcacttgacgtgtccatatcctgatcacgctggagtggtggtgttgggtgccagggctccgaatacagttgctgaatgtcactctgaatattatggaatgaaacaagccagatctgtgtttgccttgaaaggtatccagacctaatattgtactttaaagacattctgaagtattgacttcggaataagagcaagcattctttaagtcctgggcaaacccaaaaggaattactgaaatctcctgtttcaagcatacattttaatagtagtgctcaatgacaagtcattaattccctgcaacctgactcttaggttcaggtctccaaaggctaaaattaggggcatttgtctgcttcccttgctatttgattgggtatcactgtatgtagaagtacaaagctcatctgttaagttggatttactattctctgctggtgtccctatccatgcctaaaggctcatattgagattggtgtaaaatcagctgtcccaacatgaattgttcaattatcagctcaaataagccttactaaaaactacctaacatgaaggaggttgactgtggctctgtgaagatgcatccaaaatgtgtgcattaaaaataaaaattataagaaaaattaatcaccctttttgcataaagtatgtaaggaagcctcattctttaagcaacacatgttttataactttgccttccacaaatttgacctatacccaatccttggcttaatattaagaaactaaatctgcccacaggtatccttgccttttataaggaccattttgaattatttgtatttcttttctttggtggtagtggtgggagggtagtattgaatgccaccaagtcgtaaacctcacagaataagagcactatgaaaaaatcacttggggaaaaggtaatgaattaaggctgggagcaacttgactttgggtttagatggaacttgaagttgatgtgttagtgataattgctatagcatctctctatttttataaatcccggtttggaaaaatttgtttgataatgttatatttgccttcacaggaatcctgtgctctggacagtgttatataacattcctcaaaaattcttctaaactctcaaggccctcttcttggggtcagactcaacggtaccaatgagaaaagcctgaaagcatggaagacttctgttgtttagcaaagctgagagaagacattgtcttaactatctacactagttgttaaattaactaatcagttgatttactacattggatttcagaagggttgtccggtgaatattcagttttccatgctaattggaaatatcattgcatatttaagggtgtacggtgggaagggactaagcaatgatgggtatacagcaagtactcaatacatcctgtggctttattatactctctttttgctggtagaattttctgctacacacatgcattccaggcaaagggaagagactgcgcccatgctcagacccagaaacaagcctggatccataaaacagcttgttcacaatggcaggagcacagcacaggagtggggaaagtagaggaaaagaggtatgagtaatactgaccacgaaaggaaagggagttgcccattcaaactaacagatgagaagggcttcatggacgagatgacaacaaatagtagcattagcattcattgagatttaggacattgcacaacattttagaaatatgtacacttagtctaaaacagggacccgcagtccagatgggaattctgacaataatcacatcatgagaaagctgagcaaataggattcagtgtttttggaaaatgtaatcttagggggaaatatattcttgtagctatgtactactaaattgaaaatctacagaacaaatcatttatgaaatgtgtgggcatgcttttaatttggtggtggtttaaatattttattaactgtatgggcatgcttttaatttggttgtggtataagtgttacaaattaagctttttttaaaaatcagtctaaactcgaaacttgaaaaacaagttttttattttatttaacaagcaccgatacaacacatcgtgagccaggtactcttcctagggcttccatgtatctcctcctctaatcatcttgacagccccatgaggaaactgaggcacagaggttaagaacttgttgaaggtctcagagctaggacttcaaaccaggcagactggcaccaggttctgtgtacttaaccattatgctccttaaattagaatatctacgagtcaaaatgctgtttaattttcttcagattattgtgggttctgtcaagctaagctttctgcccataagtgaaagtgctcttagcatcttgtacagaaagaattcttcctagaggttcattgagtggcatctatttcagacttacacaaaaagtttgggacaaatgttagtgtttaacagaagcagatgtttatcagtggcccagacaatattatcattttgagttttaccttctaggctgggggcgtggcaaacaacagttgtgggtcaaatctcactcaccacttgttttggtaaataaagtttcattgaacacagtcctatccactcgtttacatgttatctatggctgctttcatgctaaaacagcagcagaattgagtcattgtgtccaagaacatatggccaataaagcctgaaatatttactacacgatcttttatagcaagtttgccaccccctgttctagaccagtgaggtagccaccagccagatgtagctcccaagtgtttgaaatggggctggtttgagttgagatgtgtcataagtgtaaaacatatcagattccaaagacttagtaaaaagaaagaacaaaatataaaatatctcatcagttttcaaatattgattgcaggtggaaatgacaattttattaaaattaacttttcttggttctattttttttaatgtgactactagaaaaatttgaaatgtgactcacatttgtggctcacattaggtttctattgatactgctgatctacagcctggaatttggaggatatgtgacctctaggaaaagcagaaagaggaaagatggggaaagagagaaaacctcttgtatttgcaaatgtctttctaaagcaataaaatattttctgatttggctcttcctcacagaaaggcatacgcaaaaatgggttaggtggtctatggagatgatcgtagatgagttctcccagaagcagactctgactcagaatttgaattgggaggtgatccaggaagcacctggagggagaggggatgcaaacagggaagagattgaagaggaaagagggttaatgagcaggttgttgctgtggacccatgtgctgcctcccaattgcgccctgtgggagattttgtagacagaggctcagagtggttccacccaggaggtgaaaaagctgggctgcatatccaccaattgccagtaattgccacttgagggctgctcctaggaacatcagcttcttcttactctccccagcacctgccttgcctgaagccaggtaaggccctggggtgaaaaggcacaggtgcttgcaggaaaaagccatgagcaagctggagaatggtgcctcccagaggcacagggttgggcccttctagtgtctggaactgtgtccaaactaaatgttccatcttctaattcataatttcaacagacattcatgtagttctctggtgaatgtgttcattttctcatttgatcttaacaatagtatagataggtagatttatcattatccatacattatggatgggaaaactgagcccaagacacatccagtcatttgccgaagagagtccagctgggatggtagtcccggtctcctccctcttcatatgtggtcactgactccttggatttctacaaaacttgccttgagtaaggagatgtcaatatattgatgttttcaaggtgagaacaggaaactaaaaccaatttttcttgtgctctgtagaatttttttagatatccatagggcagtatagaaactgatatctacttaatcccatgacttttatatggaaaagtatgatctctgttttgcacaagtcacaatcaaaatcaagagattatggagactgctgaccactaccacacaggatgttagtgatagagttaatttccagaaaatcttcagagaagtccctgtagtggaagcttatgggtgcatggctcattaaggactggattttgttatcttcccattacccaggttcccttcaaaggtgttgtcagcccctttggtaccacttggaaacaagtctctctcccagcttaatttccctttattatgcttctaactgactcggtaattctttgcagacttcagtaacacttgtactatttaaatttgaataaccccaaaggatctggataggtcaatgtgtttaaaccacaggctttagtctatgtattagttgattaaaaacagatttgatgcatgatgtatacttaataaagggagggggaagcaagcagatgtttgtaaaatctcaatgtgttggattgcatttctttggccctcttttgctgactaactttagaaaagtcatacttatgacaattgaactgtaaacagttagatgatgtatttccctagaaatttcctgctgtgaagggtcagccaaaaagaaaagtatcccctagtattaacataccaaaaaagttgacaaatatacgttataatggttatgtctatatcaaggacattgaagaatgggatgcttcaaaatcatcctctagtctctgaccataaagtgattagcagttgcgattcatttaatccaaacaataaaaaaaaaaaactttggcttttgttgttgttgttgttgttgttaaaagcaagtttttctttgatgcaagcataagatcaagttgtacataaatcactgtgtctagttcattctctgactcttcagcctcttgtatcccattctttaagtgaaaaagttattcttcccctttaaaattgtcatatttgaaatgttttgagtgattccaagacagaattgaaggtttcttgttggttttccagtccagatgaaatgtgcacaaagccttcctctgaagtttgaacacatgagaattacagataaaatattttaaaatgtattttagtgaatacataaccaagcataaacatatgtggaaagcctccaaggaccggaaatgaaagaaagtgtagagtggtgagagaagactgacactgggctactcccaagaagtggagatgacatggggcaatggtgacttcagtggacacatagggaagtgaacatcacatgtggcaagagccttgtacacctggaggccaagacccccatgcatagactggactcaaagggaacctgacatcttctctggaattgaagccagacacagaactctcatggaaggaagcagaggcactgagtcaaactaggatctgtgcctctgttgcacacgagtgccttgtgggagcgtcttctttgggaaaagaacctcacgccctaacctcagaatatgcttcttatctggctgggctatgtcaatccccaaatcacagcacagggaacaaagtttacatcgtatgagctgtcagacaaaaattacaagacaaagataaaatcagatccttgagaaatagtcaacaagcacagggaaatacagaattgccttttctcaaaagagcttaagaataagtaagtttagttgttttgagattatggagaagagaatcgtgtttttgtaataggaacagagagaaattcaataagaaaagggagatgtgataaagaacctactagaaatgaaaatgcattcattaaaaaattttaaaatcagtcaataggataaacaccagattaataagtttaacttgttttaaaaataaccagaaagttctgcttttgacatatgcattttaagccttagatgaaagtggttcttttccttaatatacttttctaaataaaaaatttagggaagtagaatgagctaaaattttcataaataaattttacagcataatgaaattaacacctttatgaacttgttagttttcaaaatccctcaaactctttctaaatcctctttcttggatggcattataaatttgaggtctgttttcttttccatgaaatttcctgttgttccgtatctttgccatacttgtggaactgtctatatgctaaaacacagtttccctaatcttttgccctctcaacctctctgatgttggcatacgacattgttctattccctgcccatggaagattcttccacatgctcacttctttctttccaagaagtttccactgttgtgcaacaaaaaacccctggacatccttcaagcctcagctgcaagacttggccctcttggaaacctttaaccagcagccatcaactctttcccttctcttgtttgcagcatctttctcccagtttgtacagtcatccatttccttgtggacagggaatagatattaatatttttatttgatttccccactgtctctttcagagtctggcatattgtagaagcttaataagtacttgttgtatgaacacataagtaaatgaatgaatggtaggaacacataagtaaatgaatgaatggtgtaaatcaagcttgtccaacacgtggcctgcaaggccacctgcagcccagaagcgctttgaatgcagcccaacacaaattcataaactttcttaaaacattatgagattgttttgtgatttttttttttagctcatcagctgtcattagtgttagttattttatgtgtggcccaagacagttcttcttccagcatggcccagggaagccaaaagattggacacccctggcaatcaagagcatgtgaatgagaaggaacagagaaatcttagtgagtcttacccagaacagagagctattgtgtttgaaaataggattaaatagtcattccagagaactttaagtttgatgctctaaaggaatagggaataattctagagtcttatgcaggataatgagtggtaaatacagtgttcaaagaaatttgatctggcattgatggacaaagaatagaagcatgaacaataaaatgtacaattgtttgttggtatccataaaggattaatttcagggtctctcatagatactaaaatcatggatgctcaagtccctgatataaaatggcctgttatttgcatataacctaatcacatcctcctgcataccttaaattctctctagataacttatattacttattacaatgtaaatactatgtaaatagtagttatattctatggtttagggaataatgaggagaaaaaagtctgtacatgttcagtacagatgcagtcatccatttttttccaaatatttttgatctgcagttggttgaatccaggtatgtggaacccagtggatacagagtcaactccactacaactgaccaaatgtgtgtgtgatgaggacttatcataaatgtctataaatgaccttattgtcagcaagagctaaacaattcaaaccttcctccaagggattagcctcagcctgcccataaaaggataaatctgaaaaatccaatggtagttgatttgatgtgggaatatattccttatgttattgccagctctgattcaagtaaagggatagaaatccaattacctcctttcttcctaggtcgtgacctagagataacctataactaattattctgttaagtatccctgagttagtgcaagaagcaggaacaaaaagaataaagtctgagcgtgtctaaaaggttcttttaaatgcaacttttgaaaatccagtttaaatctataaatacttgaaattatgtcgatttcactaaggtttctgaaaaatgtatcagtttttcctgagaatgagtaattttgtgtatctgaagtataaaagtatgcagaataatatttttcctcttttttttttttttttgaacagcaaaacttagagagtaacctcaccaaccttattaagaggaacacagaactggagacccttttggctaaactcatccaaacctgtcaacatgttgaagtgagtatctctgtatttctgtatggtatgtttcatatgaaaactgccagatcaaggttttgatatcctcatgctttataattttaaaacaagaatctttcttaaaattaaatattttgcaaaagccaaaataaaagatggaggaaattaaaaggaattagaacttcagagagtctttcccatccagggctgcttcccattcccattatagctcttcctgatctagcattacatagcagtcctaatgttggagattttaattgcccttacaaagaacagtcaaaaaaggtattgtaggccgggcgtggtggctcacgcctgtaaccccagcactttgggaggccgaggcaggcagatcacgaggtcaggagatcgagaccatcctggctaacacagtgaaaccccgtctctactaaaaatacaaaaaattagctgggcgtggtggcatgcacctgtagtcccagctactccagaggcggaggcaggagaatggcatgaacccgggaggcggagcttgcagtgagctgagatcgcaccactgcactccagtctgggcaacagagggagactccgtctcaaaaaaaaggtattgtattagtgtactatggctaccataacaaattaccacaaactgggaaagtatgaaacaagactaatttattctctcagttttggagactagaagtctgaaatcaagattttggcagggccatgctccctacaaaggttctaggggaggatccttccttgcctcttcccattttctggtagttgcaggcaattcttggagttccttggctttcagctacagcgctctaaacccttcctccgttatcacattctcctggtgtgtctctgaatatgtgtccaaatttccttattgttataaagagcccaccctactccagccttacctcactttaacttgattacatctgcgaagactctattttcaggccaggcatggtggctcacaccctgtaatcccagcactttgggaggctaaggcaggaggatcgcttgagctcaggagaccagcctgggcaacatggcaaaaacccatctctattaaaaaatacaaaaaattagccaggcgtgggagcacacacctgtggtcccagttacttgggaggctgaggtgggaggatcacccaagcctgggaaatcgaggctgcagtgagctgagattgcaccactgcactccagcctaggcgacagagtgagaccttgtctcaaaaaagaaaaaacaaagattctgttttcaaataaggtcccatttacaggtaccaagggttaggacttgaacatacctttttgcggacacagtttaatgcactgcaggtgtatattaatgcatcttagttgtcagatatgtttccatgaaataaaccacaattgcaacaacagcagaacctgcaatgactacactgaataaggaaaaaatagatgccacttcctttatgtgattttcaaattcctcttccatcttctcccaaactgtcttttttaccaccccaccccatgaactgaaactaaacaattatcattcattacacttttaagccttctggcccttaaccaagcagttccctctgactggtaggcccattcctctaacccatgtctatttgtcagaatgcttcttgtgtatcctccaagtcctaagtcaaggggcacttcagttgtgaacgtttctctggttccctggaccagagtcatcgctcctttctctgaatcacgtaacattttatgataccgtgtatgtgattcagagaaaggagagatgtccccgccccaatctcatgtcgaattgtaatccccaatgctggaggtggggcttggtgggaggtgtttgggtcatgggggcagatccctcatggcttggtgctgattccatgataatgagtgagttctcacaagatctggttgtttaaaagtgtatgacactcctcccccaccgcccgcccccctcccatacacactctttctcttgctcctaatttcgccatgtgacgtgccagttctggctttgccttctaccatgtgtaaaagcttcctgaggcctcatcagaagccgagcacatgcctggtgccatgcttcctgtgtagccctgcagcacccgtgaaccaattaaaccccttttctttgtaaattacccagtatcaggtatttctttatagcaatgcaagaatagtaataatcttctcatggctttatcattctttcatgtaccagttccatttttccaaccagaatgtgaggtcttagaggatgggaatcaaatctaattcgtctttgtatctcacagactctgatgcaatgattttcacacagtaggagctcagggaatttgttttagatgaatttgcatgatgactctccaaatggcaaattttgaacactatttgaatgcctgcaagttcagctcccctaaaatatctaaagttggagaagcaaattattttgagcaggcatttaaaaattttgacagtaactccatttttgcaataagaattccttcaagtccctttgatcgtctacgcagtaattataagtttatagcctcctatgtgcctataactgtcagtagatgcacaatgtagcaaataataataaagattacaatatgttagagaacagtgtacacacatataacaacatatttaaagaacagtagagtagccaatcaggtgctcagctagtagaatattgcatttatggattctaagattagcatttttttgaagactaatattgctgaaattgagctgcaacttaaatgaatggtgagacagtttaatgggcaacatttgtttgttcctactggcacacaaaatatagatgagacagttgctggtatcttagattagatggagtatggtttgagaaggggggattaaaagagaaaaaaatgcgaatacaatttttctgaagctttgtggaagagtcaggacttgagccagttcttatagatttcacaactattatttttcagtaccctaagtattgaggtgtcagcttatttatgcaacacaatgatgtttgtcagtgatacattcctcagcatagcagaaattagcaaagattgctttcagaaagatcctatcagtgtaaaagcatgtctactatgcaaatactggtgctttggtggaaggcttaaaatactttgtgtttgtaaagtctgtgcttttacttacaagtgctccccttgtgatcagaaatgtaaaactggttactaagagaaacacatgagttagcaactttttccaactccaaatttgttgtgttttccaaggataatatccagggagacagaaattagggatgttctcatctcctacctaagccatctactccagctgttcatcatttgaggtgctgatggaggttatgataggtggaagagggaaaggcatacaaaaggaaagaaagggaggaatcagagtaaaacataggtgagagagcagattaggattgtccagtgagcttattggttcacttagtagaccctcttgctttaaaagctacatgattgtcagggtagaatcagtgtttcatcatgttgagatgaagttgagagtgtgaaggcagcagtgtgttgcagaatccagaccttttgaaccctctgcttagactggattctcttttggcaagcctcttgccagggaacatgttgagccttgttgattaaacaacattggaaataatagtgaacaagcataatgttttcattattatagggtaaagttaatatgtattatatgaataaatggatgaacaaaatggaataatctgtgtgccatattttatttttatgatgtgatggcatttgatgtttaggatagtaagaaagaattatttctcttcagttaaaaaaaaaattacctgagctttatggtaaatcttataaatgctttatggattgggtgattatgtcattcaatttcagctagttactccttaaagcattaatgtctggtttccattatgacctgttgtgatttcagaacaaatgcattgcttctaatgcaatattattatggcttgaatttacaagacgctattcatcctaacatgatgtaaaattacattctaagatgttcagtaatttcaaatgatagataaattgaagaaatttacagggagattttagttttattttaatagatcagatatgattttagttgcaatacaggcttttcaaataaagctattactgaattgattgtagtggacttgcatttacaaggaataaagaatattcattcttttctctgttgtttttgtataaatccttgggaatggaagcacatgtttatgggtgagtaaatttggtatttgggaaatttattctagataaaaattaaagaaaattatgagtacaaaaataatgatacttacagtacttatttttacgtttgtttttattcctaattattagtattctgaaagtataattttcaaaagttgaacacccaattctcctataatgaatgaattagtccacatcaaagatttttttaacttcttaatgaaggaaccagcaagatgataaagctgcttccaaggaggatgccagaaacggatacatataaatgtggggaagggggtagtagggggaaaagaatgccagactagcatagctaatttggatacaaaactggttagtgacctacagggcaataaacctgaaacatttggacaaaataagttgcatattactgggtttctctaagttaacatctaacttcgcagagtctaagccctaaccactagtaaatagaaagtcagactctgttacatcccagtctggagagtcagatgaccctgacttaggctgacttcatggaatatgctctcgtgggactttggaagggctcacagtcttctctttctcttttttccatgttttggataattttgcttaacatgactttctgttctagagactgttggtctaggagcagtgtttgctaaacaaatatttctgggaggggatgtacatttttgcctgtggacagttactttaatttgttacagtgtcttgctagtttgttcattttggtagtgcggttggagtacccactgtgtgtgtgttgcactgtgttaggtgccaaaggaccctgcccacaggaagtttactatcttcactaagacagaagagcacttataacacaaaataaagtagaaagccataattaccatgaagaaggtgtggattatctacttcaaactttcagagaaacaagaaattatttctagctggggactggggaagcagcgcaagatctgagcctgccttcaagggtaggtaacatttgagtttatggaagcagcactgcttgccaggcaaataaaggcatggggatagaaagacgaggaatgtatgtacacaaagcaagtagttcattctggagaaatggaaagcatggaagaaggaaggatctgtaggaactagtttgggagagttgagagctggaaaggctttcgtgttgcatctgaatttgaactttggttttgaaggtttagtgagggttcaaggaacacatagacctgtgtgagtttcacagtgacaactggcatttccaactcttttcaggaaatgacatttttggttattgagaaaataatatggatattgtcatgcaaaacaatctcatgtccaagggaaaccttcacagcactaggaaactccaaaaaggccatggagtttgttaggcaccagcatgctattcttttaaatcagtgcagtggaaaagaatttcctggtccacatccttggttcctagatggtacttcttccttttcctcttcctgaaggtgtccttgtatttgggtatgagcattccccgggaaaataattcccatgccagctggagctaaaaaaaactcacagcacagaggcacctcctaattgttgtaaattaaatcaatgaattccttcccacgacccatgaggaaatgccacatccttataagtccacatctcttcccagggatttacctctgcttttcttcagaatggaaaacagtttgaaggttccccttcagccacccaactctccccacccctgccacattgttttcataacttgttttttaaatgagggtaagcaaatgaatggctttttgattgtaagtgccaaacatttttaaaacggtggataacagagaatggcatgctgtggctcatgcctgtaatcccagcatactttgggcggccaaggcaggaggattacttgagcccaaggattcaataacagcctgggcaatacagtgagacctcgtctctacaaaaaataaaaaaactagacaggcgtggtggtgtgcgcctgtaatcccagtaacaaaggaggccaagactggaggattgcttgagcctgggaggtcgaggctacagtgacccatggagtgcaactgctctccagcctgggtgacagagtgagaccctgtctcttaaaacacacgcgtgcgcgcgcgcacacacacacacacacacacacacacacacacacacacacacacacacaagagcagagtatgaaggccaagacagtttgggactcaggaggcagagacattgaaagagcaacttcaggccaggtgcggtggctcacgcctgtaatcccagcactttgggaggcccaggtgggtggatcacgaggtcaggagatcgagaccatcctggctaacacggtgaaaccctgtctctactaaaaatacaaaaaattagccgggcatggtggcgggcgcctgtagtcccagctactcgggaggctgaggcaggagaatggcgtgaacccgggaggcagagcttgcagtgagctgagatcacactgctgcactccagcctgggggacagagcgagactccgtctcaaaaaaaaaaaaaaaaaaaaaaaagagcaacttcaggtagactcctaagaaatgtttgtctaggattgtaaaaactaatgggttttcaaccactctattttgttttcttcaggagagaaataaggtagaatggatgagtttgtagttacactagacaagtttggagttaattatatatgtagtgaaagacaagcttatgagaaatgatcaaaatttgggtcacctgtagaacttaacttttctaggtcagataaggactgtatctcttcatcacatttctctttccattttctttgaaaaatcagaagacacagtttattagctaagcaaacacttggaatcactgatatgtaccaaattttctgcacattccaataatcaagttcttttacagcaaatacaacaccttgacacttaatagatgttcgttttggaaatgataggtgccagtgactctaaagatgatggccaagaacaactgggaaagggtggccaattgccataatggtttcaagaggataaaggctcagcagtccttaccattcttgctcaaggtcatcctagaagggcattttctaatccaacatcacttcaaagttccagcattggcccctttggtttatcttgccttgtttgtaatcacttcttaaaattctttttgccattatttttctcactaagtttttaatctatctttgttgttgttttattttaatggaaagtttgctctcatacggctttctctgagtttctccagtgctagttgtcatgtaaagtgacaaggttcttgtggaggaattaaggctgtttaattagatttctgctcagatgatgagttttgtaaattgaaaaggatgagagtgaggtgttacttgggtgatatgtaccttgtaagaaattgtagaaaatcacttggcaaaacagatgggagtctgtagaagacttttccagtaattcaccaagccctaaaagcattcatttgtaaactttgaaataatgaaaaatcactgggttaaaaagaaagatgaaccatttgtttaattttgttgtgcagttttgtaatgccaaagcattctctctccgtagaaaacttggcaatggcttcatccggagtcattggatgaagaccagcatgcaaacaccaaacgagctatttgtgtcttgtgaacgtgtgtctgatcttggatgaagtatatcctgctgggggccgacatgaatgtccaaagttataatccattttcacttgcagatgagggtcagattcccacccgatctgaccccctgtgagaatgctttcaaggtataattagagtcagattctgggcctcattaaaccacatcatacaacccacagtcagctctggctctccatgtaataggctctagaattatgataatgtgatagtgcaaatatggtggctttcagaaactggattatgacgagccactataataatggttgatttcccaagttcacgtcttaggattcccatgacaaaggagaaaagaactgttggtctgcacagaaatttatcatctctggagaagatttgtttttactattgcatttgaataatgtctattcatatgcaatagtaagacagttgaaacagtttactctaccaagtttactaaaattgacaactcatgaagcaaatgtagtttttcttggtagaggttaaatttaattattaaagtatctaacacatacttgaatgtctccctttggattcagtgcccttgacttagaaaaatttgattcataacaggcattggatcctgtttctttcttgggcatattcataaggagtaatgagaagatatcagcaaaaatctttgagtattttggaatgagattaatcttatgaataaatgaatataaggcttagtaagctggtattacttttagaatgacattcccaagtttcagttttgaaactttatataaaacattatccaaacctttcatcgtctgcaaatctttctagtttgggtggtatgacctattgcatcatatacagaatcctacctagtggctcagattggagtatgaacacttgtacgtgcctctgaagacaaaccctctaatgtttgaatttggtagtgcagatttccaaggttaatacttaaatgtgaagcaataggccttaattggaggcccaaaggctgagcattagaaagttagagagaaagtgtgcttttttctgatatatcttattgtgctccctccctccacacaatacaagaattccttatcctgtctccattacagtattccacacacaaccttctttacctggaaatatttacttgcgtgattgactagagcagcagagatgtttctggcatgatataaagaataataggaacaggtagtgatacattttttaaaatagccattgttggccaggcacagtggctcacgcctgtaatcccagcactttgggaggccaaagtgggtggatcacctgaggtcaggagttcgagaccagcccggccaacatggtaaaaccccatctctatttaaaatacaaaaattagctgggtatggtggcaggcgcctgtaatcccagctgctcgagaggctgaggcaggagaattgcttgaacctgggaggcagaggttgcagtgagctgagatcacgccattgcactccagactgggcaatagagccagactctgtctcaaataaagtaaaataaaataaaatggccattgttatttctaactcaacttttatatgagatggtcttagctggatggtttcaggtgaaagagtcagaggggaatggaatgattgcaggtgagaaggtaactctcaagtaaaagctttggttcacttattgctcccattcatgacattcagaaacaagaataatcctaacaatcaatccaccattttgttactgaaccaaccttttacttctgggtctaatatctagtttaaattatttttctcaataaatgaacataaaattgtcttccaatgacaatcaagttgaaattatctctgtgtataaaataattacagattatgaaagaagccagacatatcattttttacctgattcggttgacttctatttttaatttgctaaattaaatgttgtaggaaaaaatgaagagctttgttctaattttgaaattccacagcaaaataattgagtcatgcatataaaatgtccgttaacaagaagacaattgtagtactggttatttttgtttgaaatagaaatatgaaattttaaattcagctatttaaaatgcccgaggctaccatggaatgtacaaggctctcagtgaggagcaacacaaagatttttacaaccaagtgaggtaacttcttggcctaggaatttatgatagagcttttactatgcttttaaaagtattttccctagatataacatcaagttcatatatgtaaagtcgtgaaaactatatagtggtctaattctctgacaaggcaagcttggtattgagatgtcataagttcattcaaggaagccttctgtcaatttccataggattgggaaggtggtgccttgtccatctttgcaggtgttggaaggggagcattattgcatagatctgttccagtttcacagcaacacatagactgtagtgtaaagaaagaaaaagtgataggacttatgtagatatgcactacaagcagttatgaccatgaccagctcttactgtcacttcctgatttaattatcccaacagtcttttgacataaacatcattcaaataaccacagatacgtggcctgaagccagatataacaagaatcagccagtaaagaaataggttgaatttaaccaagtaataagtaactggagttgttactgaacccaaaccaggtgattagaaagttagattcccaggggaattctcattacaagaaccatcttatcagataggtaattggaaaccctgttaaacccaccataacaaaggctcagcaagtgtacatctgcagtgccagtacaatcagtgagtcttcagttcttatgaacgttctgaaatcttttattattaaccattgaccctctaacctcaacttctttgagatgataaatttgtttcctttagtaaataagtaaattcctttttttcctccttcccaggaagtttgagattcatgtataaagatgaagaactaaataatactggctgagccaccctaatttgaaaatccaaaatccgaaatgctctaaaatccaaaactttttcagcactgacatgacgcgagaagaggaaaattccacacacaagtacttaacacaaactttgtttcatgcacaaaattattgaaaatattgcataaaattaccttcaagcttatgtgtataaggtgtatgtggaatgtaagtgaatttagtggtcagacttgggtcctatccccaagatatctcattatgtatgtgcaaatattccaaaatccaaaacacttctggttctaagcatttaggataagggatactcaacctgtagcataaaatcaatattttgggttatgactgggtgcagtgactcacacctgtaatctcagcactttgggaggccaaggtgggaggattgtttgaggccaagagtttagaaccaacctgggcaacatagcaagaccctgtctctactaaataattaattaattaaccaactgtgagtggaggttcttgcctgtagtcctagctactcaggagtctgaagcaggaggatcactagaacccagaagaagttggagattacagtgatctatgattgtaccactggactccagcctgagtgacagagacagagaccctgaacttaaaaatatatatatattacaacttgggactgaaatatttgtttgtatgttaatagttcatagcatttaagataatatgacatattacagaaatttgacagatttgctttgaaatgctaatttgaaacacgtaatttttttttttttttttgagatggagtcttgctctgtcacccaggctggagtgcactggtgtcatctcggctcactgcaacctctacctcctggggttcaagtgattctcctgtctcagcctcctgagtggctgggatcacaggcacccaccaccatgcccagctaatttttgtatctttagtagagatggggtttcaccatgttggccagcctggtcacgaactcctgacctcaagtgatctgcccgccttggcctcccaaagtgctgggattacaggcatgagcgaccacgcccagcctaacatgtaatttcttttagaactgttattttaagttggatctgtaagatagtttaggtttcaaagcaatattgcaatgttcaaaaaaccttaggtttcagcattttcttttttttttttttttttttttttgagacagagtcttgctctgttgccaggctggagtgcggtggcgtgatctcggctcactgcaacctctgcctcctgggttcaagcaattctcctgtctcagcctcccaagtagctgggattacaagtgtgcaccaccatgcccagctagtttttgtatttttagtagagaccgggatttcgccaagttggccaggatggtctcgatctcctgacctcgtgatctgcccaccttggcctcccaaagtgctgggattacaggcgtgagccaccacgcccggcctgggtttcagcatattttttaagtttagtttattagatttataagagctacttaaggacttgggaaggtataacgtgttaggattttaattttatcctgttagcatttgaagtgcttataaagtaaatcaaatgtgttaaattgataaatgcagtttaaagtgttacaggagtaatctgaacagtgattcctcataggggtgaggattgacctgaagagcggctcgagggtactttctagggtgatagaaatgttttatgtcttgattgagctgtcggttatcaaaatccattaaactgtcccttaagatctatgcatttccttgcatgtaaattttaccgcaatttaaaaatatgtgtgtaggaacttaatcagctaatgtatagacagaattgattgtttaatggagttgagtctattcaacttgagttaatcaaacattgattcaaggactcccgagagtgattattcttggtttcataaaatttattagatgtatgaatagaataatgagatcataatttgaacttaaaagcttaagggaaactacatagtgaattgttgacatagatgcagttcttgaacaaaaatcttgatggtctgtaagtctgtgtctattccttctcctagttggttggactcctgggtaaataggacagtcttcctagtatgctgcgtttagcatgcagcacttgactattgatgagtgaatggaacacctctagaggccaactacatcatccttctgtcctccttgtagcactagctcatttgcatagatcagcatgtccgataagctcacaccttgaagggcagaaaggacccttcttgagaagactgtacacagcactgtgtttttatgacagcaaacctcagtagccacaaatccctggaggatcagtaatgctagtgcacacaaggagctccctcccagcctgagggctctgccacccaggtagggctaagaggatggagttgacaaagggaagtcaaaaatgagagagctgtccatcaggagtgttgctgagccctgaatagagatcgatcgaggtgggtctttccttcccccttattataaacctgtacctttccttttattctctaggataccttctctatcttttctggtttgcaaaagaaaaaaatagttagatagtcactttgaatcaggcttgggaaaacacttataaataataattccacacatgtaagatggctaatcaacctaggtctgaaaatgacttaacaggaaaacattttcaatatcagtctctcatgattcccaaacacacacacacactcacaaactcaccacaacttcaaaattagcaaccaaaagacatctaaatgctgtgatctttccttttctcttccagatcagattagctttgctcttcactgtccttttgtcaaagcccctattgtacagctctccagtgtccttcctgcctgcccttctactgccattgtaacttttaccagccccactaccatttcagaagaaaactccaggaaagcaagtaagcatggatagctttaaagatcaatgctgaaggcccactaagaccaggatacaaagggagtcaattagaaaaaggtgggggtcaaggaagaactccccactcccaagttaaactcctcaatttgctgttttgttttagccagactctatggagctcagtcatggctagctctctgcaaatggcccccaaaaggcttttcacaaggggcagtaagatataactggcttcggtatttctgtctccccattcccagataaccaattcaagatgcatgcccactgtaccctgcatgttgttgaaacagaattttaatttcctctgtcttgcaaaaatgttcttttgcctctcttccctggtgccttttctcatcttcctcacccctgggtttcctaactctgtcttgcctactctgatctccaaagaccagtctctccttcatatttggcatgaaaccttcctcagctactcacacagtaattgcctcatttctcaaactctccagagtcacatcatccaatcaaagtactgtgtaatgtgagccacatatgtaattgaaaaattttcaagtaatcacattttttaagtaaaaataatcaggtaaaattaattgtactaatacattttatttgaccccgatatatttaaaatgttatcatgtcaacatgtaatcaatgtaaaaatgattaatgtatgcatttcatattcacagcacatctcaattcagactaaccatatttcaagtgctcaaaaccacaagtggctagtggtggccatattggaccacacagctctagaacttctgtagcccatggtttagcagttaattatgtgtgcacttggcatgttcgctgcttgttctctagtgaagtcattctttctagcaggccaagttctgtttctaccacaggtcctagcatggtgctttgcacattgtgggcactcaacaaatccctaagatttgcttcatagatgatccctgtacattgatagcatcttcctcattcatggaataacaagaatgacctcatctcctctcactttcattccttagctactaacactgttgcaaagatctctggaaaccggaaactttggtcacctatactttaaatggagagagaagtaaaacttgctgctgagaagcaaggactgcatagaaggtttagtttgctggtagaatcaaaataagcactgaatgaagatgtgtgtggttcccagttttataaataggttttgcaagaggagagtgtttgcttctttgtttttggtgcgaaacatttcttcttttagcatgttatctgaaagtattgctgccaaagggatgatttgccagagaaagatggtttctgtccagttccttcatatgtcaggcataacctccaattaatctgaatgaaagagtgggtgcccatgcagacaatgccaacaaatgcccctgtagagaggacacatacagatgccaacctgaaatcagacactggctactgaaacaaaggattgctttaatttttgcagaataaactatttttttcttctgcttttcacgaagtggccctaaagaattcctcttgtttgtggtctcgaaaaaattagaactatgccaatgaggcctgcctttaagggttctattaaacaataagaaggctttgttcttggcaataaaattaaagcaagcagtgtttccattacctggcaggctgccctctcccttcccacaaccctgaccccgatcctgacaaacctcaacagaccattctgtttcccaggtaggaaggttagatggtaacatctgtcaggtttgtttatagaaatatagttgaccttaatgataatgtataaagagggagagatgggggcggaggggggaggaaaaaaagggggtagggagagagagggacacttctccaaataatccttaactcaagctttaaaaaagtcaagtttactgcagaggcttcaagttctcaaaccattgttccagaaagacaataataatttcacaatgagttgaaatgatggaagttaggagtcactagatgaggaaatatacattttggtctgacacgctagatgtcacgtgttttctttttcagggaactttgcctaccattgctcaaacttagacccacttacagtcagttgcaaatgagtgcttgtaggtagattgtgaccctgaagtcaggaatgaccaaggccagtacagaaagcactgtccgatgcaaattctgtttagccccacagttagtcacaagtcattggaactgaaaaattggatgactgtgatgccagctctctctgtcctccatgagagctcaaaatggttatattgtagtctcctctagtgtaagagctcctgcctacagctgtcaaggccatacccatattgcactcacaggtcctatctccctggcctgggaactttttctgcccctcccaggaccaactaattccaaagggaagttaatgcctaccttcccccaacagctttcaaccagctcctgatgggagatgttacataaatactctgcttcttccctattagctggaatgttctgtactgtttcccagagttgcccaatggggttaatctccagttgcccaaggtggtcttggtaagtcacactttactggcttcgtagttgtccctgtttcacttcctacccagtactggtgttttctggcaacaatttgaccatccattcttgtctcatatccttcttggggaggatacaactgccaaccatgtctaaaatgaaatgatagcacaagtctctttttctagtcatggctatagctcacatgttcaatttctctaaactcaagtctctttcattgtgtttgaataaacgtacatgtgaatcactggacatcaaagatatttaaaaatcaatctactcacttctcctgatattctagaatgacaacaacagggcaagatatttcatagatatcacttgtgggtgcgtcatgaaggcagaacaaagcttaacattttccagttgtacctcccagttaagttctatcagtgacgtaatcacgtgtatttcactcactgtacggaataccaaagagcagaaacccaatgttcattttccagaactttgcagaagcagatggcttctatacctgagtaactgaaacccaaaaaggggtccaactcagtatttttccagtacatcacttttcaggaatcatggcacaacaactaaaaggaatgtcacttaatgagaaataacatgtaagattgaaagtgattaaggtaaagtcatagagtagaggtttcctctttccattagaaataacttcccttcccttaaacacgtcacctccatctttcctggcactccattaatggtcatctgctaaaagttattgtttaccctctgaccacaacatcaaatgccaaacacatttgttgaaaattatttaatagaaatcgctacttttcagaaactttatgaaaaagacgtgatagagacaaacacccatggcaggttaagtagatttcttttcattcagtgtgcccagcccaaacggaagggtgtgaagcatttgttttataaagtgtgtaattaataagagaaaggaagggaggagtttattgtttttcaatgaattatgagcaaccccttccattctgcttcttcattttggaactgcttctaacaaagttaccattaaacacaaaaagaaaaggctgtgatattgatgccaagaatataagattgaagtcagttgagtgtagcctaggaaaaacattacagaaggagtaacatttattataattgtgacagaagtcagcaggacatcatggggaaagtgaaaaccataccgcaagtatgttgtcattttcaaattgaaattccattaattcagtacttgtagctattcatgccttaaaagaagaaaactaatatttattgagcatctactatgtaccagattgtttacagatattttcatcaaaagtatgcaaatgaggaaacattctcacagaaattcaaatatttttcatacctgcagtcctctgaatataaagtccatgatttttcctttatgccagaggtcagcaaactgtgacgctcatgctaaatctgactgtttttgtaagtaaagttttatttgaacacagccacgtccatttgcatccgtattgtctatggctgctttcacactacaatagcagagttgagaagctgcagcagagaccgtctggcccacaatgctaaaataattactatctaggcctttacaaaaaaaaaaagtcccccaactcctgctctgtaccacggaagaatgttctctacccttcttcttcccccatccaaaattgcatcaggaggcagccttcaaggaacccagttaggatttaaaagtagcttcaaaaattctggagttaagcctcatgttatagcttccaaagctattattttgatgatgtagatgcatcaaagttttgattcatgctagaaagtcctcaggtaaccagcacaggctgactggtcctagaacctctagttttaattatctatggacattccagataaaaagagtttgttagcaatagtgatcgttcacatttatgtagtaattattacatgccaagcatttgtcaagggcttttcatgttttcactcatttagttctcaccacagtctaacccaggggttctcaatcttgacactagtgggatttggggatggacctttcactgttgtgggggctgtctaatgtgttgtaggatgtttagcagcatcgcacctggtctgccaggtaacaaatgttattttcctcattatgcaggtagggaacttgagatgtagatagttgaagtaaatgcccaataacatacaactagtaagcaataaaaacctggtgtttcaatcccgggaagacttcctcaagtccctgaaccccaaaccactgcctccattagcccttgctccctctaaattattttacctgtttgaagattttgctttactgaaaaactaacagcgacatcaacaacatcgtgaatggccatgttctgtatgctactattggaagtaaaactcctttatgtgaagtttcaaagttttaggcattagcaatggcattttttgctaggcagttttattgccttattacagttgtatttcattcataagaaagaatttaattgctctactcaccacagtgtgttgccatttttgatagtgtcttgcttccttgtccagcactcaagcttcataatcttagaaacctcaagaaaagaggatttatcatgaggttcctcggagctatttttttagtcccatagcaaattcccatctggataatcaatatgtagaattgatctcctctggtccaaataattttccactacgtcactatgctaaagcaggattacatgtagcttctagttgtatcactatatcactgctattacttcccaccaaaagcactttatgaaaggattccatttttaatttttctgaaaagcctttcttggagtttaaaaagatttgatcaaaaatgttaaatattaaattaacacattaaacattaaaaatattgtcccgtactctggtttgtcctccaaagacagagacctcaggagccaggccattctctctctctctcattcacttgagccaggtccacaagtatttgactttggtgtgaaagagtttcagagtgaagattacatataaacatatcagatgaattacggtaatattgtctgctgttcctcaattctccttggctcagttttatatacagactgaagtattagaatccctttcattgttcctctggcagctctgtctaacttttgccccagagtctggaatgttcatcacagctgtctttggcaataaaacccaaagcaccctcatatcatcatatttctttttgcacctggtcagtggtacacagcggggtgtagagcccacttgcatacagttttctccctgtaccctcatccacaggccaaatatcagcttatataaagctctgttttgtttcagttacttcagccttgggcaaattggaattaactcctccaatgtttttcctttggagtgagatgggatggttatgccacattatgtagtaccactaaccccttcgaatttggatgcagactcaaaattacatattcttagttatagagaaaagtccttttgagtctaaacaataacaagaacatcaacctagcatcatgtataaaaatgtttcagcctttctcaagatcaccttaatttgtgaccttggaatggaaggtcacatttattcaccgtggcatgaaacagcttttgtttttgccatgaggccgaatctaggcaaacttgtaaagtagacatttgtcttttaaactcccaactccttggtaatggtttcaaagatggcaaggttcagaatcttaaactaaagggttcacagtttgatggtgcaatttcaagagtgcagtaatggtgggccggggtgagagaggcacaactcaaggggtctaccattcttgcggaattcaaagtgaatagtagcctccggatttgtgcagtgcagcaaccctcttctcaacacccagaaatagaatatcctgtctccaacacgttggggttatcctgtcccaagcttacttcagtgtttccgtctgtgtacgaataagaagtgatatatcaagtcagtgtgtcattttcacaagaggaattataaggctgtattctgaaagtctatggatggctaacttatttcaataaagcactgcaaagtgagaaaatgagagtttctaaaatgcatgctagatcaatttcacctgtgaaaactggccagatattttttttccttcactcatgctccatcctaagagttccaaatatttctaaagattttaagcccacacatgtctgaaatctaatgatgtttatactctgcactgaacatctcattttgcagttgaatacaagtcaaattaaaagagccaggttttagaaataatacttaaaaaccacttacagactgctaaagaacatttcacagacacctagtccaatttctagtatatgtatgtaactaaatccctttaatgtttatacatatatgacaaggaaaaaatatttgtcctctttaccccacccattcctcaaaacactgtaacactattacaccataaaacttagcagggagactttgggcgttgctaaccaagtgccctcgagaaaatagctaatccatttatgtcatcattaactaatctggggaatgattacgcgtaactgcatttctagaaagggaaggtaaaccgtgcacccagtagcaacttacatgggactgcaactgattattggtggcagatatgagcattaatgaagccgagtgaccctcaatgctgaattccatctcaggactaggcaggccagatatgattgttgtgcttctacattcacatcattattcaattttgtaatatctctttcatcagactgtaaaggatcagaaagtcattggcagagagaagcagcagtattaccctaggaataggagaaagtgggtcagcaactccctacaggcaagactgatggggagaagatgcatttcaagacgcgaaagaaaactgactctagatgtagagaaggtatgtgctgagcagatgggtgaggtcaaaaatgagatgaggtgaaagtgactgagtttctcatactggtgggctaatgtgatatttgctcatgagtgtacttgaggtgagaaaaaaccatagtattgaggagcctagcctgagatctcggctcactgtaacctccgactcctgggttcaagcgattctcctgcctctgcctcccgattagctgggattataggcatgcgccaccacacccagctaatttctgtatttttagtagagacagggtttcatcatgttggccaggatggtttcaatctcctgacctcgtgacccgcctgcctcggcctcccaaagtgctgggattacaggcgtgagccaccgcgcccggccaggaaggcctaattttaagctgtatttcatcctgagaagtcaagtgccccatttccagtgtggtccaaaggcaggagacagtaattacccaccactggacatcattcctaattatcttcatctcactcttgccgttagtttaggggccaaggaggagactgatggcacaaaagtggaaagaagagtttgaacttgttttctgcatccttagattggccctcctcagagcacttccatcagccacaatgatttctgaatcaaaagatgtgaatcagaaatgaaagcaaaaatcataaccaggagctgctagcttccaaaccaaacctgggaactagaaacaccagaacataactgcaagtaaccaataaaccctgccatatttgaactaatagaaattaatgagaaagtccaatcaaatcgttaattctttgtttaagtgacacatgaaacagcaaaactgtggaaaacttctttgtagtagaaaaaattctgaaatatagaatagtatttaacttgttttattgtatcttttggaatataagaatactagagttacaagaatttggaaattcatcaaagtagaaaacaagattcaacttccctggtttcaaaaggaaagctaaatctgtattctctgaaagatctaggaaaaatacttggcctaaaatgaatagatcctgttcccaaatttctaggaatttacatattggggtgatggtgattgtgataccagttttctcaaaacacatttgcctcaacaaggaagatttcagcccacttttttggtaaagcaaacatatccattctgtaaatcaaatagtcaaaatttggattaaattgagccccatattacaatggcaactgggatactttttctaccatgcagtaactcaactcccaatgattgtgagagtgaatggaccctaaactaaatcataatctgtttacaaaatcccttctcaatgcagacaacagtacctcagatttgtcaatggcttcataagtttaggtgtttcttcatatattatttcatgtattcaccacaataattccacacggctaagagagcagatattattcagctcattttacaaaataggaaaactcataaatggagatagcctaagattttcctaatgtcaccatgtgggtatattacacaccacatttcatttcacagcccgtactctagaattagcagtgggttctcactggacttagtcaaagccagaagagcttgaagtgtggaatatgttagtgacaacattaaaacttgaggacctcacaatgtggtcaattgatttttgacaaaggttctcagacacttcagtgaaagaaagaatagtctttcaaaaaattgtgctgagacaactggctatccatataaagttagaagcctaccctcacaccatacacaaaactgacctcaaaatggctcatagacctaaatataaaatataaaacttatagaggaaaacagaacagtaagtctccatgaccttgggataggcaatggtttcttaggtacgacaacaaaagcacaagtaacaatagaaaagtagataaattaacttcattaaaatttaaaaatgttttgtgctttaaagggtatcataaagaaaatgcaaagataacccacaaaacaggaggcaatatttgcaaatcacatatttgataagggacttgtattctgaatatgtaaagaaataatacattctattaattaaaagacaatgacccaattacaaaaggagcaaaagatccgaatagtcatatctccaacatagatacacagatgtccagtaagttcacgaaaaagatggtcaacatcattagccatcaggaaaatgtaagtcaaaaccacaatgaaataccacttcacacccactaaaaataaaataaaattaaaaagacatacgataacaagcattaacaaggatgtggagaaattggaaccctcatgtatttctgatgggaatataaaataatgcagccactttgaacaatagcttggcagttccttaaaacattaaacacagttatgtgacccagcaattccacccctatatcaaagaaaaatgaatatatatgggcacacaaaaacttgtacatgaatgttcatatcaatattatttatagtgaacaaaaactagaaacatcagtgtgcatctattaaagaagagataaaaagtggcctgttcatacaatgaaatattatttggcatagaaaggaatgaagtactgataaatgctaccacacagatgaaccttgaaaacattatgctaagtgaaagaagccaaacaaaagattatgtattatttgattccatttatatgaaacgtccagaacaggcaaatccataaagagacagaaagtagactagtggttgcctcgggctggagctagggcaggtagggaaaatgtggagtgactgcacacattatgggtttcttttctgggcactgaaaatgttctaggcttagattgtgatgacgattgcacatgaaatcatctgtgaatacacgaaaacccacaaaactgcacattttaaatggacaaattttatgatatgtgaaatatattccaataaggcagttttaaaaaatcaattcctggccaggtgcagtggcacactcttgtaatcccagcagttttaagaggccaaggtaggaggaccacttgagcccgggagtttgagactagcctgggcaacatagcaagacctcgtctctacaaaaaaatacattttaaaaaaatttagccgggagtcatggcatatgcctgtagtcccagctactcaggagactgaagggggaggattgcttgagcctgagaggtcgaggatgcagtgagccgttatggcaccagtgcactccagcctgagtgatagagcaagagcaagaccctgtctcaaaaaaaatcaactcccttcctccctccccctcaaataaaacaatccttaggtcataattttgtgtctacacagtccttggaaaccaatccattacctgcatgttgagtgattactagtgataactacttgctccattacatttttgccctgtctcttcttggaaggtcattttccctatttatttattcaacaaatattttttgaatgcctattttgtgccagacatggcaccaggtgcttggaatagataccttatttaatacaacagctgaagatccctgcccatatggagcttacattctatcagatttaactcgtattctcaagtacaacttagctcttcgggtttattctagtagatacttttcaagtgtggggtctgtcaaagaaaaactagagctggacagtagttaaagctgtaaaaacattttattcaggactattgtaataaggggaaagagacctcagtatagaatgggactcaactcccaatgtcacgtggaccagtggggatttacagccaaggagcagggtgatgataagtggatggaaaattactaagaggaaacatcaggggtaagggagattctggttaaactgacctaaaaggattcttgctgaaggtaggccaagttgatcagacatcctctggggcatggtgaaggatgaagaacccaatcagatactgagagtgatcagatatggagatggaggattctggctaaaccaactcagcagggttcttgctaaaactggtttacaagaaagtgcgcagaagggcccaggagaaagttcaacactaaagtttggtcgagcaaagaagcttcgtcagtgctactttctagaaattttacttcctccatcataatgtgctcatgttatcaatatggtcccatccttttcataactcagttgtagtcagttattaaattcagtttgaggtcaaaaggaaacagaagaaatttactgagtgtaagtttcaagtaaatatgtcaatagctaaatttatttgagaaacctcaaggggagctagaaatgatgacataaaaataacaataagagaaatgaagcctaatgattatcctccttgaaatattagcctgagttccacatttgtacttctcagtcaatgcatttttaatttttctctttgttcattaaacaaatacttagcaaataactctgtctgctaaactgatgtaggacataatctcatggtttactgcaaatggccaatgactatcatcttctcaataagatgtcttgagtagtctctatgttatgtctgaacaatgatcaggaataaaattcaaggaatcctgggcctctggaaacaggacatggtttctgtgaacagccatcagtggatttttatcttgaactcatgaccctacttccagtttatctcattcatagagaatgaaattactccaattaaagccttccaaatcaaaaaggctagggactgggccatgtctcctccctgagatatgctagaataatcaatgccattgtcattctttgtaacattgcaacttctcctgtggctgtgttaaaataataaacctcatgcctgctatctccatctctcacagctgtggtttctgggtttctgtttgtgaataagcatttcagaattgccatgagatggaggaaatagcatgtgcagagtatttcccaggcctagttgccaagaatgagctaattgtaagcctcccttgaatgcaagtcacaaaaacttcaaatacaagccactctaatgatccacctttccacatgaatgttatgctttcgttgtagaaccttgatctttcagaagtatactaggagtataattttaaattatgtcataagattaataaactattgaaccatctttttgtgctttttatgttttatagtgattagatacaaaattgatgtttgtatttaagagaaatgtcaaatgtgatacaggcttgctacattgcttacggaaaatttgtctaaaagagattgatagtaatctgtcctccataaaagaataatattgattttttttaacttactttttttatgtttaacagggcaaatttgatactttttaaaaatataaaagtaggaattgcaaatatatttcacatgacacatcattttccaactaattggtaatggctatgtacatgttatgttaaagattctgcagctgagtctggcttagtagaaaagactgctgtcattggataataatgttttccaaggatgcaaattaggaagtggccatgtaagtcctatatttgcaatccttgcgtaatcggacaaagagttaacatttaaaatatcttttcagagattactagaaacatcctagtatacattaaaaatagcacttaactgaaaaacaaaggccaaattaacacttaccattgtacttatcctgtaggtcaatgcatcacgtcaagaagccaaattgacagaggagtgtgatcttctcattgagatcattcagcaaagacgacagattattggaaccaagatcaaagaagggaaggtatgatttctagggcagaagatttcatattctctacctggagaaaataaatcctaatacactccagggactttggaaatgttgagaaccctctttttctatacattctataattccctcttaagtctttaagacttagttaaaaggcctttgcttggcagttttttctccatccttttctttgtactatggtctcctgtgaagacctgtgatacaagggctgctccattgcccagcgccaggaggtagcataaaggtcttgtctatcatggccattgttttctatctcacttgtctatgagaaggtgggttctgtggaggcagagtttattttgtattcattgtgatatcctagaaactagcatagcattacataaattaaaaatgaatctgactttatttatagaaattatgaagtactttcccatgtttttgaggaaatgtatacaggtataacttcatggtcccaaaacccctggggtttcactatatcatatactcctttgtggatatagtaataatacttcttttctaatgttctaatgtttctatgttttaatttcctattgttttacagcaaactatatttttaagataaattgacatacattctttatagctgctttcttatttattcaaaattcattcacaaactgttggtcactttataatccatcagtttattctattttaaaattagtcatgtttttattgaaatacttatgatccttttaattttacccaattctctgccacattcagggataatttttctttcttttttcttcttctttttttttttttttttttttgagacagtctttatctgtcacccaggctggagtgcagtggcacgatcatggctcactgcaactgccgcctcccgggctcagacaatcctcctgccttagcctcctgagtagctgggactacaggcatgggccaccacacctggctaatttttatattttttgtagagacagggtttcaccatgttgtctaggctggtctcgaagtcctgggctcaagcaagtcacctgcctctgcctctgcctcctaaaatgctgggatgacaggcacgagctactatgcctggccaaggataatttttctatggatttttaaaaatagaagcgtttatttatgatccaataaattcatccatttctattattattgttcatagttgtactttaaaacaaaatatatataattaaaacatactagcaagttttaagtgaaacacagagataaccgtggctaatgtatgtggttttctgtgttttccacaaaatttaacaggtaccttctaatattgtacaatgttttagattactctgtctatatagattacaaaatatttatacacataaattattaaaatgatctaaaaaatagtgaaatcaaatagttattgatgctggtatagtagattaacagattaacatgaaattattccctggccaaggactcacatgtgccgaaaagctacttttccccacatacgaattgtccaatttagaagagcactgagtgtccatctggaatccttacaggatatatttcatcttccatcatcatcgtgcatcataggtgcacatctcttaattctggaagtattccaggttctcagacacatggccacctgaagtacagtcacaattaattattcatatgcatacagaaggtaatttgctatctttacatggttgcatgcagagattagctctcagtacacatattagtttattttcatttttaattttaaattgacaaacatttatatttatggagtgcaaagtgatgttataatttatggatgaaatatggaataactaaatcaagctaattaacatatccatcatctcaaagccttttcttgtggtgagaacatttgaaatttacttgcttagtgattttgaactgtataatacgttattatttatttgctgttttcaccatgccatgcaatagatctcaaagtaaaaaataaataaataaataatttttttgaaaaagcacttcctcttcctctctaattgaggttttgcaccttactcttactagtttcttattgctgcaataacaaattaccttaaacttggtggcttgagacaacatagatttattatctcagtgtgctgaaattcggaaatccaaaaatcgatctcactgggttaaacaaaatcgacagtcaaggttttggcagtgctgtttctttctggaagctttaggggaaaatccattttttcttgccttttctagctcttacaggtagcctgcattctttggctcatggtctctttgcatcaatctgacctctcttcccatcctcacgtcttctctgacacaggccttcctgcctttctcttataacgacccttgtgactacattgggattacctggataattcagggtaacatccccatctcgtgatccttaatcatgtctgtaaagtcccttttgccatgtgagtaacatattcaaagattcctgagattaggatgtgggcagcattgagagcccttattcagcctgcaagggcactccaccacaacttcctggctagcttgccttcccttctcttacttagcttggacttcccaccaccagggtttctctcatgagctagatcagagtagtgcaggtgtccccaagttccagccatagtgatgcatggagtttatgcttcggtgcactcgttctaccccaaatacatgtcagtaataaagaacttaataaaatgcaaaagcaaagacatatagctgaaccaaaaacaagataaacatctccacaggccagaaatgagacaaaactgaaaagccatgactgtggctgaggatacaggctactgggatttggtctggaagaggccaaagtagctttggctttagctcctgtggataaatagttcttgaagctttggggaaaggacctagaagtgctccagatgggatggggaatggaaatcaggctcattatttaatgccatgggctatagaaggcttcatgcttcagtcaaaaattattgccaacctttccctcatatcatagcttttagcaaagtcacattgttagcttgaagcctgtgttcacactgtttctgatacccacacagaacaggagcacagagataaggatgggattcctgaataatgacctcaagggccaggtgaaggcaactggaaaactatcagagcagggtaggctgagcaaggagggtgagagaggaaagaattataaattacttccctttaaaactgaaactctaagtttaatttcaaagtatataaagaaatcttaaatttctaaacatacagccagcaaaatcagcagacaacattatcttaccccagataaaattaattttataggaaaataagaaaaagactttaaaagaagtagtcttaagatgttcaaagaaagaaatgaaggaataacttctctttcaaaagagcaaaaaaagtgaagccacaaaagaaggaaatgaaataaaaaaatagataggaaagcaacaaattagcagttttggagggaaaaatatagatattgaaattagaaagaaaactcagctgcagtggaaatttggaaactgagttttggtcaccaccttgggaatgccataaaacgcattcttttacgtctgagtgacattaaagtttgacaaatgccgactgagtttgaactcaaaagataggaaagtatataggaaaacctacacatggggcatttttaaaataataatcatgcacttggttgaaagcaagtatttcagcaaatttcaaaaactgaataccatagaaccctgcctctaagaccacacactgtatctcattagatattatcaacaataaaataatagtttctatagttttttgacactaaaatctattcatatataaatatatcttcacagtaatattttttaaatgtagaagtaaaccacagtaaaagaactataatatatcataagtagtaagcagcaaaaaagtatctgaaggcaaacttacaggctttaattcttttgaaaaagaggctgggcatggtagctcacacctgtagtcccaacgctttgggaggccgaggcaggaggattgcttgagtccaggagttcaagaccagcctgggcaacacggcaagaccctgtccccccacccccaaaaaaggtaatactaaaagtaaaaaattagctttcaaataaagctagaaaaagcacaacaggataaacccagtgaaagcagaggaaagaaataaaggaagaaaagtaaatgaaagaaaaacaggaaacaaacaagaacagctgtcagcaaagaacaactcgcagcctaattttgaaacatctgtgaataaaaaaagtgccttttcccccatttttaaaaggttgttaaaaaaaataaagaaaaacaatatatgtgtgacagagacagtatgtggtcttcaaagcctaaaatattgactatctggtcctctacaggaaaagtttgccagcccttaatcaggaggagttttacttgtaaaaaataatttaaaagaccaatctgtagttaaggttgatgaaggaaaaaagagtgtggggccccataaacaaatataccataaatacagtagagacttttttaaacataagaaaattgtgtaaatgtcttcatgccaataatttgaaaacttacataaagaagtagcggaaaacctgaataaaccaaaaatttaaaagcagaagacatttaataagtcattgaaaatgtccatcaacttgcatttctgccccaaaatggcaccagcctcccacagttctatagcttactttaacagaagttccaggaactaataatctcattctcatataaactacttcagaaaatagaaaaaagacattttatgtagagtgtatgatcttgataccaaatacatacaacattaaaaaatctagagtgagagaatatcacccatgaatatagacacaaaaattttttttaatatgagaaaatgtaatccatcagtgttttattaaacacatcaaaatagcctttattcttataatacaaggatggctcaactacagaatatctgttaacagaaccacattaacagaaaacatacatatgatcccagagtaggagggatttttctttttagaccaaacaattttaaaaaaacaaccataaagcaaagactgaaacatctgacatagaataagatcacaatacaaaagccaatttcatttcaatatattagtaacaattgaaaattgaaatttaaaaaaagaaattccatttaaaacagcctcacaaatatgaaatacttagtgataaatctaacaaaagatgggtgagacttgaaagaccttgaaaactacaaaatattgctgagagaaattaaagacgactaaaaaatgaagccatgtatcatgttatggggtaaagactcagaaaagttatgatttctgttctttccacatcaacctgtagattcaacataatctcaatgaaaattccagcaggttattttgcagaaattgacaagccgattctaaagttcatattagaatgcaaaggatatagcataatcatttaaaactttgaaaaatagaccgggtgcggtggctcacacctataatcccagcactttgggaagccgaggcgggcggatcacgaggtcaggagatcgagaccatcctggctaacacggtgaaaccccgtctctactaaaaatacaaaaaataagccagacatggtggcaggagcctgtagtcccagctactcaggaggctgaggcaggagaatggcgtgaatccgggaggcggagtttgcagtgagccgagattgcgccactgcactccggcccgggcgacagagagagactctgtctcaaaaaaaaaaaaaaaaactttgaaaataataacaaagttggagaactaacatcagctgatttcaagatttattataaggcttcagaaatcaatataaggtggtatttgtataaagatagacaaatagatcaaaggatcagcaaaaagacttgagaagtagattcatacatatatggacaagtgattttcaacaaagatgcaaaggcaatttcagtggagaaaggattgtctttttagtaactggtgctggagcaattggatatctgtatgtaagaatatgaagtttgatccatacttcacattatatacaagactttactcaaaattgattatatatctaaatgtaaaaggtaaaagctgtaaaactcctagaagaaaacgtggaggagatcttgaccttgggttaggcaaagattctttacatacagatgacaaaagcattatccataaaagaaaatatttatatgttgggtttcatcaaaattaaaaacctcttcagaatgcactgttaagagactgaaaagaccaaccacaaactaggcgaaaatatttacaaattatttattttaataaaggattgtatccagaatatataacaaattctcaaaactcattaataagaaaacaagcctttcaccaaaatgcataaaagatttgaaaactttaccaaagaagaggtgtggatgatgtattacttagggttctctagagcgacagaactaataggatatatatatatagagagagaggagtttattaagtattaacttacacaatcacaaagtcccacaataggccgtctgcaagctagcagggagagccagtccgactctcaaaactgaagaacttggagtccgatgttcgagggcaggaagcatccagcatgggagaaagatgtagacggggaggctaagccagtcttgccttttcatgtttttctgcctgcttatattcgctggcagctgattagatggtgcccacccaattaagggtgggtctgccttccccagcccactgactcaagtgttaatgtcctttggcaacaccctcacagacacacccaggatcaatacttgcatccttcaatccaatcaagttggcactcagtattaaccatcacagatggtaaataagcacgtgaaaagatggttcagtatcattagtcattaatgaaatgcaaaataaatttcaatgagatactgcttcctacctactagaataattaaaattcaaaagatggcgcataccaagtgttggcaaaaatgtgaaggaaccagagcctctcacaaactgctggaggtgggaattaaagtagtacatgctggaaagctggcagtttcttaagtaagcatacacttaccatatgatccagccatttaggtatttaccaagagaaaggaaagctatgtccatacaaaacttgtaggtgagactggtcacggtggctcacacctgtaatcccagcactttgggaggccgaggcaggtggattgctttgagctcaggagtttgagaccagcctaggcaacatggtgaaaccctgtctctacaaaaaacacaaaaattagccaggtgttggtggctcactcctgtaatcccagctacacaggaggctgaggctggagaatcgcttgagcccaagaagcagaggttgcagtgagctgaaatgatgccactacactccagcccgggtgatagagtgagaccctatccaaaaaaaaaaaaaaaaaagacttgtaggtgaaatttcatgttaattttacttgtaatagccccaaactagaaatggcccaaagtccatcaacagatgaatgggtaaacaatttgtgtcataatcacacaatgaaatactctttggcaataaaaaggaataaactagttacactagttataatgcaacaacatggatggatctcagtataattaaggtgcgtgaaaggagtcagacagaaagtagtatattctgtatgagtagattcatatgaaattcgagaaacggcactttctactaatctacagtgacaaaaagcaaatcaatgattgcttttagggatgggatgacaggaaaggatgggcacagttaattacaaaggggcaggagtaaattgtggggcatgatatatatgtttattatcttgactgtggtgactgtttcatgggtgcatacatatttgaaaaagtgtcaaatttgcactttaagtatgtactgtttatgatatgtaaattctatctcaattcagctgtttattagacatataaattgtgtattatataatgaaaaagtcttcagaaattaaaattaatgaactagggtgatatgtattagcacggacaaatcacaaaaacagaagaaagttatataattatttgtacaagcattatataaaatttaataaactaccaaaaaatcccatacattgtttaggtatgtgtacataaacatgtttgggagtgatcagctctaaatttgagagggtcttttcttctggagagagacatgagtgagattataaagtgccacacagaggctttaatgctatcaataatattttaccaccaggtgtggtggctcatgcctataatcccagcactttgggaggccaaggcgagaggatcacttgagcccaggagtttgagaccagcctgggcaacatagtggttccccatcactacaaaaaataaaaataaaaataaaaattagccgggtgtagtggcatgtgcctgtgatctcagctagtcaggtggctgaggcaggaggattgcttgagcctggaaggtcaaagctgcagtgatccgtaatcatgctactacactccagcctgggtgacagagcaagaccctgtctcaaaaaaaaatcttttttacttccttttgaaaactctgaagctcatatgatgaaaatactgagatttagtaaacctggtactatgtacaggacagttcattatattcttaaattttttgtatgtatggaatgcttcactttttaaaaagtatacatttgctcagcaacattatctcagaaggcaatcttagaaagcagatgttacttgggaaagatgagggccgcactccttttctcttgagctagtactttggcacatgaccaaggactagttcattccaaaccctgaaactcacagtgactcaagtccctagccagggcatattgtgtcagaggcctgtttttaagaggaagggtgtgaatgccaacccgtggaaatctgaggtgccagacagggagggcaagtgtggacttggggttcactgggggacttgggtccctgcaccccaggatggcagtggcaactgagggcattgagtctaaagaacggatggtggggccttctgacaagcaattggaagtgggcaggtggagcaagaaccaggcagaattgtggagatcacaaaagtgagtttcatcaactgccttattttgcccctgtctatctctgacactagtcactcagctgtcaaactcacctcaaattctgcaattgacgaggtcaccaagcaggtgatattattacacgttagtacctactgatgattcctgctcttggaccattgtacattctctgaaacaaattaactcgacagcctttataggtgggcggactggagagtcttaagccatgaggctccctggaaaagaattttcttctttttttcagtagtcggggataagtttcatgtcaacacacaaagagctaaattcagattgagttcattcatttaatgttcagacacagagatctatggtagacttctgaaggccaaagctcaacaaaataagggtcccttttcttcactgccttttatgtacactaaatcttaaaagtttaagaaaattaacttggactaaatgttgagctctccatggccttaaagagatggtgagaacaggcctcattttcagttcagatacttgtgtgaattgaggatgcattgtttggacctaattgttttgggttgtgtatcctacatacatataaaaagatttatataaaaataagtgtttaaaacgcatttcaagcaaaataaagcggcttttaaaagaatgtgtaaggtataataaacagcaaataaaatgatataaacagccctgtgtccctgctaaaaggagattccagcaggcaaactatttccatgactagtagagagtaaattccaaaagttgcaatgtggtaatctcacttcccaaaggaaaaatgaagagttgactggaaaatatttcccttgcagcattaaggcagacacatacagaatctttttatgtgtcagtatctaatttttttaaacatcaaattttattcaccttgtcaacttttaaaaataatacattaaaaagtgttgtctaatagaaaactaagtacttcgctccatgctgggtgtctgagtttgaagtgctgtgacaagtaggacagtgtttcagagtgtgctgcaaatcagggccatctgactgtaatcatttaagccaggggttagccgacttttctgtcaagggccagataacaaatattttaggctttgccatacggtctctgttgcagcaactcacttctgcacaacattgtagcaagaaagcagccatagattatgtgtaaccaatgagtgtggtagtatgccaataaagctttatttacacaaacaggctgtatgctgatttggcccacagatcacagcctaggaacacctaacttagagcagtgtttttcttttttctttttttttttactgtaacccgcagtaagaaatatatatgacatcacaatacagcgtgcacgcatgcacacacacaaaaggttttacaaaacccaacttgccttttctaccaggaatgcactctgctatttgcttttctcctcttctatttggttttttaaaggctagtcctgactgtcctaatgattcatcacctgcaggcttaaaaacatttgttgcttgttgaaatggaaattcctcctgctctgcgaattacaactccttaactcaaatattggagcgtagacccaaacatctactgtttttctttcaaaatgatgcccagctgattcttttacactaggtttgcaaagctcaaatcagatgtatcagatgaaattgtacactaacctataactaaaattatgcccaaaattgttctctgtagaacattccgatattttcacaggcgactctcattttgtcttgctttaatttttgcatgatttagggctcttttattctttttcctgttatgtcacttttaatgttcaatatcatgatagaaaaagaaaagaagaaactggagttcaagcatcatcgcatttgaaatgtgtgtggtctttaataggcatatctaaaggataagtagttgtcatgaagttattctaaaggaatattttgaccttattttcttttgctggaattgtattaaacatctgcaattcggccatgtaatttaaatgattctttatgctgtgtgattaaatattccattcacttggtttgtcctgtggactgtaaattagttttccttctggaattttccttcctctgacagtttcttatgaacatgttctaatatcctgcgcgtactggatgccttccttagctttgcctccagatagaatgatgccagaggctaaattctatttggtgtaaaataagtgttattttattccactaatgaatacaattaatccactggggacagtaactataattataatgcattaagtcttttaccaggctcacgatcctatattatttgccctaaagttttgacacttcattctctgactctttcaggaatttttttcacccttgcctgaaatcttgtgcctgctgcttctaattcagtatgaatttcctttgtttgcttatagtacatacttggaattggatgttccttagaggcctcaagttctgacatctctttccttccttttcttagattagagttatacagggatggtaatgacgacttggagaaagaaagaatttcttggaattagcaggaattctggagagagccttgggccagccttgtctgtaagacagattgactggtctcctccgtaccctttcacccagggctattttccattccagaattatcataaagccggttgaaacctgtccctgggtgtgtggttgggggcagtaggcacacagcaattccaattagctgtctaattttaacttggcttctggctagaggacttcatctcacagcacatttcaaacacaagagcgaacggtcaagtgggttaccttggacttatcttggcctgccccggaggttatggtcaattatgtttgagggacattttcaagcgagacagaatcaggaattggaatggaggttgtgaagcaatcatgcgtttttatcccaactgggaaatgcttatcaaaatagttcctagttatcaagtaagcacaaagtgcctggaaatgacgttcccagtgaggggaaatggcccagctgtgctttttttggctttctctcatctgctcaacaggaaaaatattaatcaatgggaaaaatgctccctttctgttaatttaacacatgagttttaggtagtgtgggaaatagtaacacttaatgctttccattctcgattttattacatgaattacaaaaaacactttttagaaaatggttttcatttaaaccatagattcaccacctataaagatgttttatcttcttgatgaaaagaagataaacctgagatagagaaagttccagggttccctacagtcttgcagtcattgtgtggaatagtccagggaagacgtctggtgaccctttgtaagttgccactgggcaacacctttttttcccatcaacagggaagcaattcacaattcagtgtttcctcgtaaaacgaattagcaatgcttctccaatgagataaggaatatctaaaccagagtcccataacggagctttccatattttgatatatctctatgcctactttttgaacttttatggaaggataacacaacaaaatgaaggatccagcctgatgccttttcattaagcaagaccacccatgtaaccatctctctccatgcctcttttgttcaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagaggtgagtgcaggggcccctgggaatttctcggctgctgggctcttgtatctgcgctgtgattggttggtcttgccctcgccttgcttttattttcattttcaaggctcagtaccagagagaatagaggctttgagctgttttgttccagctaaagatgcttccttttgacatgtgaaagccctttcagtaacagcctggagtctggagttcaaggcctttgaaacaagagtccaccagttagaaagaataaaatcaacctgcttttggacgaggggggagcttatgatggcacaaaaacagcatttattgtgactctcagatgtgatgttatcgtacacttgataacaaagagtcaaaatgaaggcaaaaacattaaagggaatattttcttccatcacagggctcatctatttttttttaaaatcacacaggtgttgttctctgttaggcccattttcatttggttgaggagcttggcctcacctgaaaaggtcaaggccaactcacgcaggagagaaaggaccaaactgtcaacctcatacgggcttcttttaaaatactctttattctcaggtagggagctttaatgtgatgttatctgaatggttggctcagcagtaaaactggcaaagataagtattttttcggcacacatacttggttggtataaaaattgctcatcttcactgacacaaacacctatagcaattctagtggatccaaagaaaagcactagccgggcacggtggctcacgcctgtaatcccagcactttgggaggccaaggcgggtggatcacctgaggtcaggagttcgagaccagcctgactaacatggtgaaacctggtccctgctaaaaaaaaaaatacaaaaattagctaggcgtggtggcaggcgcctgtaatcccagctacttgggaggctgaggcaggagaattgcttgaacctgggaggcggaggttgcagtgagccgagatcgtgccactgcacttcagcctgggcaacagagcgagactctttctccaaaaaaaataaataaatgaaaaaacaaagagaagcactaggctgggccaggtacagccaatgccacataaatgacatctctaactcaggctaatggccttgacttcattcattctaattttcagagtcaactgccctttatccaaagcaataatagaatcctatctctagaagaccccagagagctcatgcatgctgatcttcatcctagagcagagatcagcagactttttctataaaggatcatcaagtaaatatttttccgctttgcaggttgtaaggtcttggtcacagctactcaactctgccattgtagctagctctaaagcggccatagataatatagaaacaaatgggtgtggctgtgtgccaataaaaccattacaaaaacaggcagtagaccatactttgccaacccctggcctaggaaaaaaaatactcgccatcttatgactcaaatttattcaaagaaagagaaaggaaactaacatttattgagtgcttgcttgtttcggaaacttgtgctaattctcaaaatatcgcatagaggaggagtgattgacatctccattttcactcttcttaaagagtaatgtatcgtgtttttacaactctggtctactgtccaatcggcttgactgtattatttcttatatttgaggaaaattccttttgtagctgattagatacttatctcttctaaaaggcatggataacagctggctatcatccctgttatgtacttaagatgctctcctccttactctgagaggcccatttctttcctcctgattccttggttccaaatgtttattttccctgggccatatccagttgctcaatattcaccctaaagttaaaaactgcaaatagcactaatactccagtgtacctaggacactaatagatagcgtttacacttaggtcacggtttccaaccggaatccaggagtacttttctccatctatgaactttgagatgtccagatgaaatggctattatgaactgcattcctcatcaatccctgaagattcaaccaagtgtcacatgaataaattcttacctagtgaccagggatgatgtgaccccataacagttattgctgaaagaagatatgcatctgaagtatagcacaggtgtgggaatgcccacatacaatctccctcagttccagtgggacgtatctgctcccattcagctctctctataacaagcccaactcatcaagagcaggaacatgactttgatttctctttctacaaagaatgtgcttctgtcaagtttgaattcacagagcctgtaaaaatttgccaagagccttgtctctgtttctgcagtcccctctcctcccatcactatttgtcaatcctcttggctaattcctgagcctttctatccttccagcagctaggatatagaaaaaggacactgggcttagactagaagttggcagacctgggttccagtcctagcactgccactttttaactatgggtctttgagctattttctacttagaaaattgggttcaggaacagtttggaggttcctcaaaaatccaaaaattaagctatcatataatccagcaatcctactgctaggtacatacccaaaagaaacgaaatcagtatatagaagagatatcctcactcctgtgtttgctgcagcacttttacaatagctaagatttggaagcaacctaagtgtccatcaacagatgaatgaataaagaaaatgtggtacatatatacaatggagtactagtcaaccataaaaaaggatgagatctagttatttgcaacaacatggatggaactgcagatcattaagtgaactaagccaggcacagaaagacaaacattgcatgctgtcacttatttgtggaatctaaaaatcaaaacgattgaactcacggacatagagagtagaaggatggttaccagaggctgggaagtatagtagggagttgtgggagtgggggtgggtagggatggttaatgggaaaaaagaaagaatgaataagacctactatttggtagcacaatagggtgactatagtcaataataacttaatcgtatgtttaaaaaaaaacttaaaaatgtaactggattgtttgtaacccaaaggataaatgcttgaggggattgataacttattctctgtgatgtgcttatttcacattgcatgcctgtatcaaaatatctcatgtactccataaatataaacacctactatatacccacaaaagaattgtttttactaataaaaaaattatttaaaaaaattggtttcagaatagctgtcactgttgtgatgacattgctttaagttcctaagaacaggtcattagcattatagctactccatgagtgttagttggatctctgttttcacgtttcaacatgtcagtctagcccgccttgtgtgtcttttttccaatgctactctctgtctacctgcccctattcatcaacctgtcacttaacattcttctctaggacatgacttcttttttctgtctcctattgtgcctgccttgggctttggctcctgtatacttccaaacaatctttattcttcaattcaggtgtggagcccagaacaaacttttaatcccgcaggcattcttgaagtgagacttagatgagattttctgcatcgttaagcgacttaaagtggatatgtcctcctacaagctgaatcaaaactgtaaatttttctttcatttcagaaacatcaaacaactccaaaaggggagagagcctcaagctttacattgtaggagatgcttttgctttggaaccggttgtttggctctgtgctaattgcttagtaattatagatagcattgaggctgctcattaacattggctaattttgctcatatactccaagtaggcaggtaccctagccaccttgtttttaccattatagccccagcacattgcgagctgcctgacatgagtgaatgagtgaatgaatgaatggatccataaatctgtaagacgggactaattattcctacctaagatggttattgtggggataaaatgcaataatgtagtaaaaacattagcctagtttctgtcacaagatgaacatgcaacaaatactagttctcttccttcccactcactagatgaatgcaaatgtataatgtactatattctcaagctacactagtagataggtctttggtgtgattgtatatgcacctttatagcattattttaaataagcaaagctattcactaagtccaggcataagaaagttggtctgcttatgaagaatctagaattaaaatcccttatagcagtaacttatctgtatcaagaaggtgataaaaagaaacttccctctgaatagtacctattgttcaaagcacctaggaggttctcagactcctcaaggtgatccttctgttcctcactacaataggcagttcaaggatcttttccagaatacaaagccaagaactccagttgtcaattctgaaaagatgttgcttggttcaaagaattagagcatatctgatcagtggttttggaagtgtgtctgcagggtgttcataggcattaagataactgcacgttttcaaggccaaatgtgtttgggaattcctgggctgaccaaagtaaacctatcttgttactgtgaggcctcactgggttttactttggtgatgcacattgtttggcagaagccttgtgagcagcatagctccagacacgtccaccttctggaaaactggccccatgtgtcccagacatggctgtaaagcaagaagttgagaaagtggcatagcgctaacagccctagtggatttggcaacttatccaaaaggccagaagatgggcaataaggatttgggaaataaaaacatggcctaaaatgttgaatttggcagatttccccttgcctgtcactccaattaggaatttgaagttgtagccaaagataagtatctttccttccatcaaaaaacaaatgtgtaggtgttaaaagctgcagtaatctccactgattcttgctgtcagcctttacctcccaggctaggaactttgatccttttggttcccatgtaacaaagttcctaccatcaagatggtagacattattaacagtgtcactcaatttaaaatgttttatttaattgtttgtagaccatggaaccaggagaaacttgggaacaaaatctattttggatgagactgaataaagaggtttctgccagtgggcagggaaactgctaaagccagggaaatgcaattgcaagtttggtgcttgtttcccagtagctcagaacagttctccctgccagacattatgatggagaattaattggcgtttcactttgcgatatcttttaagggttcaaatggcaccttagcatttcttttaacttttctgcatcgaatgcatatattctgggctctttggtgtgtagcatagtttaagggcttcataaatatttgttgagaataatcctaggacctctatgaagtttaaggactttttgtgttcatgggtcataaggaaagcatttttaaagtataacttgaccatcaatcaaaaatgcctagcaaccatctccgtatccatcagtctaaattagcagctgttggtaacaataattagcccaattccccagggtgcaatatttagtcaacaaaagcactcaactctgctattcactacttcttggtgaaagggtcaggagatgcagttagattctctaccctcattcagacacttgaaactcgtttccagagcttagacctcttcacttgcatctctcaatcccagtatcattacatttatgacattgttgattaggctctctccttccctcctgtacaacactgaaaatctgccagaaatacaactatagaaactgtatttctatgaattttgagcattttacaggtatattcttttttagatgggtgaaatttacacaacataaaattaaccattttaaggctgggtgtggtggctcatacctgtaatcccagcactttgggaggccaaggcctcccaaagggtgatcgcttgggcccaggagttcaagaccaacctgggcaacatagtgagactctgcttctgaatgcacgattcagtggcatttaggacattcacattgttgtgtagccaccacctctatcaagttccaaaacacttccatcataccaaaagtaagccttatactcattaagcagttactccccatctcccctcccctcttagcccctagcaaccaccaatctactccctgtctttatgaatttttgccttttttggacatttcatacaaatggatcatacaatatgtggcctttttgatggcttctttcacagagcataatgtttttaggctttatccacatcgtagcgtgtgtcagtgtttcatccctttttatggctgaataatatcctgttgtatagatatatacccacagatgtaatttttagagccaagatatattacatttgtaaatccaaagctttaagagccattaagagactcaaaaggacatataacccttggagtaactggcctgaaatttttctagatgaaacagaagagtacagatctgaaattctcctccttgctgctgccagctagctttgtggccttgtataaatgagcatcaattttcttaattagaaaataagtaactagatttagtactaaattgtttcaaggttgtttctttgctcaaaaattcccagcatcctacgcaatactccgcatataatagctcttaagagtgttgtttatggaacttaacaaaataccaaactcaacaagattactagtccagcatcatttgatatgctcagaaatggtatgcttcatgccacaattctcttgtttttaagagaagcacttgcatttttgaatcaaagtgttcattattaataactgaaccttccaaatgaacctgagagtacatagaaggagattgagacacaccagtgccttgctttttagtttatacatgagaactctaaccagaaaacctaaatgaagaagagaaatagtgcatccactggggggatttgtgagaaagctcatgaatattttccacagcatctgctgggaatatggtgcaagaaaatgaatacaaagagaaagaaaatgagccagacaaaaaactccctttttaatgtttattttagagagaggctagtaattgattaaactaatccaatatctggaaacattcttttttaatattcactttgccttttatgcagtttgaaattttggagactctcctttgaagtggatcagggttgcgtctgaaaggaacaaacagtttcccagacagatgtgtgaagaaatgcctagagctacgcgcttcttgctggggttagacgtgaccgggccagactgttaaatacacagcaacatgaaatatgaatattcttttgctttcgcagggaattttttttcctgatagtaaaaaggaagagggcaagccattttgttgttttctccaattccttcacttttttttaaagcttgcattcatttgttttatgttactgtgttgtgacattttgagatgcctcttaaaactcatgtgtaaaaaagcactttttaagagatatttattttccttttctttttcatttctatgcagtgatgttgaaagtcatcttgacatttctgaaacattgttttgtttgcattacagagtctccatggcaactgcatcctcccaggttctaattcctgaaatcaacctcaatgacacatttgacacctttgccttagatttttcccgagagaagaaactgctagaatgtctggattaccttacaggtattgtcttttatgttctctttaatattgtgcacacttagtgatataaacactttgccaccagatcagttattccccaataaccagaggaatgggcttttgacctaggaatggcactgatatttccataaacaatttctgtgcattgccctttgttttttcatcaaaacaacacagcccattactaaactggggacaggagaaaaaggagaatctcaaccattaaaagcatacttaccactgtttccctcactctcaaggtgtgggtgctaaaaatagtatctctctgtggtatttttcatatcatagtagtaagcaactcacaatacattggcagagaaaaaattggcagctaactgattggttgtctgtactgcttcatctccttgtatttgtgatcttgttttaatttgcacaacatcgagttgaggtaaagcattataatccccattttgcaaatgacagagatcagccgtcttgctggaaatcaggtaactagggaatgacagaattagaatttggctgggacctgtacaaactccaaaaacttctgctctttctagtaaaagactgaattttatcttggcaaatgtcaccatggcaaaggtcacaaatttacattggaattcctagtgctgtgtttcagtgtgcttcctggttggtgttttgttttgttttgtttctcccttggttgagcttaaaaaacaaaaacaacaacaaaacaacaaaaacctcaggccactcctattcctaagcatgcttctaaacttttctttgctgtcaacttctaaagtaggaactgagaatattcactggtagaacctggactgtttagacaaccttattcgtgttagccaaagccaccagtgcctgcgacttcaggaaagcacaatgtacacagtgaagccagatgtgcgctgcacttaagacatacagccttcaagagaccacgtctctaacttagcgtgacatgagcttctcaattccaattctgtgtgtacatgtttgtgagaaagcgattgaacaaggtggagcaggagaaagggaacattgtgtgatgtttgtttttacagtctgtggatagaaggccaggggttctatattcagggagcattgtacccagaagatgagcattttttctttgcgaggacccaatgtgccgtttttagcctttctgcattgtcaagcaaggcaggcaggcattccacaaacttcttatcttatgtaactctctctttcaaacataccactcctattaaggaagaaagaaattgactaaaaaagcatttaccgtatggaactaaacttggtttcaaatatttgtgtacataatgccctcctatttaagcttttaactctgagatttatttaaactgacactatccaataaaactttctatgatgatagatatgttctatatctgtactatccagcgttagctgcctcccacatggggctattgaaaacttgaaatgtggctagtgaatttttacttttatttaacttcaactaaatttaattgaaatttaaaccaccacatgtagctcgtggctattgtattgaacagtgcaggtctagactttctccagctaagctgtttttcacagtggcatcctgttaaaaatctcctttttcttatatcatttgcgaatgagtttagttgcaagcaacaaaaaatccaactagcagtgaataaaaccatcaaggagtgtttgtattacagtcacagaagagaagcctgtgttccagggctgggcagtggttcagtgacgacctcagaccccaggctctttcttttttcctcctctgccgccttcattgtgttgcctttttgccacatgatcacaacatgactactccacctccaagtgttgtgctcaagctctaggcaaaaagaaaggggtggaggggaaacgatggacaaaatgctctgccagtgaagtttgtttatcagaaaaacaaaaagcttgatcagaagacccgcctagcaaacttccacttatgtctggtgggctgtatctgtgttacaaggtcatgtccagggacagaaaagactggaaaattaagtatttgcctaggcacatggccattctgcccagaatcagtcttattgacaagaatgtgcccttgccatttcccaataattatttcatagtatttcaacaacatatacccattttaatctctataggaatgcaaaagtattgattaaaggggaaattgtgaaagtagtttagactgaattgtaacatacaccatatttcatcccgatggctgtttatttcaaactaaaggccatatggggtacctgctattatgtcttctgagctgtcaaccccaaatacaaattcagtccatttctagacataacatcgatcctgaccataacatatgatgcttggctgatactgccaagtccaaatagtttatgacatttgtaagcaggaaatgaagtctttgtggagtattagcccaccattccttgggtggtgtttgtgacagagacaagaaaataacacttctggtactgattccatgagtattgaaattggcagcatgctgctgttctcatttacactaaattgagtattgacttctcaggacaaactcattgggtttacagtcaaaataaggttagcctgtctcattgtaaaaacaagattttttttttcctatgacatgcctctaagtggtatatcaagttaataacccatagaggtgacatttccttcctgattatggctactaccatgtgtctcacagctacttgcctattttgaacatacgttttctttctatttaattgtatattgcaatacagaacaaaatttttctacaatggttgatggagaaataattcaatgaactgtttaaattgtgagagagtaagtatttcttcactggtccatgcaggagtgatcccacaccaacagggaccacacagacaataataagcacattttacgatgcagctggacctcctccgtggaatgcatatcctgattggtgtcactgattcatgcacatccaagtcataccacatgacactaaatctcacatgtgaatacttcaggagacagatgtacaaatacatattccagaaagaatgctttaaaggttatgtagaacccttctgtcttaatgcacaatttaatgccatgcctgtcacgttggaggtgctcaacaatgtttctggaattcagaaccaatagataaagctaagctaattgacttaataccgtagacttgcttctgtgatacttgtcctagaggtatattcaaaaagcaaagtgaagactactaacgcagagtttaaatttacagtttttataaacttttcttcctctttgggtttgcttaggactcatcaattctaatcataatttagagcaggaaataactctgaaatagtacaagcaaaggttgctcctagtttgtagagtgcaggtatgtttctccttttgaagtgagattctagtgggtagaagagtggaagtaaaggccctggatcaattctctaaaccagaggtcagcaaactttgactgcaaaccaccagatagtagacactttaggctttgcagtccatatggccacaactactcaactttgctgttgctccaaagcagccatagacaatacataaatgaatgaatctggctgtgttccaataaaactttatttacaaaaacaggcagtgggccagacttggcccacagtcacagtttgccaacccctccctctaaaatattatttacaatgcaaagcactcattttctcatattttccttgctcacatactcttctcataaaaccagttactgaaatcaattcagtagaagtcattttaaactcattattttggtaggacttagacttctctgctccagaatgtgttaaagaaataaaacagcagccttctacaatgataaattaaccaaatgccaaaaaaaagttttttccttggggaaggaaaatgtaccttttagatatgattgactatgaatcatggtcttctgaatttgaaatatcgcatgagttgagaaatgagaagaaaatagggctggactagtaagttcttttttttatgtaagtcatcgaaacatctaatgaaagaaaaattcaaacaattatgtggctgattttttgtaggataacaaacataagtattttttcaattgggtgcctaaagatataagtatctggcaccacgtattaataggtcaggggttggtgaactttgggttacagcccaaatctgaccctctacctatatttgtaaataaagttttattggaacctggccatgcccacatgtataagttgtgactgttttcatgctacaatggcagagttgactagttgcaacagagactgtatggcccacaaagctggaaacatttaccatcaaggcctttactgaaaaagttagccaacctcccaaagtgaatgcagctatgaaactttatcttgtttactttttatttgacaagttttccttcatgcacaagaaagtattatttgtttaacctcccaaacatattctcatgatctcatgataaacacagaaagtccatactggctgactctagtcacactccttattaaaaacaaaagcaataaccagccaatcagatattctttagattggggtcaccatctctaggatagtagtcctgatggacctattgagaaggacctgcttaactgtcaaacatctcctctgaaatggtatcccagttgtgtgtgcttttccactgataagcattcttgacccccacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtgagtatctcatggcctatttatttctgtctttggtggctttcttcagattgattgcattcctgaatttaaacttcaaaggaagacaaggaaggaaagaacacacaatatttattgacttgtctttcttgaacaaaaaagtgatagcactcacttgtactacattagtaaaaacagctggctaaatattgatgaaaattaatgacctctagcaaaccacatggatgttaagggaaagaagccagaaacaaatatatagagagaaacaaatatatagagagatacatagagagagaaacaaatatatatatatagtattaatccacatataggttcataacttaaagatcaaaataaactattttgcttaaagaaacattcataggtgttaaaactataaaccctgggcaacctggtgaaaccccatctctacaaaaaatacaaaaaaaatacaaaaattagcggggtgtggtgacacacacctgtagtcccaactactcaggaggctgaggcaggaggatggcttgagcccaagaagcagaggttgcagtgggcagagatcacactacagtactccagccggggcaacagtgagaatgctgtctcaaaaaaataaaaataaaaagtcaggatgatggctacctccaggattaaagggcaagtggcaccactggaaagaaatatacaggggttcttggggttaatggcaatttctaggtgaaagttacatgctttagtcattttatcatacatttagttttatgtactttcctgagtgttacttcacatattttaaaagaaaggatttaataaaataaatagccaaagaaagttaaatacctggtcccattcagaggagagagctgggcccatcacttaaaatgttagtaactggccccacccgggaagaatttccaaccttacctgaaacattagaggtgccccctctcactgaggcctatttgatatctggcatcagagataacttggtgatttcaaatagcagtagtagcaggccacagagatgataacagaggaagcagtcctccaacccacagagttatttaaattgaactgggcaaatggcaatggaccagaagacatggcttttcacgggagcaagcttgaaacttctttaacaaagaaaaatacaatatgtcaaaatagaacagaatagaatagcagtcatgtttcaacaaagagatgttttgaataaattcatatcaatttaatgtgcttttattatataaaccttttctctcttaactacaaactgctctttcctagcacaagtaattctgagtcatacgatgcttaacatagaaatttgatttaggattaattaaaagagtgatgcagaaatacaccaagttctaagggactaaagtataaatgacccataccaacaaatggctccccctaccttccttatatccactctccccaacttctccaacttcctctcctcaactccctcaccttctaccctataattggcctgccgtggaagcttttattaaaatcttgccatttaccaagaatgtgtaatttttaaatgaaagtggagaaagtcatgcaatgtcaagaacagctctggcaagctgcctgagtcagtagggaatatagaaaggtcagaaatggtgagtgggacaaaaatgtcttgggggaagttgtggttaaactaagtcttgaaaaaaagcgggtgcattttagcaagttaaggctgtaccggacagctatgtcatcataagcaaatctatcaagatgtaacgtagcagggcatagtgggaggtcttgcctaattaagcctggctggtaagtgaggaaagggagacagtgagaaatgaagatagagaaatagaaccagggctcaaacctatattggcctagctccaaaaagcacatgttcttaatccttaatcctcagtcacctaatcctaattcacaggcaagagctagattgcagagggctacccaggccataccatgtttggattttaccctgtgggcttgagagtcatgcaggacagtaatgtaatcagaggtataactagaaggtgactcaggagcactgtggagagtggagaggaacagggcaggaccagaagcagagacatcagctgggaagtttcgtagtaattcactgaggcagaaatagccaggacctgcaaatggcaccagcatcagagatggaaaggaaaagataattccaggaagacttctctgcgtctggcccattttcctgggaaaaaatcatcagtgtcctcagatatttgaagtgctttttggggcaagtcgcagaaggcctgtatagcaatggtttagtaacattttgctcaccttctaggattttgaattcttctggtatcattcctcatttctgactctatatgccctactgcaaatcataaagaaatactaattctctaaaatatttttctacatgtgcatatcatacacaatgctttaccttgtttttttcaataaatattatgtctgagatatcattccatttcagcacaaataaagaactgcctcattcctttttgaggcagtatcatatcctattttaaagatatgctctaatttatttatcccatcttctatagatgtttatttagcttgtttccaatctttggcccttacaaacaatgccccagtatccccaaggatgttcaagatatccttgaatatctctccttccacacacggggaattatatctgtagtataatctcttgaggtgcaatttctaggaaaagattatttgcatttaattttacttgacattgccaaattgcccttcagagagatgacatgatttttaaatgcatttttccagctgtatgagcttattgtatttcactgatcttggctacatataccataaacttaacgtggaattaaagtctagtaaaattttaaaccttgattgtgcttcaccataaacctgaaacacaagttaatctatgatcactaatatcatactaaatagtcactccttcatataagcagtgattctcaacaagggcagttttgccccctaagggacatttgacaatgtctctagagacttttggttctcaaaacctaggaggagggtgctattggcatctagtgggtagaagtgaggaaagatgggaaatctcccacaatgcacaagaaatcccccaacaacagagaactatctggcccaaaatgtcagtaatgtcgaagttgagaaaccctaatttaaaacaaggtaaatgtataatatctacatgattacatgctaaatactgagaccataacacactgatccacacacactactatactatgtagcatggaaggaaaaacacaacaaaaaggggggaatataattaatgtattttgtcttcacttaaggaattgttttctcaatattttgtgattaatatcactagcatatttgggataaactgaaccagggattgtatcaaacttgaagaagatgaaattcaaaagatgatcagaaattccaaggtaagagaaaagaagcacgtgaaggtctgagaagagcaggtagaaaatggagagatgattcattgtaaaacaccaaggaaggttctctgaaaatacatagaggactgatagaaccaacgtctgttgatgagtgaatagtctaaccggaaaaagaaaacatttggagtcattttataccaaaagagtggttcttggcccatgtgagaaatgctatatttctctcaaatcattttcgtctgattcaggaaaagtgctaacagttttctattgctgtgaaacaaatttccaaaaacttagcagtttaaaacaatacccacttattatttcagtttccatgggttaggattctggcatagttgagctgggtcttcttcttagggtgtcacagtctgaaattaaggtgttggctgggctgcattcatctggagactcaactaaggaagaatctacttcttagctccctccatttgttgacaaatttgtttcattgtggttgtggaattcatggcagcttgcttcgtcaaggccagcaagggagagagtctgctacttcaaatctgtcacctccaaacctgtctttaaaggactcacttgactaggtcagactcacccagaataatctgccatttgattagctccaaatcaaataattagggaccttaattatatctgtaaactcccttcgccttcgcctttgtcatataatgtaatataaaaacaggagtaataaaagtgatagacctttgtcctttgccatattctgttggttagaagcagatgacaggtcctgtttacactaaggagataatattacacagttatgaataccagggagttggaatcctggggaccatcctagggcatgtcttcctcagatggttatgtctctcctgaaatttcttttggttttcttttattctttcatatatgtatgtgtgtgtgtgtgtgtgtgtgtgtgtgtgtgtgtgtgtgtgtgtgtatatatatatatatatatatatatataaaatttcagacagtcttgctctgctgcccaggctggagtgcagtgtcatgatctcggctcactacaacctccacccccagagttcaaatgattctcctgcctcagcctcctgagtagctgggattacaaacatgtgctaccacgcctggctaatttttgtatttttagtagagatgggatttcgccatgttggccaggctggtctcaactcctggcctcaagtgatccacccaccttggcctcccaaagtgttgggattacaggcatgagccactgcacccagccctctcctgaaatttcttaaatcaaatcgtcatggacactttgggagtacatgtagccttggccttgactgatgggctctgtatccgttggcttttgctgaatagccaacaaccacagggcctaagtagaattcatattgcttatgcatctggagtcaactgagtgtcaactaggaagccctgctgatcttggctccctcacatggcagactgataactgtggcaacccgactgctgcacatctgtctcatcctcctacaatccagctcaagtctgctctcaccctgattgcagagatgaaggagtaaaggcaggaccaattacacacattctttttaagcccctgtctgtgtcacattagctaacatgaggtttgtcaaagacgtcccctgggtgagcccagagtgagaatgcaaagacctgcaaaattacaaggaaggagcaaggaattggggccaaaaggccctaactcaataccagagcttcacctcatccccaaaatgaaaggaagatatttattgcttgaaacttagggtttctcacttggctaaactgtgaccaacttgatttctgtgctatttgcatcgaaaataataccaaacatgatgcattaatagaatagatgatgcaaaaaggtcatgcataaaaaaactcaacaagagcaaaaccactcagtataatgaactcagaactttatgttgggtgattccagagatgttttgttcccagaaaccagttgccataagaaaagaaatgcaaatggcttagtgaagattatcagcctttaacgcatagatgccagaaaggcccattctcccaggatggaagaaaaacagtgaaactgctggtgctgaccaaactgggatactctcaccgggttgtttgtatcaggatgtgttcctcccttgatgcccattaaaccagaatagtgaagtcctaatgcctacaggatccatttgcgacaaagaaagaattcattcagataaaaagctaaccgataggcaaagattttcaaattattttcttcttaaatatttttcacatttgtagtgaccaaaggagacctggatttcaatcttgactttggacctcactagctctgcagtcttgagcaaattatttaatgtcctccgaatccgtttcctcatctgtaagaagggatagtgttttaacttcacatggttgagataataatagtaaacaccttagtcttgtgtttgccacagtggtagcacatagatattcaaagttattattcctacaaaaatacggactgtactcaccccataattgcattttaaaagaaagaccagttttgcaattttccaggattatctacatgatagctttttacacaatcagtatgtgaaaggctttccttgaatgatgttaaataatctgtcctattatttggagaagtatcctttgcagatgttgtattgcgtgacaaggtctaatggtaaaactctactgaaaatgagaagatataatgctcaaaacctggctgtagctccttatatcactagaaaatcttttactgtctctaggtcatggttccttcactcatcctaataaattgtagttaattgccttcaactggcgttagtgaaggagacttagataatatctatggagctttttcaatcttacgaaaaggccctcactaatgaaatacatacattcaaatgcaaaagtaatgacattaatttttattttttatttttgttaatagagttatgactatagatgttaatgaattgcttatcaataactagatatttatttaattttacaacgtttgccacgttttctctaaaactacttttgatgcttcattttaagtcttaaattgggtcctttccccagcagcctattcttattcttagcagaaatcaaaagctgcatttttttcaagccttaatggctaagtagttatctgtttttaatttattgtagtcacttagaaaacattcatgaaaattattaaacatatactatttttacagaggagaaggaaaggaatgttcacttctgtccagtctgttggaagagacaaaggatgttagaaaccagtgtgcagcctctcctaagactgtccacatcatgtgacatttttacacataattttttgtggcaagatgacagttgccatacaaggctctgaaatcccagatgtaattaagatcttataatgagccacattatgtagggaaatgcttctaacccattgtgaatgaaaaaaaaaatgtataaaatcaaaaaactcaattaattaggtttcattgtggacaaattattttccaagctccgttgttattttaaactgagtcggaggaggtgaatgttggaacaccctcaaagatgactgaaaatgagtttggagaaaagtgaagtttcaatcaggatggttgtgtgggtgtttcataaagagatgaataaagcctggtcaagagtcctaacacagtggggtgtcaaggcagagaagtcttgcttaagcaaactcagtgccatatgcaagaagttaggtggtgctggcgtaagaccaacaccggtaatggtgcactccaagtcaccccacttactccagcccccagaagaaaattgtcaatgttgctttcctggcatttttaatcaacttctcaattattatcttggcaataataataacataaaggtaaacctaaacagtaatagtgtttgttagtattcatgaaagtagattgtcccagtataaagctaaccaatgaaattttactacttcataaacattttgttcttttaattttcaaggaaaaaatagggacctcttcaaaataatcaggatagtcagagtccctttttgtttggaaaaggtttctgaaacataaaatctttgttgggttaagactttggattttaggccaagttacagttttcagcaatttcagacatctgctttatgatgttactgaaagcgttcccccaccacattaaacccagcttttgggttgtacagtgatgtaaagtttattgaaacatttttacacttgctttctttgaccacaatagtcatttttttgtaacatattcaattaaacaggaacagtataaaggcagtgaaattgatacgattctcatttgaatctactgaatgccttaattgttctcattcgtggctgactgccattgacaaagatctaggaatatgagtacactatcctacataatagaaaagctaattttttgttttattactactgtaataatattaagtacctaaagagagttataggcctcttggggcccagaactcagagttcaaaatgacccttctttgattggatcaaaatctaatatttggctgtggcattatccagaagtatggagtttattatagctatgttcaaggaaaaggtaaggtgaaggaagatcagaagggatatatagtaaggagattcccatgttactaaactatttgtggatgttttcctgcatcatatgcaaatgagaattggtaggaaaacagagggctaagaattagagaaaataaatttggggaggagggatggattgtgcctcttattgctctgctgaatctccaaatataaacacacacacactcaaacccttctatgagtcctaaattacattcttgcttcaagctggctttttcaaatctggcagtccactggcgaaaatgtttgcaggttagagaaaaaaaaaaaaaaaggcaacagaaaattcacaagaccaaatatgtgtgtgtgtgtgtgtgtgtgtgtgtgtatctttagatatctttagatgatatatacatacatacatatatatatatatatatttaattcactgatgtgtacttgaaaatattatgcacccaagatggaaatcatataaggtgaatttttcaactgtgacaataccatgaataatttttaactcaaaagatggagtaagtaagtattcagtaagattcaaagacaggcttcgggagcctgtgactaccttgaaattctatgcatatatttgtggtttggtgtgtatatgcatttgtgaatttcttactacagaaaggttttattagattatcaaagaggtgagaccaaaaaaagattaagggactgcttcttgagaatctggtaaagtataagttgcctcaagatcaaaggaactaaccctttgacttgcaaatcaattgaaagaggagtggggtggtggctttggagtcctctggaagtggagggggcccagccctctcccagggatcagtgaaggaaattcaacagagtcaggaaacttcttgacagcctggtcaccaagggtttggaaaaaggttctattggagtggagattgatgggtggaaaaaggagagaggggagttggacctgataccaaagagatgttttcagccatcaaccagctgcaaaacaagatgggcttccttttcctacatattcttccaagcatcataaatactcggtctgctccccaacccacatcctgcaggatgcagccagagcaacagccccactccactctgaaaccagtcatcctagggatgatgatcatttcttagcttccctgttggaggtcggttggggttggctgatcgctgcttggttcactcctgcactggctgggcgttggctgcatggtaaagctgttccctgtctcatcctgttgggataaacagagtatcctaggcatattttctccagagcagtggcagacacaaagggtcaacagaaaccctcaaggttttgtcatgcctactcttgcaactagcacattgtcatttcagcctcatgctattgaccaaagcaagtcacttgaccaaattcaaagccacatgacagggaaatatattgcacctctttagaaggagcacctgcaaagttatttgggcctggatatacagggcagggagaattttggaggcaaaaatgcaatctgccacatctacgttagtgaagtcagtttttcgtacatgactaccaagacaaagcacttcacttaccaactctattcaaataaatggaaattattcaacctaaaattatgcaaacattgctccccttgtgccaaagaactgcaccatgtctgattggctttgcaggtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagtaagtgctgtgaactcaacagagctgtcatgtcttatctgctcttctttcagctgactctgtccccctttcttttccttttctctgtcttgggtatcattgacagccccccaaaacaagtaaaaagccagtgtggaataatggaatttgcatcagatacctctaggttccaaaactgattctattccttcacagccgtgaggccattactctctctgcattactcaattttaaaaaattgagtcttctcattttttaaataaatattcctggaggcattcttgtgagaagtagatgatgtatatgtaagacctgacacacagtaggggctctgtaaatggtggatagtgttatttttcatagcagagtagccaactaatcactcttcagaaattcttttattctagaaaacagtcggagtctgtggttctcaatcagggacacttcttcctccccctccaccccaccctaccaggacatttagtaatatctggaagaggtttttagttgtcacatctgaggtggatgctaccggcatgtagtgagtagaggccagggatgatgggaaacatccccaatccacaggacagtgcgcatcacagagaatggtctggcctatatgtgtgtctcatgatactgtcatctccctctctctgtccacatgtgttttgttttatcctctcttctttctttacatccttttgatctaggaatattatgttatgtaacatggtgtttatttgcataagacctcccaagagaaagcaaattggagtgtgtcggtatggcgccatgttgtgaggttgccaggcagtcaacaggaacaattaagtgcttttcaaggggaaccctcatttaacctatatccttgtttctcagtacaagtgttgtatcctagaggaatgtgttggatcctagaggaagaacaagggatgtaaagagagcactgaattacgaatgagaagactgtggctttcccacttggtacccatatagctatatggctagtttcttcatatttttaaatagattttttattttggaatagctgtagatttacaggaaatccatagataatacagagagttctgtacacccttaacccagtttgcccaaatattaacatcttatgtaaccttggtacagttatcataactaagaaattaacattgatgaattactcataactaaactccagactttattcagattttaccagctttccactaatgttcctttcctattccgggacccaatccaggatcccacaatgcatttagtgttccttcagttttaaaatgggaatattttaacaacttgagggttgttatgagttgtcaaaaagaccctctcaaagtaattctaaaagtacataagagaatataacatgatgatatatttctttacagtcatacaacaaatggcacaatacctatgcacacttagatcagcattatttgatttgcatttgaacatgtaaatatttgttccttcaaaagatatgtttgagcaccaagtgtgtttgggatgctgtgcaagatgctaaggatattatgagtatcttcaactccctaaggtgtgcttctctctcaaaaaggtcctagactattggggaataaagcacattaatcctaattaacattcaatatgtgaaatctctgactggaataaccatgagaggttctaagttgacaaagccagggtgccccagcacaaccttgagaggctttccaaggtaggttaggagcaggggatgtgaggacacagtgttccatgcagaaggaacagcatgggcaaaagcccagagacaaggagaatatatttatggaacagaaaattgatccatgtggttaaagtgtgtcttaggttgggaggataggtgagccaggaggctggagacaagaacagatcgcgaaagcctcctgggccacaccagggagtttctttgtataccaatgattggtggagagattgaagagtttaaatcaaacaggcaggatgaaaatttccatgaaataaagctctcttgcactatgatgtggtgagtggattacaaggaaggaagactggctgctgggcacagtatcaaaagattattgaaagagttgtccatgtaagtaaacaacggcctgaataagagtcgtgtcccatacaaatattataatgaattgaattatttagtaaagtaagctattaatctctttcttgaactaatttgtcttcactgaagcaaaagccttgaatttgggcagagtaggtagtggtttatttgggaaacatatctgaggcatgggcagaatttgctcaccaagattgcatgattctgctccacacatgcgtgggtgagggtgtgagccaaggcaggcaggatgtttgaggcagtatgtcaccatcacaaggccggtctttccaatggctctgacattctgatatatctcaccggaaggaggccgagcagaacttggccttcattgtaaatgatgggcgccattaaggaatttcttcctgctctgcccattagtatcctatcaatcatttttaatccatattctaccttccacctttaaaaattgaaatattttaagcaaaactgtcttcatactcttcttgtcttagttcatagtttatctctgatagttgctagcatgatcattcctaaggacttctttttacaagtcaaaatttaaactacacatgtaatccaatagatcttacggcctctgagaatgtccaatccctgctcagcccttgagggttttctctgctccccctttaaagcttttcttttcttttttattgttatttttttgagacagtgcctcactctgttgcccaggctggagcgcagcggcatggtcttggctcattgcaacctccgcctcccgggttcaagtgatactcgtggctcagcctcccaagtagctggaattacaggtgtccgccaccacacccagctaatttttgtatttttagtagagatggggttttaccatgttggccaagctggtcttgaactcctgacctcaggcaatcgagctgccttggcctctcaaagtgcaggcattacaggcatgagccaccagcccagcctaagcttttctttgatatgtacagaaatagatttctaaaacaaaagccagctaactatagctcaagggccaaatctggctgcctgattttgtaaataaagttttattagcatatagccacacccattcatttacctattgtcctgtccgtggctgccccctcactatagcagaagagttgaatagtcacaaaagagaccacatggcctggcctgcatagccaaaaatatttactgtcaggccctttgcagaaaaagtatgctggtccgtgacctaaaaagaaaggattttagaggtgctggtgttgtgttgtgtttgtatccaaaaggcaactggaaatcctttggcctacccacatgtgacaacacacactgtcctatactcactgggtcagtttctcgcccagcatcgtgtattgccacagttgaatttactagaccttttcctgtgattgagagctgtatactgggcagaaggaacctgccaactgcaacagtgactgtggagtttggacaccatggcatttgtatcaggttgcaatgcatttcctgcctttaaacgccttgtacccaatgcagtgttgaatgacaggcagtactccaaaccaatattgaattgtcaaagaagaagtaacaactatgacaaaatgtccaggtgtgactctgccaagatttttttaatacttaaatctttaagacacaaatgtgagtaatgaaatagagaaggccttattatatataaataatttcatgagtagaaaacccaggcattgctatcacattttttcctaattttgtggcctgaaaattgtattctcatcctaaattcctaagagtaatgctttaatttttaataatctcagaataatataaacctctagaatattctatatgttaagacccaagatcttgatttgtttggtttctggtctgaagtctattgagcatgaatgcatcttatgctggatagaacactgcagtggttgaaaatggagtcttcattcattcctccttttcaggatgctatccagccagtatgtacctgtgctgcttgtatacacctggaatccgtgaagctagctcaccctatgttttctggctaagccttatccatgctgttgttgaatagttggcatgccaccactggatccctatcttagaactggtagactgaaagcttatgaagacaggaacatgttctttttcactcttactgtgtactgtactatacacagagttgctgctctctattgtcttttgaatattatgaaaactttgcaagcaaatgtctttgaaagttgcttataatgtttaaattactattaaaatataagataccactttgtgataggaggcatgactcagggagggctggcttgttcctgtcttttaaacctgattttgaaaatatgctattggttatgataaaataaacaatcctcttcctcttcctttttctgttttgtgaatttgttttcaggccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtaagcaacttatttctattgtcctgcagttataaaaaggcacatctcattctgtacttagagagtcaacccatactgtaatgcatcttaaagaataaaatgcagaaaagttgtattagtcagctcttgctaggataatactgcataacaaacacccccaaactcagcagattcaaacaacaaccatatattactaatacccacacctgtgggttctctgttcaagattatagagctctgatcattggatgagctataccatgttaacactgctctttcatgccatgaaacatgggttggcaaaccacagcccatgagccaaacctggcctgctacctggttttgtaaataaagttttatgggaatacagccaggtccatttttttacatatagtccatggctgcctttcagccacaacagcagaatcgagtagttaagagagaatcatatggtctacgaagccaaaaatatttacttactttctggtcctttccagaaaaagtttgccattccctacttttaaacatcactcttcatcattacacaaaactaatttctgttgccttgtatgttttatggttctagactggaccaattagtgcaaatagctaagggttgaatggtgggggtgaagcagtgatcataggctgggaataatttcaaaaggcctgttagatccagcccagtgactttagcccactgagttctctaagaataagggcaaaggtcaggacacaattacattggaattagttaacctcacaaagttaaccttgcctaatccacagccacaactgcacccctttgaccgtctgtctcacaaatgcctgcttgctattgatcaaaaagggagctattttatttttatttaacaagccctcatatggtacaagtatgtgccaggcactggtctaagcattttacagatgtcaactcatttattcagccttacagccctacaaaggtaggtgctaatattatccactttactgatgaggtgactgaggtatatgctgaagatcacagggttacaaagctcacaggtggcagagtcagtaagtctgcagtcaagggtcaggctcttaaccagcagtccacaaacattatctgtaaagggccagagattcaatatttctggttttgcatgccaaatgatttttgtcactaatactcgactcttctgttgtagtgggaaagcagccacagacaacacctacacaaatggacatggctgcgttccaataaaacttcatttataaaaacaggcagagggccagagttggcccctgggtagtagtttgctgttccccgctcttaaccaccatggtatgctgctattcacaaaagggtggtatatttttgaaatgctataattactctctagggtttatgacagtgtacgtaatgagtgatagctgaatccttgctttaaaaaataaaatcaacattcaaaattgcatagcctgaagatggtgagtataacagtgtttctttcaatataagcatgataaaacacttatttatatataaaaaaacctttcaattcaaacctatgcaaataatgtgacatggctgagtcctttatattgtaggtagaaattagccaaaaatctaagaagtgaattgtaagcttcccatctctcccaataatggtacatactatattggctgagcgagtaggttttcctttgttgctatcctcataattctctttgcctagaagagttttctgttccaacatcctgccagaggatggaggacaaatccttcaccccactaggctctgggctagattggcatttgcaatttttagctgcagtggggcaaaattaaagcacaaaggaaaacacaatggatgcaggtacaaaaaaagcaaatgtttctagttaattaatgtgctgtattaatctgggatagaatccagggtctaaatgattattactctattaataattaattatgataaatgaaacctgatcattatgatctcattgccattgatgaatagtttgcaaaattccatcagaccacttcagttatataaacacacatcagcattaccttgaaaacaccctccagatgtcaaaactaactcatgagggggaaaagaaattctaaaattaattgctacacaattaatctttacaaacctgacggtgtcaatttcagaaaaatcttcatgtagaaagtcactttacatttccttggggggtattagcaaggaaggggcaccccctacgattaaatgcctgtgacatcttgacttgcaacagctaatgacatatttgcttatgaaatatagtcctgactttaaattgatgtgtacattatgatctgtgcaatggggcacgttaacattgctccgagagacataatttttatactttgaattctccgtgtctcactgcgtaacttaatggaacattacattctgcctgcacatttcaagctcaatggaaatatgtacctagtttcacagattaatgatactataatggtattttcctttgcttaatggactatacacttagtattttcttactctctaatgctaatgtgcacttggtgttttatgaaatggtgttaactaaatgagtaataacgggttcatgcaaagattattagaccagaaggggtgggggcagcatacaactctggattttgctcccaattttaatcttctgtttctacttgctacatgtagtcagccatacctgccacagctatttcatagggttcagttaaggttcaaatgggaaataaacatcaaagtaataaaaaataaaaatgctgtgccacaacaagaaggaaacaatacagatgtggtgattttgtgatgcaggttccaaattgtctgaaaagcggaaatagtattcactggggtatacagaacatttttggggggtgggagatactgacaattgcaaaatgaaaacctttccaaaatgtatgtattagtctgttttcatgctgctggtaaagacataaccaagaccaggcaatttgcaaaagaggtttataatggacttacttacttacagttctatgtggctgggaaagcccacaatcatggcagaaggcaaggaggaacaagtcccgtcttacatggatggcagcaggcaaaaagagagcttgtgcagggaaactcccccgttttaaaaccatcagatctcatgagacttattcactatcacgagaacaacactgaaaggacctgcccccatgattcaatttccttccaccgggtccctcccacaacatgtgggaattcaagatgagatttgggtggggacacagccaaaccatatcagtgtatcaaataaacagatgacatttgagaccctcgatgcatgccacagaagggagccagaagcttacaggaccctggaagggctggggcatgaagtcagggagtctgctgctctagttcatggagtcatgatgagctgtagctgctgcaaagttgcccacagcacaaggcaggtgtactcaggcgctcatctagaagcttccaccaaccgcacgtctactgtctgccatcaggaaagcgtgtttcccctcctctaagcacttctggatcttgtgcaaaggcatcacaatagcagagcctgacccagactcctacaggaaaggggattctgggaaatgcaacttggattctcctcataagcaggagaggatggacgggagggaagagaggatgcaacattgatgacagacaggcctgcacactgggcttggcagattatcaattccatccttcttttggatttagtgatggcatgttgtgttaattttctttttaaacaaacacaccactcttaaagtgattgtattttaagtccagtgtgattttttttaaagaatgtcattttattaaagacccatgaaatttttctctctgcattgggtaaggtaccatatgttaatatccaattagactggtttctgctataacatattaaaagttcaactgtgagtcatttactctttataaagagtgatgggttttgtttatcttaataactgaaatacgatgaatattacagaggcatgactcagaggggtaaaaagagattaagatgcttagaacattgtagaaagcattctttggatttttttgagcagcaagagaacatttagaataaccagaagatccgtctgctcaaacacgttcagaattttttttccagtataatcagaaaggctcttggcagtgatgaactgcacaatttctggttacggatggcattgtagaatgtagttcgtgtttgtgggttttgagtcatcctgagttcaaattctgattctggtacttattgttaatatgtgccatcaggcaataataataaaataaatagcagttactgaatattacatgccaggtcctgtgcctgggacttaacatgtattctctcctttactccttaaaataacactgtatatttctcaatatacatgagaaaattggggctgagtaatgacaaaggatttatccctgcaaatgggaatcatcttctgtgcttgcccttggcaaagtgcattcagaatcagaaaatgacagacatggtgttaaatgaaaaattataagaaggtcaaaaggagaagtctagggttgtgctgtccagtatggtagctatgagccacaggcagctatttaaatcatttaacttaatgaaaattaaataaatttaaagttcagttcctcagtctcaccagccgcagctaaagtgcccagtagccatatgtggcttgtggttaccatatcgaggagagcagaacatttcagtcattgaagaaagttcttttggtcagcactggtctagcgaattcattgtgtagatttttataagagtgaaaaaaagcagcaaaactcaaagttcaaattctccgtagtgtttgagctgaaaacagaaatgtgggtaaatacgacgcttctttccacccactactttccacccactttccatgtttgggagggaaggagatgaggaacacagatgttggggttcttgccaagctttcacttaaagaaaatgaacagggacaacaaatgatcatgtttttataacccctgaggaccacagaacggatttaacgtgcatgtgcaacatggctcattgtttttgttgttgctgttttgtttccgcaggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaag

SEQ ID NO: 2996 - DNA, 175324 bp, human
gattggcgaagctcctccgcggcccaagccagccacctacaacgtctctgagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcaggtaagctcaggcggttgcgctggcggcggagggggcgggcgccgcccgggacccctgcgacgtgttactgcggagagcttgctgggttagcaggcgcctggccgtagtcgatgcgtttggcggaaagacggggctgcattttcctaagacaaccaaagaagcacattttacctgagccaccccggtctggtcctcgccacccgcccccacttttgcctctaattgtggttgatgtcaggcagtcgttgtaaagggcttacaagcagtttgtagaatatatgtaaatcaattccagtttgcggccgctggaatgtatcgtgcaggatgtatctcgagcttttagtgcctctaccctatgctttgggctagaataaagacagctgaatgtcctgaaaaagaatttcacggggcctcttatctcattttggtttcgcattctgagcacttactgtgtttctggcggagaaggcggaaccagcttgaaatgagcacagacagtccttccagaaaaatgcaaatttgtttttctgttctagcagtttggaaactgtattgcttctggacgtgagaaggcagccctgaaagtagtgagcggagaaagggctgggggattacttaaatgagtctttgaaaagaattctaaaccaacagcttcttctgtggctctggggcatgatgataaaattccttatcagtccaggaagaggtttatagctttgctgttaagcaagaaaaggaaagaaaaagtggatgtaggaagccaaggagagggtgtgatttacaactcaatcaaagttatggaagaattttatgtcaatatttaaatatcaagaacaatactcatataaggagaaaacaaggctggaaaaacatgccaataggcttggaagggcagggatttcaagaggaatgctattgcttttaccagctctgaataaatctggatgggaaagttagcatctgtatcgcaaccggaaaagctcttcactttttcttctaagtgggttgggtgctcgccaccctgcacactttgggggaagtgagctttccatttaagagcgcaggggaggggtttcgaactttctgtccctttcccacagccttgggagatgaagcagagcccccttcgaatggtcagcgcaaaccctccgccttcttgccccctcgcttgttcgctcagcaagcaggcttggcaagtttcagtgagtgcagaaaaacacttgcggaggagcaagtgccgtctgcttgcaatgaattgcccttgccttggtagggactgtggggaggacgtctttaagttctgcaaactcacagtccaacctcatacttttaatgtctactaaagtgggatgaggaaaaggaaggagaagggtaattggaaaggattgaaaaggaaaaagaggaacgcaaaacatttttgacaaaggtccttagctggaacaaagaagttatttgatcctgtgcagagccacctgtcctctcctcggtggtgtctgagctcaatttccagaatccctgttcccacacaattcctcaggaaccatggcagtctccgtgccttatgcctaaggtttgcttcccccagcttggaatggtttttcccatgcctagtttgttgtggcatttacgtgaagttggaaaacagcccagtattgaaattttaggggtacaagtacacatatagtgaactccttagttatttaatgaatgggcaacttttcatctcacagctacgtatgtctactaatttttttggcctgttcagaactttgaaagagggtgggatggaacaggggaggagatgaaggagagagacaggatcattgttcatccaaagaacgaggacagtttccagaatctagcatgttgttccactgcagtcagaacaagaatgtagggaggaatgagatggcagtgttattggcatgggttaatccctactttatttgagtttctcttggggaaacctgactgttgcatccaggcagggtgagtcgaattcaccagccaatttgtcatctcagcccggcagctccagctggatttacagggttaactatcaaacagacctgtgtgtcatcagctcagcaatgaaattggatctctttgctgatgagtgatctgtccctagggctgcacaaatgttgtacactggtgtggcagcccagaagagacccctgcctgccactgatagccagaaattctgggtagccagaaattgcccgcagaattagaaggctgtttgcctagctataagattcagaggggtttgggcttctgccaggttggcagaaaaggaacattcctgaagccaccacttcaggtgtagaaggatagtattctttgagggttcctaaggccacggctgagttaggccaaagaaaagtgtaaatctgattcaccttgatcaggaagtaattttaaaatatgtgccaacctgtctctgccctctgatcataaacgggaaacttttatgaaccttccttgagaaggaatttgctctgttcccaggcaaaaggaaaagcatggccacctgttctagaagcctggccgaaaacaacaggtttgcctgtggcattcccgcaactgcatatatcctccccacatggcaagccacccattgtccctacacacaagaagaacaaatagttcattcttgagctgggggaaaaatcagattctctaggcaaaattgcctactagacatattttgtgtttttaacatcctgataactttagaaaaaaaactctaagggaagaaggtgcatgatgtatttctgatctactaaaacaaagtaagtcacgtagctgctaaattcttgcaaggccaggatgctgctgtttcaaggaagccgtgaatctgtttggttagcccgttctgcattctttagattggaattaaaatgcccaaggacatctggcttaataatgaaagtcttcgtattaatctttcctctgaggattagaaagtcctttacaaacacgatctatttattctctgccacatccccaggagagaatgaggtggcaatttgatcctcattgaacaaatggtgagacgaaggcagagaaaggttaagtataaagagacacagcaagttaggggcaagtctggggatgaatactcacccacccagaaagactacctgtgcaggtttaggatctcaaatggcattctagggattaaaacagaatctctcttacgacattctttttcttatcattctgtaactggcaagtatattgtgtcccaagtatgttgtatggtttccttcatttgaaagtccagactcttaacagttcaaaaggcagttctgttctcatttctcccaacattgagatcaggcagcttttatgaaatctaatagaaagatacagtaactaactggaattttaaatatgcatctgagaaatgttccctttcaacagatgttttaagtttttgcacatggtttatagagctcagtgtcttcaacatatgttaaaattttaatttcttctctgctatctctctttcagcaaatgttataatcataagacttgctgtcagtttaaagatccttgttggtcattttgaaataatttttttgagtcatgtttttagttcgcttggctgtagaccgcataggctacaagcaaatccgttaattggtagttgcatgttatccacagacattccagcaagttttaaggctaagtgcatatgtggatgtctcctggctttgatcgtttgtgtggtaaatagacatccaaggtagctatggcaacctgggctgtgcgttggtgaaaggaggggatttagttactggacaaagagtaatttgtttgattagaaaaaggtaggggcaaatcaggacatttttaacccacatgatttgaggatcccagttcaatcaaatcatttggatttttctcaataggcaaaaagaagtaatggctaagcgcaccagagtatcttgcagacgtaatttaattatttttaaacaagtggttgctactttccaaaagcaatttatacaatgaaaaggaagtacaatatatcatataaatatcatcaatatccctattgtactaagtatgaacgtttttattttcagaacttgatgggactttgaaagaccaggatctgattagaggtgtgcatttcagttatctacctgcaggggtcaggcttgaagttcccgtggtcggaagatcaggcagcggacttcactgcagggagcccgaggcagagtcagagagaattgctctgcttatttggaacaattagttagcgattctttaatcttgtgaccaaagctactatgaaaatgagttcattcaaggaagagaatatcaaatacgctgtgattaaagaaagggcgataaagccaggtcaaacagcaatctaatctccgtttacatgtaaggcagtttatcgggaagattctggctcattatcaattcctttgatttcacacaaaagtgagctcagcggttttgttctagaaatttgtttgcccagttttatgagctggcatgttataaaaatttctttaaactaaaaaggacacaatattagggagccatctggatccgaaatatttttccccctctggaggaaaatattccattgacacaagatcaggatggttaatggcctccaggaggtcaggtgatagtaggagcacagaaaattgaggcgcagaacaaaatgccaagaggggactttcctgaaaaaacaaaccagaccaaagaaaataacttacctgctttgcgctatgaaagagaggttctgagtaaacatggaagaggtgctgatcatttgtagtacaagtggatgttgaaggtcttatattcagtccagtgtttatgatgaatataatataaaggctgtccttcctttcttatatcattcaatgacatttactgagcactcacagaattaatatattctgccacattatacgtgattattaatgtgccagggcactttctgggttccaaatatgactttggtaaggcccctgccctcaaagaacttttgatctggtgtacaatttattgtaccagtagcataatgtaggtttttccatggtcaaaatggatgctcattaatatctatatttgtatgggtagggatccacttgaaaaactgatggtatccaaaaccttactgaacttaggagacttgagaagtgatttgtaattgtgaaatttagttgatttttagcccacatgtccatttgtagaaatttatgacttcttacataaagcagatttctcataattattaaatagtaatttatttttctcaatagagaaaagtaactcataggtagtccccaatctaggaatactttatgttttaggagtttgttgtttgaaacccagagcattttccagcgaaaaataatcaatctgattaatgtgagatcaagttctgtgttttgaggacatgccactgtgttatacaggatggaaacagaaggagaaagaattggcatacttttggtaataggccagtcatggcaatatttgaaataggaagttcgtactagttttcacctttctttctccatccttctgatgtcttctggtctcactggggcatctcccccaggcctgtcctaatatatagtgaattcataattgttcatcttcccacccttcccttccccacctccaaaccactctcctgtttcctttagtcaatggtctctaccacatggcaggaaagaagtaatatgggtgagccaaagctcatgactcttatccctttaacccttaggatgaatctttaattggggaaatttcaagcagtggagcctggagctacaaaacacatgattttcctttcagggacaatatttgggggcagggccatgcctttggcagacagaacttgctggtgtgtctgcccgtgggtcagacctcttcatttgttctttctcagcaacctgcctgaacttctggacccactagggtctttgtgagtaacagccagggagccacaggcccccagttgagagggaattatggcgtttgtgggtttgggttgtttgtaagtatgctctttgtatgctgagcactgtctacttggattagaataaatggaaagaaaatagctgtagcatcctcttatccacacgagtatttgagttggtgtatatatttctactcgtttgtctgcttatcttggaactgagttactccagagcaagagtcacatattaattacctttgaatccccagacccaagcccagtgtctggcacacaataagaatcattaagtgttctacaggcacatgctgggtgaattttagtaaaaaagagaatggaaaatgctccttaaaatccgaagggatatgaagaagaaagggcattagaaaggtccgggaaacagcaaggactaaatagatcagtagtagagaaaattagcataggttatgattactgaactatatgtatatggttttatatatatatagtccatttatatacacatagtctctctctgtctgtctgtctgtctgtctgtctctctctctctctctctctctctctctctctctctatatatatatatatatatatatatatatatatatattcctttcagttgtgttctgggcaagaacacaacccaaaacatggtaagcagcttggcttatcctctgtttgattgttctgcagaaatgattacgaaatgggtcatgccctccaatagctcaaagcctaatcgccaagatagaatctgctgctttctctcattgaacccagcctgatagtttaggccttaggtccatgtgcagttgtttaattttgcaggtgagtggcatgcccaaggttactccagaactgagatagcgtgtctgagagaagactgaagccttctccatgtagatggtggccacatttttcatagtgaagttcaagatttgtgccggacaaagcattttcattgctggtaggtgtaacagaccagaagttatagttaaaaatgacaaaatagaaatttcagggacatttaatagtttatggaaacaacaggactaatatattaccaaagggtctatgcggtagactgtggtatctgtcctatgtcaagttttggagtgttgctttggttgtgtgtatttagaagtggtcttccccaaacaattcggaggaagggggatgttactgggaaaatggaattcattgaatgccctgctgagttaataataagtagatgaatggccaaataaagcaatatatagatggacggcaccaccaaatattattaatagagatttatttacttacataggatcaagtcttctgtacgaaatacattaggaatccagactaagaatactggttaaagtttagcatttctgggttgacgttttagcacaagaaacactttaccctccatctgggagcaaggtatgagggagacttaggttctacacctagaagctaagtcttctagactccccatctcattctcttttgtgactgtaccacatgccttctactaagatataatttggatgttttcaggtcatgtgctataattcaatatgctaataaattccaaggcaatttgaatggaatgttggtttataatgaggcaactcaggaaagactacatcatctttagtggaaaatactgtccaaaaaatccaaatagttaaatgatcttatatttgggttttgtgcttcttttatgtgtatattctttgctctgattttagttaagtatgaaaatgtcagacagcaaaaactaggaggattatatttatataaaagaaagtttagggaatgagatgagtcatttagcccatgaattaatcagctgtgctttgaggaaatagtgcaggaaggtaaaatggaacaaatagacgagagaagaaagcgtgacttcttttagtcaacatatgatggggaaagcggtagagaaaaattggctatttggtgagtgattcacttgagttccttttcagtggtcaatgtttaaagtgaaatcctaatgagattgttgctgccctttttgtacggctctgactaaaagagggaaaacagtcataataattaattgagaggggtatgactttctgagtagataaaaacatgatagactattagataatgaatatttattgcttgatgcttctcagtctggaagagacactttctgaatatttctccgctttctaacatttcagctgtcagaattgaatggttcacatataaactacattgttttggtttaactaacaaagagtgataagacatgaattgtttgtgacagccccgaacattgataacagaagacattaatgcctgcagacacagcctacatggtaaaaatctggaaacaaaaatgcttattatgttaggccatcgtgctttgacctagttttgcttttctgcttggaaattatgtcaatattagttacatcatcccttcggatgagcaattccacattcttgtttatttcagtgtcatattattagtttttgtatatttagttctgacctctgaggagccaaactaatcctcattgacttgcattttccttttgaaatgagacttctgcatgataaagagagaggattttatgtattaacaaaacaatctaagatgcctctttaaaggcattcatttctccttgatccggagctactgccctcttgaaggttcctagaggccatccagttttctgctgatcagaattagtctttttttctttgtcttatggggatggaatagattactgggcctagaactgccatagttgaataacaaaaagtaaaactgtgaggctgatgggacatttcccagcccatcatccttaaatttgcccttttcatgtttctgctttacttcttcatccagcagaaacgggcttagcatatttttcccatttaacatttttattgaatacttttcaaaatgaattatttccgcagttgatttcgaacacatttttttctgtcatttaatactttatatcactagaggaaagaaccatttaattctttcatacatttatgaattctaatcttcaaagagtgtgagttcttcaagtgatcaacttacatcaaatttacaagtataatttactaccaaaagaccttgaacgctttttggtgcacatgttttggcattccttattaacaaatgtaatgaggcaaaagcccacaagaatatgtattcctggttcctctttaaaaatgtaccatttgctcttattttctaattaaggctttgaaggttaaaaatccctttgttgttagctcctttacaagtctcctgcctgagtgcagaaaacataagaagggagtgtcctcttcagagcataaccaaaccaactaaattttaaccaggtaaattgttgattagcattggatcatgtaaagaaacagtatgaaagtaattgagataggcacaactcctaattgtgtgatcccagggggcttcaaacattgtttgaaacattcacctcagagattatattccatgtctgatccttatgctaatttgaatactaggatcctgaagaaaaactttataggatttcttgagtccctaattggtatgtaaacatcgtcattcccaagctgcccaaagttgtgaattatagtataccatgtgtctcctgttgtgatatcaatttctacagcaatttttctgcttgttgtaggcaaatgtaaatatatttccctcctcttacacaaatagtggcctttcacatacattattcttcaccctggcttttttctgctttagagtataccctagagatctttccataacagtccacagagagcttcctctttaaaaacaaaacaaaactgcatatcattgcactatgacgatgtaccataattgatttgacccttcccctactagtcacgtggagtgtgtccaatattttgccattaaagcaatgtgcactgaaaaacgttgtgttcatcagtttgtatggggcggatgtatctgtattaaaaatccccagaagtgggattgctgggccaaagggcaaatgcagtttctaattttgataaataaataacattgtctaaccagcctgtgtgagagcactgccccagagcctcatcaatagagagcattgtccaacttgtgcacctttgcctatctgatatctgaaaagcggcatctctgtgtagctttgcattctcttctgagtgacgttgagtgtctctgcatgtgttgaaggtctatttgcatttcttgtgcaatgtctgctcatatcctctgtttagaaaaacaaaaagaaggccgggcgcggtggctcacgcctgtaatcccagcactttgggaagccgaggcgggcggatcacgaggtcaggagaacgagaccatcctggctaacacggtgaaaccccgtctctactaaaaatacaaaaaaattagccgggcatggtggcgggcgcctgtagtcccagctactctagaggctgaggcaggagaatggcgtgaacccgcgaggcggagcttgcagtgagccgagatcgcgccactgcactccagcctgggccaaagtgcgagactcagtctcaaaaaaaaaaaaaaaaaaaagaaagaaagaaagaaagaaaatgccaggtctagtacaacgatgtttgatgggtttttttgacaatgataaaactactatttagtaagagaatcactcccggcagtagacttagaagcacactatcagagaccctcgagtaaagaccctaacgtgccacatcttaactctgtgaccttgggttgattccttaaacttcccaagtttcctcacctgtaaaattgaaatgatgtggacaactcacagggtttatagaataatcactaaatgaaggattatatatataaatgatatataaagcacttaacagagtattggttacatactaggcacttaaaaatgttaggttaacttctctttttttaggtacaaacttaaggtttcagagaaggctgggttttatggacatttctacctcttaccctctgaatgaatacacatccacccacacagaggcatgtaaatatacacatatgtacacacggtggaataatatctgaaatggctgtaatgattcaaaagcatctctttagacaaatgtgtgtgtgtgtgtgtgtgtgtatgcacgtgtgcatgtatatgtataaatatccctgtaatgtaagaaaactaatttgttgctaaaaatgtacccttttcggacaaattatcctaatatgctaaaacaacaccaaatagtattaaatggacatgatcacttatcactacctttcatattataatccaaaaaagcatatttttccttcatctatcttattctttacaacaattaaactcttttacaatgttacacaccttatacttacagctatacctagaaataaaattacacttatactcatgtttatgtatttctgtctttaaaacaaaaaaataaacacagcagtaaatacaaaaggtagaaatggaaaaaatgcattttagagggcatggtgctgagggctgagaatataacactggtctttaaaacaactctaccactgtgaatgagaccatttgggtgatcttgtttcccagggctgtgttgttacagaaacataattttaaaaattgtattttgaaataattacagatccataggaagttgcaaaaaaatgtactgggcagtctgcaccctttacccaccccttaccccatccctaacccccagaaaccagtaatcatctgttctccatctctataattgtgctacttcaagaatataaacgtaatcatacagtatgcaattgtttgagattgacattttttcccgctcacttaattttctagaggtttatccaagttgttgcatgtatcagtcgttttttcctttttattgctgagtaatgttccttggtgtggatatatgacagtttaatcatcaacttgtttaaggactttggagctattacaaacaaagttgctatgagcatttgtgtgtaggattttgtatgactgtaagtttgcatttctctgggataaatgcccaggagtgcaattgctgggtcatatggcaagtacacattcagttttgtaagaaactgccaaagcgtattgcagagtggctgaatcattttacatccccaccagaaatgtatcagtgacccagctttctctgcatcctccccagcatttggtgttgtccctgttttcattttagccattctggtaggtgtgtagtggtgtctcatttgtattggttttcaaaaagtgcagaagatacttcataatccagtttgggtgtgttcaatacctcccaggtaaaattctcacacataatatgggcctatcttggtacatgactgaattgtcaaaaatatctatgattgctgccttttttgttgaaccttaactgaaatattgagagcaaaaaagaaactgtgttgtgcaaaatatatccgaacattagactgggcttcaatttatactctgagacactcagagaattgttacttgctcaagacatggcagatgcacgccccaacacctaacttcactttaggaatagacacattaggtatcaggaaaaattgctaagactatttaaattcctctccccttttccaacatattccattgcctttgcatttgcataaattaaataggggcatgatctgtcttcattgtcaatatacatgtagatgtgtgtaaatctacaaacatacatatacacagacatacatacactggctctgtgggcgtcaatcccaaatgttccccaacatccagtctagattctcccgggtcaggatttctcaactttggcactattgacatttggggtttcataattatttgtggggctgtcctgtgcactgtaggatgtttagctgtatccctggccttaagcaactggatgccagtaacactcccatgcccccaaagtgtgacaaccaaaaatgtctcagcacattgcaaaatgtctactgggggcaaaataaacctccctttgagaatcactggggtagacagaagagaaggagaatctcaggcttcaggttacctcactgggtttgctgaaacttgataagaatctccttaccagcggggatcaggttttggtgcccacctgttcatttctgataactaccaatctctaaatctgtttctgcaagttatggctgaagattagtggttaacagagaacgatatcagcctttgtttcttaaagagcttatattcaatgctttaaaatacaaattggatctggcactgttgtggttcacacctgtaactccagcactttgggaggccaaggtgggaggattgcttgagccagggagtttgagaccagcctgggcaatatactgagaccccatctctacaaaacaaataaaaaattagccaggcctggtggtgcaaacctgtagtcccagctacttgggaggctgagtcgggaggatcgcttgagtctgggaggtcagttctgcagtgagctaagatggcaccactgcactcgcctgggaccttgtctcaaaaaacaaaacaaaacaaaataaaataaaacacaaattgaacacacataattgaaaagcaaacttcatgcatacctggttttgttttacttttaatgatgttttatcacttatattagatatcatgattattttaacagatacaaaatttaataggtaataaaatacctcataaaatagggtatatctccatatgcatagagaattttatagagaaattggcacaattcctggatcttcctctgattcaatgtgtttatctttgaattctaataggttttaaaagacatttaaagaattgcaaaacaggcaaaggaaaatatgatagtgttttataatttaaattatgtctacatggcaacaataattattatataaattatagaaaatgttatgtattttttaactttataaatttacccctacttgataaataatatattttgtatttattacatttggtatataaatatatttctactttagaattaaaataaggtgaaaatagttattttttgaaatactgttaagttgcatattcttacctgtattagaattaaaatatgtatcttatatttatatataaattacaaattacctgaaaaaagaataaattataaccgcatgtaaaaataaaatattcctgtatcagttgtgcaatttaaattccggttttagttttcattctttaagttgttacatttggaagatttggatagtagttatcatgaactcactgttatctatggctctgacagtaaaatacgccattgagttgtactgtaatatgaatctcccgggaacgctaagccaattcagaatgaggcattcctgtctcaggaatagagatttataaagtgaccggaggtatcactatttctagaggaaggtgcaccttgaagtattctcattcttttctatgcatttatgatcccagcctactaaactcaagcaacacttcaatacagcaaagcctcttggaagtatatgagtttaataagaaaatttatgaagaaagaatacactgaaatgcagactgacccccaaaataataggatactttttaaaaaatgtattagtttcatagcatggcaaataatactcaaaaatactttgaaaatgcacattttaaaaatgcccaaagggtttagtagattatgttgagagaaggcattggaggaagaaacattatagccataagaaccaggaaaatgatcctcctttgtttataggattacaaagaggaattttaacttctaaagtgaaaatacaaattacttgtgtaggctaaaatcacccttcttagaggaaatggtacaaattttcttcatatagtttatgttcctccagaaagtctctgtgaagtgataacattataactgcatgcattctcctggtgacttcatttaaagtctgtgatgtagtaacatcatgcacacttccctttcctacagagcccttatgttctctatagaccaagaggttaattaatttttagagttatatagcaaagagttgccagaaccccaaataacatatctctaatttccaaaattgcctgacaaactatattttaaagaagccatgttattcttaggataaacctaataatgtcactttaatccccagtcatgctcatctttgcctttcttccaatatgtgcaaggaatatataaggtgaccttttaaggttacagtatcttcttacaaattagagttgatgcactgaggttataacagcagctgagcattctcaaaagctgcagattgagccgacaggcagattagcaagtacataaaatgttagtagagaaaaaaaatagacttcaattttttggcaatcctgttaaacaactctgtgaataagtctttgaaacttgtacagtggaaggtttgaattttcctcaatgcctggcacaaaacttacctatctgttgcatatgtgcattgctgaattaattaatggaaagtaaaattttaaaatgtaaccttggttatttgggataaaatggcacttccatgtaatggaatgtcataactgaaattgtagggattttcagatactctagctggcactaaatctcatcagagcccttcaagttataacataagatagcatattcaatatgagaaaatatttaattgtcagccttaaaaatgtatatagcagaggcaatcccttttttttctgacaacaaagccttctaaaagcttttcaaactatacagctttgagatttataactttgaaccaagaaaacataatttcaagaaatgaagagaacttctgattaattctagtctaaggcagtgaagtcctgctagattttaaagtattatattcttcataattaatgtcaagataggttcctccctgtggctcattattttcttgtaaaaagtacatactgcctgtgtttttaaatttcaggttttctcatgccgctcttgtctaatgatccagcaagttcaggcatataatacttttgaagaatctatatttaaagactaattatttatgcatgtgtgtctatgtattttgaaatatatatatttcaaaagactgtttttagcctttggctcaaatattttttttttaaggaatataatattgaatatctggacaggttaaaaatctccaacatttaactataaatgttaactaatgctttccttttcatttgttaaattgctgcataaatgctttaaaaagtatgttaccgttggcattaagacatcatctcttttacttaccaaagtgcaccaatctttgggattgaaccattgtagctgctttaagccaaaaattctccccagccgggttccttatcatcacccttgccacagaatctatatcgttgggagttaaagatctttggtctcaaaccttatcctggttgaattcctgtcatatcaccagcaacccctttctaatggcccccaggaatgctagcacaacaggggatcttcaggaggctcattccaatgagagacatcatttgcagtgacaaagtttgtccttagatgaaatctgtatctctctctccctatagcttttacccctgtttggccccctctctacaacacagaacacgtgcagttactctgttctctgacagctcttcaaagacaaagctaacatggccttctgggggcattttttccaggttaaatatgcccagatgtgcttgatttggactctatcctttaggatcaagccatgttagtaagtacaaatgtccaacatttaaaagaactgttcataagagagactcaccagattagaggaaagagataccattcagtttctaatacacagtgaccttaatgccactattttaagctctctctgcctggattgtagagactttgcctagtttacctctggaatagaaattctgaacctttgctagtgagtgagcaataacaatgatgacagacatctagctagatactaagaaaaaaagtcatgaatgaccaaagtgtgaattttgtttctttgcttgtctgataccccatggctatttgcaatatcttattgtcatgtgctaaaggatttaggatattaatcaaagagaaaagcggttctaagatggaagaaaagacaaaaatgtgggcagataagtaggaaaagaaggggatgaggattcaggagctttttccaggtacttggaaagttgaaggcaacttaaatcatttttaataatttaagaaatatcatttttcatttttatataaaatactaaaagtctggaaaatatataggcaggcacagtgtgttggcaatatgctgtttacaggttggcaaaacaagccagtgtctaatgaaaaggaaggttgcgaagagcttagatctgaaactgagaggcatgtcttgttccacaccttgagaaacacttggcatataccaggtgctctgtaaatatttgcttagtaaatgatagaatgagcatgtggtggcagaatgatgccttacatggcattacccagactcataggcatccctagggactgtaagaaaagtttgtgggcttttttcagcgttttgaaaaacccagaagatattgtataattactttttcaatgattgttttatcaaatacttctaaacctgaggatttatgaagttaaaagtgaaaaggttttttaaaaaatgttatgccaaatgagagaagccagtcacaaagggccacatattgtatgatctttttatattaaatgtccagaagaggcaaattcatagatccagaaagtagattcgtggttgccgggggataggggaggggagaatgcggagtgagtgctaatgggtatggggtttcttttgggagtgatgaaaatgctctggaattaagtagtggtgatggttgcaaaactctgaatatactaaaacccactgaattatacacttgaaatggatgtttgtaatgtgtgaattgtatctcaataaagctgtttttaagaatgataagcatagcatccaagcatttaaaaatttttttaaaagtggtcattggtggtaaaaaaaaaaaaaaaaaagtcagaaactatttgcttaattgttacagagattttatcccagattaaaatactccaattccgcactttgggaggctgaggcgggtggatcacgaggttaggagatcgagaccatcctggctaacatggtgaaaccccgtctgtactaaaaatacaaaaaattagccgggcatggtggcgggcacttgtagtcccagctactcgggaggctgaggcaggagaatgggcgtgaacccgggaggcggagcttgcagtgagtcgagattgcgccactgtactccagcctgggcgacagagcgagactctgtctcaaaaaaaaaaaaacaaaaacaaaaacaaaaacaaaaactccaattccatttcgccaaagggaacaagcagaatattcccacaaccctagggaacaggggtaggcttggctattagtcattctccttcttccccattcccaataattggaaaaaaaaatgtgtgtgcacacgtacgtgtgtgtgtatgtatatgtctgtgtgcatatgtgacaagggcagtagtcagagcaggatcatgtgactaccaggatctatggacagccccacactattaggggagaaagtgtcaagctatttgtacggttcttatagagcatgaatctaggccaggggtcagcacccttgttcataaaggaccagacagtaaatattttgggttttgtggccatgcagtctctgtccaaacccctcagctcgacatagactatataaagcaattggaggtaactgtgttccaaaaaaactttatttatagacactgaaatttgaatttcacataattttcacaagtcacaaaataatatttaaacaatttttttttcaaccacttaaaaatgtaagaaccattcttagcttgtgggccacacaaaaacaggcagaggcctggatttggtacataggcggcctgtggtctatagtttgcagaaccctgctctagggtaatgactgagaaagggactctactaatcagcaggttgttgggaagcacgttacttaccttaagccagtataaaacttaaagcaataatgctacattatgtctaaaggctaagctagtgagaggctaaattataacactcaacttttttagcaaataattatgaagcatcagctaataagaccttttcttaagagtattcagagtataataatgctaccttgtgtggtttggggatttttattttaagttagggaagctatgaatctcttgaactttgtccattaagaagtctgccaaagctgtgaattttaaagccatgggaatttttcattgcgcttggctgctgaattttaacagcaaagttattcattaagtccacatttaaaaaaaaaagtatcaacaatgcttctttatactttatctgcatttgacacacttccagatagatgatctttaatttgactaatgagtgcatcctttgttattttaatgacaagtaatttacagaaagagaaaagcttttcaacacgcaagtctcttaaatctggaatttaaagtccctgatgttcagaagcaggaagcaacagttggtgtaagacagggccactaggacactggaaatgcatcctgggtaatgagtgggaaatacaaaaggaagaaaacagttggaaatatgttggccattttatatgacactttctgggtttattttcaggttggagcacaagtcagaagctgaagaacttggagattttggggagcatatgtcccaccttccccaacccccaagtatccaaatatcccctttggttctatcagagaagtattaagatttattaattagaagaaaaattaaagttataaatgttcaataggaacataaggagaattcaaaaaaataaaatgttgagctcaccacagttttcagcagaaattttactcttttttttttctttgttgagatggggtctcactatgttgctcaggctggcctcgaactcctgggctcaagcgatcttcccacctcagccacccaaaatgctgagactacaagcatgccactgtgcccagctaaattttactctttaactgatttttcaatgcataaataaatgaataagtgggtaagtacttactgaggacacagttttcaaccaaaccctgtagatactcaggatgaattaagcatgggccctgccttcatggggcctagggtttactcaactttacagaaaacccagaaatatcctaacaaatgtggcaactgaagaactttattcctaatcctaaaactcactttctttattctcagagcaatggatacagcattctaatgtcaaatcattgtttccatgttacacaatactctaactgtcaaggctaaaccctgtcttaaggaagggtgacaatggctttgttcttatgataatagaagagataaaaagattatttacaaagctacagcctctgaaaaattggaagtattttatacaaacaaccacctcaattcttctcacagtgatatttaagtgtttgtgcgtgctggtttctgttatgtgggtctttaccattttcattcctccttgcagctctatgagttaagtattactattattcttttacaaatgaggagcatgaggcctggaaaaatttaaaaacatgcagaggtgataaaatactgggaaagtttcacattcaaccatgtctgatgcttaatccttttccttctctttccaccatagcatatgatcatggcatatcatcactgtttctgtttcccctatagaaaattcaggaaaattaacacatggaagagtattcagactttcacttttcttcttacataatctttgagcagcccattataggaaaataagggcattggagatttgaagaggcagaatgaacacgttctagatgtagaaagaaaagttctaagcaggtaaaagacaaccagagtgaaatacaccagatggatgcttgacttggagaagatgctaagcactaaataagccaggtggtagagggtgtgaaagcggagagccctgagaaattgatcattaagcggaaggtgattaaaatcttcctaagggacagttggtcagagcagaggtcaagagctaggacttgtctggcaagacttattgtggattcttgaagggttaagaagtcagtcagagacccgggattggatactgtatttgaactgattgtcactcaccagaatctgtgatctaggagacagacattgccaggatcccccccgtcaggatggtcatagagaagggaaggtgtgttcatttactattgctgcatagcaaattagcacaaatgtacagattaaaccaacaccccatttattagctcgtggctctgtaggttgcaagtctgggtggcccagctgtgttctctgctcagggtctcacaagactgaaatcgagctgttggccagacgaagctcttatctggaggccctagggaagaatttgctgccaagctcgctctggttgttggcagaatttactctctggcagctgtaagactgaactccttgatagctataagctgtggtccactctttctaagggacatctgcattccttcttaagtggccatctccaacctcaaagcaacagcacattgagtccttcacacacatagaatctctctaaattcctctttcatcagtcaggaaacgttctcagcagttaagggttcatgtgattaggtcaggcccacctgcatcatctccctttctaacatcaactgtgctctgtaacacaacacaatccaaggagtgatgtcacattcacaagttccagggcttcaggtggacatctttgggctgccattttagaaagtctgcctaccacagaaggtgatgaagaatctcagctcctgccttgctccttggtgagctgtgtgacctgtaataacagcagctttgtggaaaattggcccaccctttcctagggttaaagggccaaagcgaagttttgtgactttttcttcctcttctgacactggcttcttcctctaaggaaatctgctgcttttggtgttctcttctttccttcaccatctcctggtgttggtgccaagaagcactggaaggcaggtggtccatcaatttagggcaactgaaggttttgagatcaaggcatactggaggcccagacatcacaagagggcagcacagagcaagagctgataaatgttgagatgcagacttagcaggccctagctctttctgagatgatgtgttcatctgccctcaaaacatcctctcactcaacatgtgcctcctaacccagaccccaaggagtctttagtaagaacatggcagatatcacatgtgctgaccatggggttatcacaaaacattaactctccaaaaatctgctgcttggaaccttggtttctgcaactaagaaatgagttaaaaatgtattcaaggttgataaatttaaaatggaaaaaatcatcttctgaactctagcaatatgaaggccactttttacaagtctgatgctgtagtgcagtgtttacaacctattttcattttcaaccccctgtcacaaggagcctgttgaaacattttttgctaattgctccttgcatgaaattttaataccacaaatatagtataaatctatttatgtatatctgtgctttgtgcataaaaagagtaaggttttttgtttgtttgtttgtttgtttgccactgagaactagttttctcgctcttgggggcaatattgcccctattgacagtgcatgttataatggggaaaaattgctaacattttaatatttagtaaatcttcagcttatatagtctatttgatttggaaggtggctgtaatactttagttgtactaaaaggtacttgaaattaatcttgaaaagtcagaagaatctttacacatgaaaaatcacccaatatattatatttaaaataacaacttgcaaaacaaaacgtaaagtctgatcccatttttgtggctaagaggtacagaaaatgactagaaagatcaacctgtggaatgttgcttctttgcggttagatccttctataggtgttttgctctttgggaatgttataaatattcaccaatatacattatacatatgtataataaatacatattatattcatgtcaagaagaatactatttaaaaagttagccattctctctctctctctttttttttgccttcaacatttaggattaatgggcagtataaattcaatcattcacatgtagcaaaaggagaaatatttcacatggcccattcatgactcctttagatctctagagggcttcaagcctcaaagtttattgttgcattcttcttaattctggttgaatgcatgtacattattttctgcaaagaaataccacccactaaagactgttccttctcttctaacagggttttggtgtccccagggctcccttagtcctatttactttggatatttcaggagttactgtaggtttaactgtggtgagtccttaagccctctttttaaattcataaactgtctctaatcttagcaaaatgtcaggttacacttttgagaggtttgggaacttgacattttgtagcccagttggggtgtaggctgcttctattctgagcaccttgttccaatttatgtcaggaggaattatatacaggtcagggctgggagcaggttataattaatggggtggacaagtggatttttaatgtttcataaaataaaatggaaatcacatgttcttggaactgttgtatgttttaaaatatttacatttattctagtaaacattaattataactgatatatttctcctatgaactcgctaactgtgaggtcacaagccattgttcactgagtagaaagaatgggtgacaagctagttacaagaaaaaagacagtacttgggcgggtatcggtgagtgaactcgtggaagtaatccagtcttaggtctttctcctaattttctcttatgtttaaagcacccccttgccaatatgatccagatgtcagtccttctaagacagaactgggagggtttagcctgtgaaatttctgaatagctcctggtgaagaaggaacacatgaccaatgtttaactatttgtcttttcaaaattaaagtttagaagtagttgaaatactgccagaatctacagcgtccacgttttattcatattagtttatcaaaaatttccaattccttgaagctgtagcagcaatatgttgctgaggaaagaaattttttttaaaaaaaatttgtacttataattgacacctaataattgtacatatttatggggtacaatgtgatgtttcagtacatggatacacagtataattatcagattggggtaattaccacatccatcattttaagcatttattatttctttgtggtgacaacagtcaaaatattctcttctagctgtcttgaatatatattacattgttatttgctgtagtcaccctactgtgtgatagcacatcaaaacttactcttcttgtctaactttgtgtacctattgaccaatctctacccgttcctcccttcccccataccctcagcagcctctgggaaccactgttctactctctactgctatgaaattgacttctttagattccacatatgagtgagatcatgtggtatttatcttttttaatgtttttaaattttattttattttatttataatttgaatttttattttagattcaaggggtaaatgtgcaggtttgttccatgtagtaattgtcttctgtgcctgacttattccacctaacataatgtcctccaggctcatccatgttgccaaaaatgacaggatttcatcctttttatggctgaatagtattccattgtcctaatcatccccataaagaaatatattttctttatccttttgtctgtagatgggcacttaggctgattccatatcttgactattgtgaagagtgctgcaataaacatgaatatgcgggtgtgtcttcgacatagtaatttcacttccagaaagagatctttaagagtcagaaaaacccagattctaaactggtctctgccatgtgccagttgtgtggccctggagaagatgctttaactctgtgtctcagtttcctcatctgcagaagggggaaaatgatacccactatttagggattgggtagggattagacccaatttgtataaagtgcctggcatattgtaggtatttttttaaatgccagttatggatatatgaaggaaagctccaaaaaatgaaattcaaaggaagccttatgtaaattgcatcacatgtcaaccatttgggtgttaggaatattgatgcattctttattttgcctagaattcatcactccctaaataaatattatttccattaagtcaccaaattttatatatattctttgtcttgtatggtgaagaattaatacaagtgcgctactctattagggtataacagttacctaagtaatgtatcatgagacctttttgcccttttctaaggaaaataagtatttattggaaggacaacttcacacacagtcagcaggtaataatccgcagtacttcccaatgctgcttctatgggctggaagagtgtttggtggttctatatggcacagggctacttgtccatacccttgacccaaggatgtcacgtgcacccaatcaacctggaaatcactgtggtgacagaagttggggcccaatcaccctcagggccttgacactgattttgagtataccagtttggaaagtctctgcagaattccccaagacattaagtttataatatcccttgaggggtccttagaaagaaaaagtgcctatgttttggtgtcattatcgttcttcagggcaaggcttggtgaaaagatactgagagaagacagtacagatagaaggacaaagcgaacaaaaataaggacccactgattttatctttgcaagctctaaactgagttacagattgagatctaaaatatatactcaatacatgcatcctcaaaatgttcttcacacatttgtgcccaagacatagtagttgataatattaatacataaatatatatacacacagatatatatgccttacaatacagtcctatttttagtgtgtaacaactgtactattttcaaaatagtcatcggcacaaacaccagtaccacggctaaatctgacattattgatcttttctccctctaagaatatcttttgtaggcccataagtgagagatggcagatctcctgagcttcattcagtcctttatggaaatatttatgaaaaccctactgtgtgctcagtagctatcagagttcttggcatataaaagatttcaaaataaatttgcctagtattgctttgggggatgaggacttggtgatatcttcctctccccaaaagaaaaagtggtgtgtgtgtgtgtgtgtgtgtgtgtgtgtgtgtgtgtgtgtcagagggacagagacagaggtagagagacagagtgtgagagtgtgtgggtattcagagagagaacatgagtcccagtcttatccttatcttccctcatacaatgcaagctatttggaattgtagagctggaagtgatcttagctaacattttcccaatctcctacccaatacaggagcgtcttctacaataaccttcatcaaagggtggaacgctaaaatgtaagactagaggtctctttttgttgggcaataatttgattcaattatggtgtcattatttggtaactcaggtggcacagtataaatttctgtgggaaattggaatggggagcccaagctggactggacatgactgcaccatggaaggaggacatttgggaccagtcttgagctgccattgtgttccactgggaaactaaacactagtgctttctcaattagtttatatatttctcaaagtattccatagtctttagtttgtgctaacaaaattgatcggaagtactatattaaaattatcattcattttttactcttactgaacagcagtgagaaaagcaggaatctttgtcattttgtttagcatgtaaatgcacaaaaacctcagcttacctgaactttgctaaaatgtcaaacctttattaaccacaagttttctacattatacttttcctaaagatttgtgaaatacaaggaagaaggtgatattatgaattactgtaaaaatccatggtcatggatacaattatacattcaagtcaatctcctacgtcatctctatttatgatcaaatgaaaaaaggtctttttaatgatgatctcaaggaaaaataagatttgaaattacctcaaacttttcaattagatccaatatgtgatttgtagttatgcaagtaaagtggactcaagcattgtagaaatgtttcaattaggattttttttaagttaattgagatttgatcatatttttattgtcatctttgttcccacatggaaattaattccatttcagacttatttcttggagggtgtttagcatagttatcaccttaaatgagtagggtagggtgcgtagggtggcttttcatttttggaatttaattattactctctctatatatatacatgtatatatatatgaaaaagaaagagcttgccttggcagaagtgtttaaagaaacatgagtagttaatgccctcactgtgatttgacttccatcttcctttttttaagcacatttttcattttttccccctttaaacctgccatttagagctgaaaagtatttttcaagaaatggagcaatgctttctatcccatttattaaagtaatgcacagaaggaaatgcaccgtggtaaaaacaatttatacgagaaatgataatgttttgctaaagataaccaggaagtgaggaggagaaaaaaacccctcaaatagcagagagaggccagatggtctttttttttttttttttttttttttttttaacgcagtccctaagcaggaaattttgtttgattaagaagacactggtcttgattttcattcagcagttttgaggaactttttttaatggacacacacacatatacacacacacacacacacacacaccacaagccattttcattcagccaaattatcatttgtgctattgtaagcaagattctgctgatgaaaatgtgaagtcttaatgataaagaagaaaacgagttcccaagtctcagttatgaaagaacttggaatttacccactaccctaaagacgctcgatcattaccatatccatcatattgttgtaaggtctggtgttttgttttgttttcttttgatagcctggaatggaagaaagactgtgtaccacagtggctaactagggttttgtgagatacagggtagacccgggggaaaaaatagaggttttggagttcaacaccccagggggctaatgtgcataaagcgactgctccaaaggacctgagtttaatccttggagctgccagtcaggatcaggatgaagaagcacccatgcaaagaattgcttctggatgctgataggcagggaggtgaagggggggaggtgggaagggggaacggagcacccctctttggactgtgatgttttggcagtcggtgcttggaggagggtagctggcagtggctccggcacaataaagctcccttcggtgaagtcaccagcatccttgccatggtctggcaccctttgcccagcacccctggagtgtgcaatttcccagtctgtattctaaggatgaaaatgactaaagttgtgaaactaactatttgcatctgtttcaaagagaaagagtcacttggaatttggaatggaaagaatagatttagacaactggcagaattgttcggaactatgccctgaatcaagagaccctgttgacttatataaggacaagctaaaggagctacgtaaaagagagaaccaacatatctttaccatgaagatgacaaatcaggcattcaaatttgttttttcaaaaatgaaatgtgttctcatatagttgtgtgatactttctctaatcagtattcatatttatagtcaaaataagtataacttcactttaatatagcttagccaccttgaaagctcactgttcttaaagctagatttttttgtaagtgaatttttaagccctagattgcatcttaagtactgagttattttaattttgcctttttttttaatgtttaaaagccagcttcttgtctaatttgattcaatggataaaatgtacaggatgaaactcacacttaaaatgcatttcaatgagaattaaattgtttaaaatgaaacttttttcctttaaattttaaataaacaaataagatgcaaagcaaaataacaacaaaaaactcttaagtcaactcccttggggataagggataaccttagggataaggtcataccttttgatattaactccaaactcatgccttgtattcgtgttttacaaattacatttataatttatctcaaagataacaaggaagcatactttgataatacaagaagaatctctcagactttagcctgccttgagaatatgttttaaaagccattagaagcttcctagcgtttatgggatttgttcttatatagagtacatttttttttacatatattttgggcagaattctcaagtctccaaataaacagtttaaatcttggcttttaggccaaaaagtctttgggctgggaataactcaccctcagaagactacttgctttataacccctcccctggaatgctgcgaccctgtcttcccacaaaccttatttgcttcactgtggaagagtggcacagggcacccaccacccagacttcccaagctcttctcttggtctctgctatagctacaatagcaactttattctcctacaactgagagaagagagacagaccctctcatattgttgtatattgttttatactcagaaaaggaaagagaagcaaaactaaaggcaggtagcccggcgcctaagaaccagacgcgaaaccaaggaaccagacctgaaaccaggcctgggcctgcctgacctaagcctggtagttaaaattccacccctgacctagcaactgatgttatctatagattatagaaagacattgtaaaacttcccggtctgttctgtttcactctaaccaccagtgcatgcagcccctgtcacgtaccccctgcttgctcaatcgatcacaaccctcttacgtggaccccccttagagttgtgagcccttaaaagggacaggaattgctcactcggggagctcggctcttgagacaggagtcttgctgatgcctctggccaaataaacccctttcttctttatctcggtgtctgaggagttttgtctgcggcttgtcttgctacatttcttggttccctgaccaggaagcgaggtgattaacagacggttgaggcagctccttaggtggctttagcctgccctgtggaacatccctgcgggggactccaaccagccggagcgacgcggatcctgagagcgctcccgggtaggcatttgcccaggtgggacgcctcgccagagccgtgtgtggcaggcccccgtggaggatcaacgcagtggctgaacactgggaaggaactggcacttggagtccagacatctaaaacttggtaagactagtctttggaacttgcccactccatttgtgtggaagcgtggtctgatcacccacggcatgcctttatcggcactttggttttggttttgacttggtttgaattgcttgacggaactggtcttgggaacttgcccgctccatttgagtggaagcgtggcctgatcacccacagcgtgcctttatcagcactttggtgttggttttggttttgacttggtttgaattgcttcacaggactggtcttgggaacttgcctactccatttgagtaggaacttgcctactccatttgagtggaagcatggcctgatcacccacggtgtggcagtaccggcactttggtttttgtttttgacttgacttggattgcttgatacttggattgcctggattgcttagttttggttttgacctggcttagatttctggatactctaattttggttttgattctggtttggtgtaaactgcaaaagtgtgtgtgtgccctttttacctgttctttgttttgtggtgtgcgtgtggtgtgagcatggtgttttgtctcaaagaagcatgggtcaggcacaaataagcccaccctactaggaactatgttgaaaaatttcaagaaaggatttaaggaagactatggagtactatgacaccaggagaacttaaaactttgtgtgaaatagactggccagcattagaggtggcttggccatcagaaggaagcctagacaagtcccttgtttcaaaggtatggcacaaggtagcctgtaagccaaggcacccagaccagtttccgtacagagacagttacagctggttttagatccccttccccccacagtagttaagagaacagcagcataagcggctggcagaggcaaggaaagaccagcagacagaaagagagaggcagaaagagaggaagaaacagaggcaaaaggaaagtcagagagagacagagagacagaaagtcaaagagagaaagaaaaagagaaagagagaaatatacaagtagttaaaaaaaaaaacaacagtataccctattcctttaaaagccaaggtaaattaaaaacctgtaattaataattaaaggtattctcagtaaccctgtaacactctaatactactttgttgtcagtgtaaacaagggcatatcccaagagcactgaggccttcctatcaaaaatccttaacccagtaacccgcgaatggcccagatgcattcaatctgtagcggcagctgctttgctaacgggaaaaaaaaaattatgcaaaaaatgttgtataatttaaaagtactcagtactattgaagaaacagtttatgttcaaggtgtataagaaaagtaaaatatacctttggtaaaaggattataaggaggcataagaatgtggatttttacctacattaaaaggttaaaaaaattattgttttgaaagtttaagcgagttttgagacgttaattgtaaagaaaattctgtgtgtaaacatattagctaaagttaaaaaggtatcatccagtttttctgtgaactggacattaaaataaaaatgcaacaggtttttcttaaagcaccaacctgctctttaacaaaaattatgaaaggttaaaaagagtatataaaatcttgcttatggtcaaacattaaaaattagataaatatgtctacaaggttttattaaaattaagtttaacatcaataacactaatataaaggtaaaatttggcttatctagtataaaaatcatacagaaagcattgttaaatgtaaaatggtatttggctttctttggtctaaaaactaataaaaataggtgctaaaggaaacattcattttactagaagatcataaaagttaaaaacttaaaacaaactttggcaattaagacagcataccaagatgcaaatgcctggttggaatggatcaaatattccatgtgcacgttaaacaaaagcaattgttatgcttgtgcacatggcaggccagaggccctgattgtcccccttccactaaggtggtcctccagtcgacaaggcatggactgtgtggtagttcttttccaggattctacagcctggagtaataagtcatgccaagctctctctgctatatcccaaagtccggcaccctgcgggtcagcccccgagggctgtccagcctccgtctcccaacactaagttcacttcgtgtctctcacgacagggaggaaacttagcattccttggagacctgaagggatgcgatgagcttaagaattttcaagagcttatcaatcagtcagcccttgttcatcctcacgcggatgtgtggtggtattgtggtggacctttactgggcactctgccgaataactggagtggcacttatactttagtccaattggctatccctttcaccctggcatttcatcaaccagcaggagaaaaaataagacattgtaaagcgagagaagccccttgtaggtctttcaactctcatgtccatttagacgcaattggagtcccatgaggaataccagatcaatgtaaagcttgaaatcaaatagttacaggatttgagtcaatattttggtagatgacagttaataaaaatgtagattagtaaactacatctattacaaccaacagcagcaagcttttcatgagttaaaagaaaaactcacgtcagccccagccctggggctacctgacctaacaaaaccctttacaccctatgtgtcagaaaaagaaaaacatggcagttagagttttaacccagactgtaaggccctggccaaggccagtggcctatctctcaaaacaactagacggggtttccaaaggctggcctgcatgtctaagggccctagcagcaacagccctgttagcacaagaagcagataagctaactcttaggcaaaacctaaacataaagtccccccatgctgtggtgactttaataaataccaaaggacatcattagctaatgaatgctagactaactagataccaaagcttgctctgtgaaaatccccacataacaattgaagtttgcaacactctaaaccccgccaccttactcctggtatcagagagcccagttaaacataactgtgtagaggtattagactcagtttattctagtgggcccaacctccaagaccatccttaaacatcagtagaccgagagctgtacgtggatgggagcagcttcgccaacccttgcaaagtgactctgaagaagacgacaagccctgcttcagtcacacccagaagctaactggtccatgcacggccgaaacatgaggaaactcatcgcaggactcattttccttaaaatttggacttgtacagtaaggacttcaactgaccttcctcagactgagggctgttcccagtatatacatcaagtcactgaagtgggacaaaaggttgctacagtcctattattttacagttattataagtgtactggaactctaaaaaaacttgtttgtataatgttactctatacaaggtatgtagcccgggaaatgaccaacctgatgtgtgttatgacccatctgagcctcccatgaccatagtttttaaaataagattaaggactgaagactggtggaggctcataaacgatacaagtaaagtgttagccaaaacaaaacaaaacaaaaaaagaagtgcccaaacaagtcaccttgaaattcgatgcctgtgctgtcattaataataataggttaaaaataggatgtggttctcttaattaagaaagaggctatatggcagaaaataagtacatttatcataaattaagactgtgtaaaaataaatgtggatactggtcttgtgtcatttaggctacttggataaaaaaaaaaaatcctgtccaccttcagcaagggaaaagtggcccttcctgtaccagtggtcagtgtaaccccttagaactagtaataaccaacccccttaatcctcactagaaaaaagaggaacgtgtaaccctaaaaattgatggagctggactggatcttcaagtaaatgtcgtggtttgaggaaaagtttataaacgctctcctgagccagtatttcaaaccttctatgatgaactgaatgtgtcagtaccagaaattccaggaaaaacaggaaatttgtttttgcaattagccgagcatatagcccagtctctcagtgtcacttcgtgttatgtatcagcacaagtgtaaatatgtgaatcattatcaatctattgcacaggaagacataagtagcaaaaataagagtgagaactcccactaataaaaagtgagagtctcaaaggggggaaatgagagaagagagacagaccctctcatattgttttatattgttttatactcagaaaaggaaagagaagcaaaactaaaggcaggtagcccggcgcctagcaaccagacgtgaaaccaaggaaccagacctgaaaccgggcctgggcctgcctgacccaagcctggtagttaaaattccacccctgacctagcaactgatgttatctatagattataggaagacattgtaaaacttcccagtctgttctgtttcactctaaccaccggtgcatgaagcccctgtcatgtaccccctgcttgctcaattgatcatgaccctctcacgtggacccccccaccttagagttatgagcctttaaaagggacaggaattgctcattcagggagctcggctcttgagacaggagtcttgccgatgcccccagccgaataaaccccttccgtctttaacttggtgtctgaggagttttgtctgcggctcgtcctgctacccaattttctctgcgattattttccttctaaccctttcttaaagtgatgggctctaaaaaatcatgattcagctgctattgcaattttacctagccagtgaatttatttattttgagatgctttttgatattattgtcattgtcaaatgacattatgacatttcaaaagacattggctgtcagccagtgggatctagtcttaactcatctttggtgctcaccggtcataaagctgtagtcacatgtgtttatttcccccagcactcttccctcatttccttcctttccttcctgaaatttcctcttccagtggtgcaaaagctggtgagtaagtactgacaaaaccaatgcctcttccaatgtctctattcatttccttcctgtccatccctataagcttaactgtacatccatggttattttcaactttgagttaacatcgtagaatcaaacacttaagatattcaggtaattctgaataccatatgctatggtttgaatgtgtctcccaaaattcgtttgttggaaacttaatccccaatgcagcagtactgggatgtggggcttaatggtaaagcccttacgaatggattaatgccgctattaaaagggtttgtggaagtgggttcttcctctcctgctcttttgccatgtgaggacatagcattcctcccttccagaggacacaggcttcaaggtgccattttggaaacagagataccaggcccctaacctgctctctgttcttcttttttttttttttagatggagtctcagtctgtcgcccaggctggagtgcagtggtgtgatctctgctcaccgcaacctctgccgcccgggttcaagcaattctcctgcctcagcctcccgagtagctgggattacaggcgtctgccaccgtgcccagctaatttttgtatttttagtagagacggggtttcaccatcttggccaggctggtcttgaactcctaatgtcgtgatccacccgcctcagcctcccaaagttctgggtttacaggcgtgagccaccgtacctggcctaaatcgctgttctttataaattacttagtctcaagaattctgttatagcagcacaaaatggactaaaacatcatggttcctgcttttttggctcactaagtgttcgtggcttttctctttcaaaattttattgctaaaataaataaagatgtcactactttacaataattcatcacattccatttttttgtaagaaatagtaaaagttggatttctatgcccttgaaaaagaactctatccttgaggcaatctgaaactaagcatttaacaacttgaaaaattagatcacaaccctctgaccaaacaccagaaagttttatactgaaattcagatactctttgcttgtttattggcagggaaaaagccaaaatatcaagaaagccagcacaaatatgagtagtaatatccccttagctaacatagatttgcaccacccatctaccttctatcatgtcatcctttttatttctttcattttatgtatgagtctttgaaatgtttgtgtttttaaaaaccttttatttttttatttccttcattaaaatgtaagctctccaagggcaggcctttatgctcatatttaccaccaatttgctgctgcctagagcagctcctggcacacagaatgacctcaaaaaataccagtggaatgaaagagtaatgaaagaaatgactcatctggttttactccaaaagaagtagttctaattttttttaatgcttaaagaaagccaaatggatatacatataggatttccagtgtcataaaagtaacaaaattagcttactcttccaaactcttattttattaatattttttaataataaaaaattatagaatgcttcatgaatttgtcatccttgcattggggccatgctaatcttctttgtatcattccagttttagtctatgtgctgctgaaacaagcaccaaactcttaaaattagcttaggttcagagtgaagagctgaagttgcagaccagacccaagctgttttgggactatgaaggacattaagggctctgtttatttgagcaaaatctatgggtgaggcttacctgctttctgccaattttccttgtacaacagctgatgtcagagggtggttggataaggagcttggagccgttggtaaggaagttcttatcactttcttgcaggctccttttacctctagtcttctatgactcaagggtcattcagtgccaaatgaaattctgcctctgtggtaactgctagaaagtccagtgatgatctgatttctagtaacaactattggccatatccccaggaggagataagaattgtgtctattaggaaataattttccatggatctatcacctttttgtacctcttgtgagctggagcactgaatgattttattccagactattccccaggatgtttgtatagcaaacagtcttgggagatagaggtagtatctcgcgccaggggagaaggcaggtttgtttgttgttcattatattaaagacaatgtcttcctccagggcaaaagttgggcaggctaacttgcagtccattataaaagattcagatttcctaagcttggagttgcttaggtatgatgcaaatctcctgagtgtgcaaacatggacctaggatgctccgtaggacttcgagaacaaggggaaccaacagaacatgaaacacataccatttgagtaaaaacagcctttatctttgattcaggtgtcttctgccagcattcatgaaacgaaactggcaaatagcaaaaatctgaaacatttcactgttcttgatagtttcacatgctccatccatgccagggtcccttatttcctgcaaaataaaaaaattctgacaaagagtgcatatgggacagggtgaccttcactgggaagcggaagtgaagccccaagttcatggtgggagatcagtggtaatgaacagaggtatgtcatagtgtaggaaacagatgaaattgccaatgtgaagataagtcattagtgttaagaataaaaatgctagttcatttcacattcacatactgtttgttcacataagatgctccataaatgttattgaataaatggatttatatccttcttgcttgcaaaaatggtatgaagaggtttccagtaaaaaacacagataatgaatttattcaaagaagagtgggaagaggcgattcaggacaagaagggaagaaggaccccaatcccccatcccctaccaccctgtccttccataagagtgagaattttgtcaggcattttaaaaagttcacctcactaatcctcaaaggacccttaagattgctctcagataaggaaactgcatagaagataggaagagcatctgtgagtataagatatgtacagtatctggctccgatctgcctttgcaaggaaatggcagagccaggatttgaactcaggttatctggcttcaaggtactacatgttttttgtttgtttgtttgtttgttttttgtttttgttttgttttatatgactgagtttttttactctatcacccaggctggagtgcagtggcgcaatctcggttcactgcaacctccgcctcccaggttcaagtgattctcttgcctcagcctcccgagtagctgggattacaggcacccgccaccatgaccagctaatttttctatttttagtagagatgaggtttcactacattggccaggctggtctcgaactcctgacctcaggtgatccgcctgcctcggcctcccacagtgctgggattacaggcgtgagccactgcgcctgacctctacatgtttttttttttttttttttttttttacaggacaccacattgacagtgtcagcccaaaactagaccaagaacacttgggcacactgagctcagggcttagcccaaagttttctgaaagcatgccagagggaaagctggatgaaatgctttggtaaagaagaaagcacatcagctcatcactcatctgacaatagaaaggactgatcaggaagtggggaaaaggagaatagtggcaaaacatagaaaagagaaaaaaaaagactgaaatttttaatggagcgcaaaatcagacatatttttttacttttttgaacttctttagagactacaataataattcttatgtgataagtccaataagctatgatgatgttttattaaatgtaccatcatactagcagcttttgcagaatttgcatcagaagaaaagtataagatattaccaccatgacttggcaaaagcggtatactatattaatgttagccacttagttgctgtcattgtttctcagcacagtacccattgcctagtttccctgggagttcttgaaagctctattgaaaagttatatttaaagtgtaagttagagtgtgctgtgaatggagagaaaattgtttttctttttgtaaaaaattcactttccttgggactatatactaagttagctcagttatttgacagaaccagtatcttattttacaaagagaaaaacatagatctagaaatttccagaagcagatcactggttgaaagggcggggcgggggggggcatgtgattgaatgtgatttgaaggcagttttaattttatgacactttacagtgtgtgtgtgtgtgtgtgtgtgtatgtgttttaatgataacctaattttattgtcccagacttaaagatctgtgccacctggagaaactacagttcatccattagcatgtaaatctgttaagagtatttttgcttgaatttctccgagaaggctcccggctttgttctgtacagacacacagtcccgacgctgttcttaatatcctgttttcatttgtcagcgctgttgtccttttcattgccatgttcccatcattcctcttctttcatgtggtgctttacaataacattcagaacaaaagagtcactcctctttctgttgcctttaaaaaaaaaaaaaaaagacttcttcccctgactgcagagcttcagtgatcaggggaaatgtttaaagcatgttattcgtaatagttaaccaggagttgtgaataagggttcgttttccttactttttaagatcaggaggtagcttcagggtattgtgagcaaaaggtttttgtgtgtggctgactttgaagttgagggaaaaagcgattttctttgagaaaaggaggcatcatatttgagagaatttccaatctgctcacacaatgggaatcagttactctataacatcgtcattacctccatgagtcacgagactagtatttgttcttgtctttgaacttaagctttccagtgttcagagaacagttgtgaaatgttgcattggccatcatcaataactattttgctcctggttggtaataattgggaaggggagggtgtgtactttctctgccttctaggagagtattatataaataaagtgagaaaaagtttccccaagcggcaagcttttctccagggcacaatctattatacttgctgcaaaaatcccacttgactggtctttcagagaatagatcacttgcgtcattttgctcatttccaggtgaccttttgcagatatgagcaggcagttgtttttaaataaacattatctacaggtttctgtttctgcactaaggaaggaatgtttctgtaatgcagaagggatgctatgactgaggggtttgtgaagagtgaattctagccagtctcaaataattctgaaaaggtgcttttgtatatgtatatgtgtacttatgtatacatgcacattgtatataactacaaaaactaattccattatggacatatataggactttatacagacatagttatatgaatatatatagaaatacctatcaaactataaatacatttgagaaagcattcagggacagcagtgttaaaagcttttcatctgtgactggtttcacagaaattagtgacttccatttctgctaccatcacgctgttggtctgttcaccaggagggttgatttagacttctgccaggagactaggtgtggccatctctcaccctcttcctctctgtccagtctgctatcattgccttcagaaccaaattcttgcatgatacccagtacagcatagacctggaaaacatcggtcattttcaatataatgtaaaataggttctgtgtgcctttaaaactaaatgctttatttcttaaactgtaaaagacatgaaatgtctgagacattcagatagtgggaaatttcatctgcaagttgtcagattatgccctttagaagattgtaattttttttgttgtttatcattttctcttgaggggtggagtaaatatttctttcctgatgtttcaacttcagatgttcaggctaattttccactacagtgccaaaatagggaaaagttaggcctgtagaattttgacaatttaaatgttgttttaacaaaagccatgtcttgatgaaaagttctttagaattctacttgatgatctatgtgtgtctcttccgaggacaatgagaacttcttaaggaagtcatctatatgtgaaattgagtaatccttttattcattgttaaaagacaaatgaagttataatttggagagacataagccaaaaaatctatgtttgcatttttatgtcctaacatgtgaagcatgctttgatttactgtgaagtgttgcaatggcaataaagtagatgttgagacgtgcagactgggcagcccgaggaagcagttcttgcctctgcttcccctttatcatgaatgttccttaaacacctttggtggagtccaaatgtctggattatgaattgaattgtgcaagattctttttttaaacactttcctgatgatttactttacttgcagtttcttgtcttgcatggtgataagcaatatccttcaaagaactgcagcgcaggactttttttttttttttttcttttaggaagactacttccccttcctcctttagtcaatcaaattttaaaagattacttctttccattctcagttcaccctttctttgccattctggagactgaaattttggacacccatcacagatttgctattatatatataccgtgtatgtaatattaaatatatatatatatatacacacacgatgtttttatatatgtgtgtacataatgtatgcatacgtgtgtatgtgaaacctgtgtgtatatacatatattttaaattgtttatcaggatgatagattgctatttaggtcactatttttggaagaaataaatgactgttctttgtgtctgtactggagattgttcttcctgatataactttgaagaaaacttcttccagacattatacattaattcagaagataaaggcacaaaataatgtgtatattatttttttaaatgaacaagccagcatgcagagcataatgtgatcatgtgctcagtacgacactgaaaggccccaaaggcaaatgagtctagtgcctgttcccagccccaggagctgggcaggacggctcctattggtggcattgaaagctagcattcagccttctgccacaggacagtgtctcattcggccaagctgctgctggtccctgtaaggaatgagagtacagatcccgttgccaagtcctcatttttttggaccaggcagtgggtgttgagctgacctgagctacctttccatttgggttcagttgaacattgagtaggccagaggatagggaagttgtggcgggggccgtggaaaaggcagttgattcttcaactcgggcaaccctggcggagtggatgaggtggagctggccttcctggaattgttggaccgattttcctgttgtgtttcactgttgacgcactcacagacacacaggaccgctccagcactgcctgccacccaccgtctggtctcggtggcctgtctatcatttcgtgggtccccatcctctgcctacggcgatgtttcttcaaaaagaactagtgtgcagtccattggtgggtattcaaggtgatctctttgtcagaatctagagaggtgctcaaagaactattaaggaccaatgtactagttcctgtttttaacctgtttatcagtctttcaattgaacaaattggatttctgaaactgctgaggggttttctgcactattaggacagaacaggatagggtggttgttcctccaggaatctgggttgttcttttgcattgccatttgtctttgtgcttgtctgcttgtataaatgaacctcgagaaggagtgtttaagtattctgttaagtaaatttggaagactaggtttcaattaaaataaccagacagtgtgacccagcttccatttccccttaattttgatcattaaagccttcatatccccacagacatctgccatgcttcgaagtgattcttctcaggaatgttcattcattattaatcaggttgcatggtcaggcgagtatgtgattattttaaagaatgtcctagagatccagttactaagaatgagcatgttataggcagatgtgaaagtacagaaaagatttggttaacagtttaatttgatttgcatgaattccaccaggtgggtgtttggcgaaattaaaagtcttccctggttctcacttcagatatgaggtaaaaaaataataataataataataatttcagcacttcttaaagaagaaatgtcaagttattcaaaatatctattgtattaattattttaaaacttgaggctagcatctcagtgctcatctgcttgtcacttttttttttcaaacagtccctctggtcccctacaattttcttggcagaaattcttagttgtctgttactggttgagcaaatgaatttgagtgtgctgacatttggaggctaaatgcagtgataattcagagtaacattctttacctataaaatgttactggatcaccttttttcacctgttcttacttgatgtattatttatactgttgtttttaagaaccactttgcgtttgtactgaaacagcctacattatgctatcaatttccagtctttcagaatgcagttaaatccaactggatccccttctcccctttttccatcagttcatggccctgttttactgtgcctttgctaacccacctgcttctcaaattggccagagtgctaatcagtaaagtaacatttgggtagtgtctttattcggtggtctttatcactcaaagtcaaatactaaatggcataattgaatatgcagatgctgagtgcttgtattatgttattcaaaataccctatgatgaattcatcttggatgtagcagccagtttttattgagtttgtgttagacaagtttttgagttgagaaattatgcttatttaagatgagagcaagtcccttctgagttgggtccccgttgcaatctgcctcccaaactcaggttgatttccagtgtttcacacttcagtagttttgagtcctctgaaagtctgtatttctgctggtccaagatagaaacatcactctgcagtctttaaaaaatatttcacctatagttctataataaagataatctcatagcaaaaatccaaacagcaatagtcaactaaatctaattacccaggtgaataggggttaagaggagcggacaatcaagtaaattgacttgatttcgtttctgaaatttaggactctcaaataattcatttgtacattttcaatgctatttgttgtttgaaatacttataggagcttcctgttctgaaaccattttcgtgtggcttgctgtaacatcgtgcaattttaacagtgtgtttgtcatctcagttatgttttggtaaatttaacaataaagttagtctctatagtccagaggatatttggaaaagaactagaggaagtgccttgggaatcatctgggcagtggctgacagccacgtggtattaacgattaatcacaggccacccagtgttggcatacaagtttattccttggtctaatgactcactaatttccctggtagtgaaggctttagagttgtacaaagtgaggggctggaagtaaaattattgatagaattgatagaattgcatgttctttttcatatactccaaattagaaaaataattgtatttcatggagtatgcagacataacctagaatacttgtaggaaagcattgagaggtgggtttaccttatcattaaaaaggtcaatgcctccattaagggaaatttgggataaaaattatggatgatgtgctgatgatgggcgatctccttattctaatggatgctgtaacaagttagcacaaacctgatggtgttaaacaatgcaaattcattatcttacatttctagagtcaaaagtctgacacaggtctcactgggctaagagtaaggtatctttagggctgtattccttttgggggcccttggggagaattcatttccttgccttttccagcttctagcctgcattccttggcttgtggccccttcctccatcttcaaggccaggcatggctggtcgagtctttgtcatatctcatcattctgactctgactcttcttcctgccacttccacgtttaaagagccttgtgattcctttgggtccacctagatgatccatgctgctctccccatctcaaggtcagctacttagcaatcttaattatatcagcaacagtcagtcccctttgctctataacctaaaatattcacaagctctgaggaggaggctgtggatatctttggggaccataattgtgcctcccccaaagagggaggagtagaaactgtggtgtctgctgtctggtgaccaggaggacagaagccctgtgaggagacaccaggagccctgtagagaagacaaagacaggctaatgagggaagaggataaatcccacatcatgtgcattccaagtctgaggcacttgcagtacatgaagcaaagaactgtcagtgctaaaccgggttccagaaaggggttctcgaccatcttgggatacaagcctagcagtcattctcagagaggcagtacatgaaacaaacaaaaaactggatggccctgtcaaaggaaccatagaccatcagaaaacacttaggctttgattagcaagaggtagaagtcagcagtggttagacagaggaaaactaggaaagtacagtttcagtgacatacagtgatgtggtttgtttgtccccaccaaaactcatgttgaaatgtaatccccaatgtggtggcattgggaggaggggcctagtgggagatgtctgggtcatggggatggatccttcacaaatcgcttgatgcccttcttgaggtagtcagttcttgctctcatggagactagattggttctcacaggagtggattagttcccatgagaatggagttgttataaagcaaagttccttctcttgagcagatgccagtaccatgcttcttgtacttcccagcctgtggagccacgagctaaataaacctcttttgtttataaatcgcccagcctcaggtattctgttatagcaacacaaaatggactaagatacatattatgagagaggaaaggaaaggaagaagagggaggtgtgaaaacatttacatcattattttccagcaaaacatctacttattaattttccattttaaagaagtactttcctcataagtcttgaatctataagaaagttttttcaaaagatgtatccaatgcctcccacgatgtggggcttcactgtaatctgtcactgaagactctcctgcctaggggagtgattagagtgagtgctagagggactgtagggaacatctgtggacactcacccatggatactcagacagctaataagtagcagaactgcaggatgtcttagattatcccgtcacctgtccagctctctcccctttcattcattattctgtgctgtgttctagatgtttaaaccatggacaggcagaggtgtgagctgtgatttgttgccattcccagtttgttgcaagggactctcaagattatctagatcctcttctcaatgaggaccaatctgcccattcacaaaaatgttaagctataggatttcctgacaacaatatgcatgtgtgatttccttttattgaagtagaaatgaagaagtttttttttttttttgaggcatggaaattacattatgacagttaagaaaaggcaaaagctgctgttttatgatattggggtttttgttgttgttgtttgtttgttttgagacagagtcttgctctgttgcccaggctggagtgcagtggcatgatttcagctcactgcaacctctgcctcctgggttcaagtgattctcctgcctcagcctcccgagtagatggaatcacaggcgcacgccaccacacccagctaattttttgtatttttagtagagacggggtttcaccacgttagccaggctggtctcgaactcctgacctcaagcgattcacccaccttggcctcccaaagtgctgggattacaggtgtgagccaccatgcccggcctgatactgttattaatgatataaataacaatgtaagctatatatatatgtgtgtgtgtgtgtgtgtgtgtgtgtgtgtgtattagatacatatatatatagagagagagagagaaagagagagagaaagggagagagaaagagagagagagagagagagagagtgaaaagaaagataacattttgcataaaattcccacccatgtaccactatctgcttggtgaatccctgttcatcttttaaaacccacttcatactttacctccttcaggaagcttctccctgtctcctctccccctatatagagttgattattccctgtctgtctttggcatgcatctttttttatgttgcattacaccttgttcatttttttttctcgatatgggctcactctgttgcccaggctgtagtgcattggcatgatcacggttcattgcagcctcagcctcccaagtatctgggaccacaggcatgtgccaccactcctggctaatttttttatttttattttttggtagagatagggtctcactatgttgcccaggctggtctcaaactcctgggatcaagtgattatcccacttcagcctcccaaagtgctgggattacaggcatgagccaccacacctggccttgttcatattttctctctcggaatgaaccataagatcatggagacaggggccagctgttaccagtacttgtctcaggaccaagtacatagatgaacttaagtatttggtgaaagaatgaatggcaaaaaaaaaaaaaaaaggaatgaatggcattttaatttctccaaaaagatattttaaagaaagctagaaaataaaccatactaagtttcttttagaagaaggaatggaatgagtacaaataagatactgtagagtcatttaacaaaaatgctatctatgccattgtaaaatctgggtaaaagtggaaaaagtgggatgcactatagatatcaaaccaaaaccccttcctttttggtagcatacaggcaaaagatttagaaaattggctgaaattcacctaccacatctgagtattgtgtcttcacctaatacaattaaccatttacagtacagacacttgcataaagcactatgccaggtgctatggcagtaaaagaaaatatctagttttgagcagctactattaattcgttcttacatgagttgcccctaagcactcgagtcacataatttccattgatgtcagattcaaagcccattgcatatcatttcccattagcactggaaacttgtaagtgcttgttcaagtcttgctccgccatccttgctgctgttgcccacacagcattttattcatacctctctgagaatgattttcatttatgttctggttatctgtatatgcctctatcttccaatacatggctcaacaaaataagatgtgcaggccaatgctggcctgtgacctgtttttctaaatatggttatgttggaacacagccatactcattcctttatgtattgtgtctgattgcttttgcactacagtggtagattgagtagttgcaacagggcccctttggcccacaaagccaaaaatgtctactattttaccctttatagaaaaagtttgttgacctctgttcaaatatattgagagatccttaaagtcaagggctgtgtttgattctttttggttttagctgaaaagtcagtacatttaatggaatcaatgaatgtttgagtcattttgtgtgctgagtgctgttctaggtgttggtggtacgttcttcaaagagcaaagcaaaatctctgctttcacagagcttatattctagtgttgaggacagtggggacagaaggagcaataaacaaactaaaagaatatgtcagtgataaatattataaagaaaaataaaccgagatgggggaagaattaccacgatgggtaggtggtatagtggtagaaggggaattggttttatgtgggttcagagagaaagtgacactggagcagagagtcatgtggattctgaagaccttgcaggggcgagcaggggattgatgtgcttggcatgtttgaggagtcagaacgaggccatgtgctcagagcagagaaaggagtgggtagcgtgggaggaagtgagctcactgtctgagtctgtgttttctggggctggtttattctggtgaatttctctctgggtgaaatgggaagcccttacagggcagagcaaaaggagatgcatgttctgtcatgttttaacaacaggctctcttgcttctgagtggaggatagactatagggggaagggcaggagtgaacagaagccaagagaccatttagaaaggtcttatgatagtccacataagagatgatgctggcttggcccatgataatagagatgaggtgatgtgaaccccagattctggcttcttcatctaactcagtgcctggcacacagtaaacatctgttgaaggaatgaataaaatgtcagtatttccactgaggtctccccagtggaatcctttctagaaattctcatcacacctctctgggatggaatcctggcacctgcattaaaaatatagtcatcatagctctccagacataatttgatgctcatccttctattcagattcattggtaggcattcttgttttatctgagaacagagcagaccaaaagggctacatttttcctttaatttatatgcttctgatgagaaggtaaaagaactttgatttaaagataattctacattttttctatgattaaccaaaataattattaataggtaaaaacctttccatttcttctgagccatctgtaggaagaggtgacagaccaagtggggatgatatgtttcttacaacagcaaccctagggtttccattgcaggttgtagaaagatgtacaagctttaatatttcaagtcacagttgctcttttattctttcctatataataaatgctagtgaatggttgaagattttttaagataccaggcttttatgaagccagtagctgtttaatttttaacaggctcgggacatactttatacttttaatgatcagttaccattcagttggtagcaagatgagcattaatttcaccaaagcaccatattggtatttctgagggatgctatttcagaaggggtcagggtattctagaaaccgtgaattttgtaaataagcggaggtgtgaatacaaacgattgattgtcagaatcactaaacatagctttggatgtgaagccttcccataaatccggctgagaacgctctccccaccacccccgtgggtgatttgaacctcccgaccactgggtgaactgcactgttctcccacagcctgcaatgggctgcatgtaatattcccatcactggtctgcagacctctgctaatggtcttgaaagggagaaggttcaaagcggcttggttcccaggcctgctaatgagcatgaggcctcttcacccttaatgaactggggtttgtgtggaattctttctactactctttttgatgggaaggcagatgagagttcacaaaagcactcaggtctttatggcaaggggagcaggcagctgggccaccctcgggtggcctggaggagagcaacatagctagcagaggtcgtacccaggccaacatagctctgagtgtgaggctggacctcctgccagcctggcctgttgctggcaacagtgacaagcccgtggtgggagttttttggccaaaagggtccctcagcagttttgtaagcctccttaaattgctttctcaactgtaatcattatcattgtcataacataacttatcacatgaatatgatgaccactgaaatccttgttctaattaactaaatcattgctctaaatattagtcattggtactcaaacttactgcagccactgaaaaagcccccagatatttttctccacttcgttctgcctacccacgtcccactgctggattaaacaatagaattattcagaaacataatgaacacatgccaaaaatattgcctctatcacaatcatctttgtgaaagtcaatgttttttctcaggaatatattttggaaaatgacatcccacacttaaacacgatcatctctgctgaaatccccacatttgatttcatgtacatttcatgcccatttctatagttactgccttcctattgttctgaaacctggtttggtattgcagagtaaaagtccttaaatctcgtatacattaatacgtaagtttataaattcaaatttataaaagactctagtttattgatgaatatttctacattttaattttctgtgcgaggttaaacctgactctgacacaataagattattctgattaaatacaaattatggaaattacagtttcaattacattctagttttgaatgaagccttttaaaaaacaaaattgaaaaaaaaaattgcacattttcagttactgaactttgagaaaatgttaactggtatatgatggctcaggatgctttttcctccttttttccccagtgaatagaaagagaattatttggaatgtacacacacttaccctttcatgacctgtgtttggaattattctgagatgcattcaaagctgacacccccctatggttgacctccctgtgcctaatcaaatcttacattcttgtttccagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaaggttagtccgatccgccttaagccaacccctttctgccagaaaatgtcatggaaataaaaagtgtattcactgctagctacatggcaggtgaaggttttctcctcacctttgttatctgattagttttagcatgtttttggcaacctataaatgttacacaataagggtatcttgtaaaagttgactgctgcttgtaattttagcgttgtcaaggtgagggcaaattctaaaaatctggatcattttcaatccatgcagtttttctggatcattttcaatccttacagttcttccaaagagagtgctgcctctctctgagagagagggagagagagagagagagagagagagagagggagagagagggagagagagggagagagagagagaatgacagataaaatctggctttgggcatttggggaacacttacttttctcactcatctgggaaaactaattcactctcattgtacctgtatctagttactgcacaaacaaaagaatagagggaagaatgtctgtagcaaatgtgggattttagaggacacgtgaccttttattccttgtataaacgatatccagcttattggtgaaattcagtgctctgacaatctcaggtttcacgaaagaattccttttcgtgtaggctctttattcagtaaggttacagtcaagactatttgaacttcattttttacatgaaattattaacctaactccagcttgggggataatgattaatatgactatatgtgaaataaaaggatcactttctaggcagggcgtggtggctcatgcctgtaatcccagcactttgggaggccgaggagagtgaatcacttgaggtcagcagttcaaaaccatcctggccaacatggtggaaccccatctctactaaaaataaaaaaattagccgggtgtggtggtgggtgcctgtaatcccagctactcgggaggctgaggcaggagaatcacttgaccctggggggtggatgttgcagtgacccaagatcgcgccactgcgctccagcctgggtgaaagagcgagactctctctcaaaaaaaaaaaaaaaaaaaatcactctctaagtatggatagaaagcactagggaagaaataataagccaagtctccacatgtttgttcaatttcaggcaacagtgggtctaattattgaaaactcagctgagagagtttgagtgagatactatgttcatcagctaattttagatcacaagacaccaattaaaagaaaggaagtataaattaaaagctctaagtaaatatatattgaagtccttcctctcaggaaaaacacataccatgttgttgagcaaacaaaatgaatcacatgatcaaaagagtgttatcacttagaaaacagtgtcacctttaacaaatggtttctatcacctctccttagcgctaatgggtggttgtgtttactgggaccacatagtttattctgtgacagtgggattaacggaccacatctgggatttggctttgctatttcttgacatgttgagggaagccgacatgctgaagtcaattcctgcttctcaatgtcacttgggcaacaaaagcatcacctgggcagcatgtttcacttcaagtatccaaagaattactggtgcaaatccatctttaaaccatgtagaggaagtcaagcacaaggactcaggtgacacagacaacagaagacagccgctgacaggctttccagaacagtgcatggcagcacaggagaaaagtaccaccaaagttaatcatagcaaaggcaatgcatgtatgagctgtgcctctagagcaaattctgaagaaattgcgaaggctattaatttttacaaaccaaggtaatctttttttttttttttttttttaccccttttttggttggtggtggagctgaagggagaatatttaggataactgaacagagatgtttgatttttgttttccaaaatgtaaacatgccagatctttgtttctttattaaaaatgttcctttgattggatttgcactaccttttaatgattgtttgttaaaacaccacaatcataatgatgttcaatatttaacaactcccaggcttgatatttatttaaatcttgtggtcaggttctgctcaagtactcatggcctgtcacagcagagttattaaatatttacataacatctccaaatttatgaagaattcctgtcatgctctagccctctttgtgataaaaacaaaactcttcagttacgagccctgcacactttaattgagccagtggcctatcggttgttctactgtcacatggagggcctgacaattaatgatgtggtttctttttatttcctagttacagaaatataagcatataaacagcatccaatgcaccgaaacacatttacagccgttcaataagatgtacttatgagcatttgaacaaataacttatcgacatagcatgtttgttttaaaacatgccacttacgttagaattttaaaaataataattatgacatttggatgtctgatatttcagttatcgcatacttatgaacatatgtacatccttgttttatttaaaacctaagcacaatataaatgttgatttttttgaaggaagtaatagcataccaagaggaccaaaaccaaggaagtatatttctgttaattactactttggtctgaaatgtgctctgaacatgcatttttctgtagctctaggatctcatatagatgtggatttgtgatgatgtgagaacacagataaagcatggaggaatttgaggatgctttcattgataagacaatagatttgctttattaatttgcatatgtaaggaccctggtgtctttggaaacatttttgtccttctgttagtaaaagtttattacctgaagaagggaattctgcaattattatgaagaataatttcttgcaataatactaaactttgggggacatattttactcattagatctcagtataagagatgtttgtttatacaaaaaatcagaatatcattttgtacattacaatctttttctaagtgtaaaagaaaaagagataaaaattctaacatgttgaactcgtacaaataaaatcatccacatcatgtaaaatagcatcatgtcagtaatctaacgctttcggagactatgcattgagaggcactcatgaaatattgaagcaaagagaaaattaaggtagcatttcctgaactctactaagataaaaagagaaaagttttcctgccaagtgcaaaggtctctaagtggagcgtatccataatgtggatatttctttacatcgttttaattgaattttaagaagcctctcagtccttcaaacttggaggaaaaatttgatttgtgaaccacataacatataagagaatttaatataattaatgcattccagagttttcaaggaattaaaatgcagtagtcctctttttctgttccaacatacaaggttggagctcttgtttcttttctctaattatacctataaaaatatacaaattgaaaaaaactgacctttccttgcctttcagtttcagcatagccccttcaaattagctgaagctgaagttccaaactattgttttgctattcttattctaaaggctggctgaggaagtttgtttgtataatgcatgtttcaacggatcatcccattgtaattttttaatagtttgatttaaaagttcaaattaaagctcagcatttctatgtagcactttttatctggaagtgaagacatgagatttcattcttgggtttaatttatagattgtaaggttctatgtttgaaaaatctttcccagtttgcaactaggaaagttgtaagtgtatactgagctagacttctttttattataatttctataacttgtttcttctttgaaaaccagtagcaggcatagtgcaggttctagtgctatggtgtgtgatgcacacacatacttgcatatacatatacatacatgcatttatttatttatttaatattataatcttcctgaatctaagttggagacaaattcaagtgaccagtattttcattagggatatttcattctgcaggcaagagatgacaacaaacatagcaataataactatattcccatcactcaaaatattttacctgttccttgaatgtttggtagatggatacaagtcaactttggacttggtatattttttgtgggaagagtcttatcttgaaggggtttttttttgaagttacaaatatgtgtattttttaaaatgtgtctttctgtttattggtttctagtttaaatcccttaagatcagggctcaagacaattgcatatggtctcacttatggatgcagtatgctttaagaaatattagaataagtttattgtatcttcaaaatttccatgagctcattaatgttttcagtctgtgtaatcaattaatgactaggagaggtgcacttaggccttccactcagagagtgaaattttcttttttttttttttttttttactttaagttctgggacacatgtgcagatttattacataagtatacatgtgccatgatggtttgctgcacctatcaacccatcatctaggttttacaccccacatgcattaggtatttgtcctaatgctctcccccgctcgccccacaaccctgacaggccccagtgtgtgatgttcccctccctgtgtccatgtgttctcattgttcaacttccacttatgagagagatcatgcggtgtttggttttctgtttctgtgttactttgctgagaatgatgggttccagcttcgtccgtgtccttgcaaaggacatgaattcattctttttcaggcctgcatagtattacatggtgtatatgtgccacattttctttatccagtctatcattggtgggcatttgggttggttccaagtctttgctattgtaaatagtactgcaataaacatatgtgtgcatgtgtctttatagcagaatgctctataatcctttgggtatctacccggtaatgggattgctggatcaaatggtatttctggttctagatttttgaggaattgccacactgtcttccacaatggttgaactaatttacaaccaccaacagtgtaaaaacattcctatttctccacagcctcgccagcatctgttgtttcctgactttttaataatcgccattctaactggcttgagatggtatctcattgtggttttgatttgcattttcctaatgaccagtgatgatgagctttttttcttcatatgtttgttggctgcataaatgtcttcttttgagaagtgtctgttcatatcctttgcccactttttgatggggttgtttgattttttcttgtaaatttgtttaagttctttgtagattctggatattagccctttgtcagatgggtagattgtaaaatttttctcccattctgtaggttgtctgttcactctgatggtagtttcttttgctgtgcagaagctctttagtttaattagatcccatttgtcaattttggcttttgttgccattgcttttggtgttttagtcatgagatccttgcccatgcctatgtcctgaatggtattgcctaggttttcttctagggtttttatggtttggggttttacatttaagtctttaatccatcgtgagttaatttttgtataagatgtaatgaaggggttcagtttctgttttctgcatatggctagccagttttcccaacaccatttattaaatagggaatcctttctccattgcttgtttttgtcaggtttgtcaaagatcagatggttgtagatgtgtggtgttatttccaaggtctctgttctgttccattggtctatatatctgttttggtaccagtaccctgctgtttttggttactgtagcctcgtatagtttgaagtcaggtagtgtgatgcctccagctttgttcgatttgcttaggattgtcttggctatatgggctcttttttggttccacgttaaatttaaagtagcttttctaattctgtgaagaaagtcaatggtagcttgatggggatagcattgaatctataaattactttgggcagtatggccattttcacgatactgattcttctatccatgagcatggattttttttccatttgtttgtgtcctctcttatttccttgagcagttgtttgtagttctccttgaagaggtccttcacgtcccttgtaagttgtattcctaggtattttattctctttgtagcaattgtgaatgggagttcactcatgatttggctctctgcttgtcgattattggtatataggaatgctcatgatttttgtacattgattttgtatcctgagactttgctgaagttgcttatcagcttaaggagctttggggccgagatgatggggttttctaaatatacagtcatgtcatatgcaaatagaaactatttgacttcctctctcctattcgaatacccatcatttctttctcttgcctgattgccctggccagaatttccaatactgtgttgaataggagtggtgagagagggcatccttgtcttgtgccagttttcaaagggaatgcttctagcttttttttgccgagagtgaaattttcaagtcctcttcatagttctgtcattttgcttgctttaggccttttgaacctatgttattaagaacgatatggctgggcatgggggctcacacctgtaatcccagcactttgggaggccaaaaaggagcattgcttgagcttggtcgtttgagaccagcttggacaacatagcaagaccctgtctctactaaaaataaaaataaaaattcaactgggtatggtggcatgtacctgtggttccagttactctggaggctgaggtgagaggatcattgagcctgggagatcagggctgcagtgagcagtgattacaccactatgctccaacctgggtgacagagcaagaccctgtctcaaaagaaaaaaaaaaaaacccacaatgaaagttaatataggttttttgagaggtcataaaaaattaatatgtgtttaattaattaaggtaatatgaacagtaacagtccctgccttcatggagcttatagtctagtagggcattccaacagctactaaatactttctctgttgatggtggcaggaagcacattgtgcccaaagcaaaggtactgaccccagtcctgagagatggagaaaggcttcccagaaaagggatcactgcacctaccatttccaagccttgtattagaaaacaatattgaatttactagatgtctgtaaaatccctgttatcagttattcctttttaactttttaccacgtatgatgttctttgtgtaaccctatatagtttttcaaacttgttcacagtaattcccagttgattttaatctaaaatacagacagactatatgatgtttcaccatgtggtatgtgaataactcagacacatgtcttctaaaatgttgtaattttatggagtttcaccagttccaactgactccaatatgcaattctgtttgtactaattttatggcagcatttgtttagtctgcaatatagatatgtatttttttccttttatctttagttggacacttaataattgcacatatttatgagatatagtctgatatttccaaacgtgtatacaatgtgttgaaatgtatattttttaatagtttccatgtgattaaaataagatttccaaatatttgtaaaatgtattaaaactatattttaattttgttagtttggtacaaggatatttatgatagatggaataaaagaaagcatctccaggcatatgttcttaatgggaaactcaaggcagcttccttttcctcctcctcacctgtctattttctggatgagtcctctctcaactccttcacctgcagagagcaatgtattattgcctagtgatttattattgttggaatcattcttggtaagctcagagagttcgaaaaatgcacaaacaagtacacatggtacctcttcatcatgtggctgtgtaaacgtaattcttgggcaccttgttaacgttcttgtgctatattttactcgtctataaaacagggctaatgtatagtacttactttcacagaaaattgggagagcaaaataaagtgtttcatgtgccttagcattgtgcctggcctacagaaagcctgcaacacatgtcagaacgactgttagaaactaggaggcagaatgtgtaatggttaagtgtatggacattggatgtagactgactgccaaatattttttaaccactgtcttgtattatgtgtatgtgagataagagtatatattgttgctttaatgtgttttgtagttttgtttctaaagcacctgccaaagggcagagacgtgacaattaataaacacttgttgatggacatgtgcagaattgatgcattagacgagtgttttgggattcggaggaggaagagatgaatctgcttttgagtagacaataaaccttgcttcagggtggtgggatttaagctgctttgacagatctgtggattatgcatcaaagaagagtgaggtgctctgcaggagtgagaccagcagagacctgtcggtaggaataggcaagacagctttggaattttagacaatcctaactagagcacagggtgccaaatggggagccaggaaagaggatgttggaagagtcacctggagggaaggtcttgaaagtctttaaatgcaaggttaagggtttaggccatttttaccattttctatagagtaatagtgaagtgttttttttttttttttaagagagagaggttaatgtatattttctgaaataaatttcatgtgagaatataagaatggatagggttactgtgttcatggaagaaataaaagggggaagagacattcacattactttagattttgtggtctctcttttaattggcagaaagaagtagtatcacaggtcaaaaaccaccaccctgtcaacagaaacatgtaaaattgtgagattcaaggtcctgccccttaaaactaggaagaaataggagatgtcgttgctgattggctcttaggtacagacacaaatgtgattcttttcctgcttttctagtgcagtaagacacagtggggacaatgcatggttatttcttctggctttttgattcacaataaggagaatgctgttcaaacctccgaatgcccactataaaccaaaataatgttttagagccagaagcaaccttggagctcatgtcattccatcctcattctgcagatgaggaaagtagggctgagagtagtaaaagaagttttccgcaatgacctagtgggttagtgactctgaactaggactagagcacagttcccagctgtccagttttgtgtctttcctgctacttcctacagcggttaacagtgccagccagcacaggcaggattgccttttgagtggttctgaaatttctgaggtctcttctgaggttttcaggagtaaacacaatgattttacggtaatttttaaacgcctgcttggcctggcaataaaccagcatcatgggtgtaggatgatgccttaccatgctgtctgggaattattgcagagatgtggctttgcaatgatgcctccagggccaccaaaataagttgcctagaagatgcccccatgctgacattttctatagctgagccagtgtagatttggccatcttgaagggccagacttcatgcctggagctgtgttcatgtacatggacccagacaacctcggggacactgcaaaagaaagcagagttaggacagtgatgtcaatgaggaaacaaaggaattgtggttgcaacttaatgggctcactaattcccttcttaggattattgttttcctgaatgtcttaatatatagattattcttagactggtaaattttttgacattgccataaagtgggcatgagtagtctgagaaactgaatgtggctaaagatttaatttattttcagtatgtggcataaacattctggaaaaatctgatacaaatgcaattgtaaaaatccatttaaaacttaatcactttatattctggacttttgggtatgacacaacgttgttgcgtacccatgaggtatggactttaagctgacaaaggaaaacacattttgcatgtcgcatcaaaaaggaaaatgcttgtaaagtgccgagcatggtgactggcacatagtaagtgttggatgtacacgaggtattattttatctgggcatttactgttacaataaaaccttcattggtgtaatccaatggtggatttcttgacagtatcataaattactcagtggttatagggttgatatgtgtttctggctgacatgggaaactttgaacaactctcaagggaattataattgggtggaaactttgatttgtcctttctaaaccaagctaagtagtgaaatggacttttaagaagcagtgagtggtgaattgaaagaaatggctttaaaaacaaggcccaatttgaagtctggggatgcgggtggcaggggtggaggggagcggctctttcatgtttctggttaatctgattggatcagcaccacaggtgccatcagagcacctacagctgtttccaagaaaagaaaagctggcattggtttatactatggctgtcacatttatacacatctagacagatgaggaaaagatgggtgacatgatacacagtaagcctagactagtcagacgagctcagggggctagctttctttttttttttttgtagggttgcctttggtatgtgagtaaatgatgaagcaagttggccctgggctgtgtgttagcagctgtctctcttagaataggaagaggaaggaacttcggtatcgactggggctggaggaggaggaaagcgctgaagtgaaggagctgtacaagaaggcagcttccaactcctccactgtaggggccctggggtgttttgttctctgtgctctcttctgtgccagttgtgcagggtgcctagaatagcggtatcatcgtctgcctcctcccttatatctcttttgctatttattgagggggaaaatccggaaaatatggtttttatttttatttacattgggatagactaggttcttattactgaaacaatatggaaatcatgagcagcttctattccttttgtgcctttataaatattcttttccctatctgctttatcagatcctgcttttaaaaaaaaaagaaagaaaaaaccttatttgtttactcagggaatattttatgtagctactatgagataaacactgagtaaattctgggaatgcagaaatgaaaaacaaagataagtcgttgcttccatggtctagagctcattataacatgtaataagaatatatagacaggatatgaaaagagctccatggagctcaatcaatgagataatttttaatgtgaataataataaaaaaccactgacttcggtgttgatatctggaaattgcctaattccaaaagctgaagtaaaaatacatttcaataaaaagcaacatttacagagaacagtgacattcagtcatttggaattgcaaattccactgttcagtcatttggaattgcaagtaagggcaaaatatgaagactccaatccatgaaaaaagccggctggatgctttcttatgaaaggtctactgttcgcgggctggactgctagcccttctcacgtgctttcctcagaggtctccatttccttcctgaacagggctaataggtcagataaatatccaggctcacaagcagtttatgtcatttccactctgaaaggatccatccctaggaagatattatgggagcaaacttgcggaagtgctattgtgttaaccaagccagctggtgggtttgctttatctgttatggaatttttaccaacttaggtgttaggatgaatatcctgacctggtagagtgtttatttcccccttctttgacccttgacacagctgtttagagctcagtcactcttggttgacatggtcagattcaaagccaagaagagtgaaatgggcaggcttttagactcacacactgagtatggcctgtgtgagtgagtctgaaagatctaggagacatggggaagccgtatgcacttcacttaaggagcttggagggagatgctatttttgcctctggattgctgatttaagctctagagggtcccagcaaacaagggcctcacttatttatagtgtccagcttgttaactggttccagtagctctttcattctaaataccctgacttgatcattacagattctatgcatgtaacaaaatatcacatgtaccccataaatatgtacaaatattatgtatcaataaaacgttcatctgataacatattaggcaaggccatagggctgcttccatacctctagaaaactgcctcgtaggtcagggctgagtggtagtacaggaaggtggagtaatctgtcaagatgctgctttaagttgttttgagatgtggttcaagggtgtttgttgatcaaacaccaagagctagctattaccaagaataataactagcatttgtaaatctccagattgacagtttgcaaagcactttcaagtattatttgatccttggaacaaccacgtatctcctgcaaaaatatgggaatgataatacctgctcattagggatcttgggaggattaaatgagataatataggtccaagtgtctagcctagcatttagtgggtgggagcagctgggtaaataggaaccatctttaacaatgcagaacatgaggccatggaaaattcaaaagcataactgtagtcagatgactacgttttggagctcagacccagggaccccattttgcccttgactaatcgtcacctatgattaaagcagaaacaactatggtccaaacataccacccttaaaaaattagcgagaaagaaagagagagagtttgagtatggagagagcaagtatttttgccttcacttttgacacacaggctccctggactgagcaaagaagttccctttgaagtggtgactatgattgaggatgagctagtttccactctaatataaataaagaagtaaaaatacaaagttgaaatatggaaatccatatggaatcattttatttacttacagcaatattgaattatccaatactcaatagtttctctgtacctaagtgttaacataaatgaatgaatctctgatgatccctaaaatcatttcatcacttgaaatgtgattatttacttaccctggctaaaaatgtaaatttatagtcttggtctatgagttcaacatttcaaatttcttaagagaccaaaacgagttaatattcatatttagttattcatgccaaagcgtggatacatataaaaatgatcaccatgtgttagtcaataataaaactttttgatctgttatccattcctctttctaggatcgctaatcagtcagaattgtagatttaaattggtttctaaaacaaagatatctcaaacatggttgtgcacaaagccactcagggttcatacgtatatatatgtgtgtgtgtatacatatatatatatattttttttatttctttttttttttttagatagagtctcgctgcatagcccaggctggagtccagtggcgtgatctcggctcactgcaacctccacctcctgcattcaagcaattctcctgcctcaggctcccgagtagctgggattacaggcatgcgccaccacgcccggctaatttttgtatttttagtagagacggggtttcgccaggttggccaggctgatctcgaactcctgacatcaggtgatctgcccgcctaggcctccaaaagtactgggattacatcatgagccaccatttataagattcagcagatctgagacaggtttagagtctgatttcaacttgtgtcctggcgttgccattttagaattgtgcgaacttaagggaaaaaaaacaaaactaacttttcaagcctcaattcctcatcagtaaaacagaggtaataattcagtaataactccataatgcttgtcccctaggaagccctggacaaaggatagtggttcctctttccatcactattgttattccttgaatgcctctatctttaccccgttattctaaattttaagccttttctgtagttatatggacaatgcagttggccctccatatttgtgggttctgcatctgaggattcaaccaatcgtaaatcaaaaatatttgaaaaaaaaacaattaaaaaagataaaaacacaaataaaaaagtataacgactatttattgtattattaattattaataattattgtattattataagtaacctagagatgatttaaagtattgcaggatatgggtaggttatatgcaaatattataccattttatatcagagagttgagcatccatggatttttggtatctgtaggagggtcttgaaaccaatcccctgtagatattgaggaatgactgtatatgttcttatacaaagtcaaacaatacagtttatgtaagtgaatcctcagtccttccagctcttcctctaccaactcttgattattcttaaaggatcaactcaaatctcatggaggactactctaatttaacttttaataaaattatctgatctccgacattccctattttttttttttttaccactccttcataattgcatgctgtttgtgtattatttcatattctttgggccggattcacaaaggataggataaagtaataccatgtacagtggcttacgtttgtaatcccagaactttgggaggctgaggcaggagaatcgcttgagcccaggagttcaacaccagcctgggcaacatagtgaaaccttgtctctacaaaaaaataaaaataaaaaaaaattccaggcatgatggcacacgcctatggtcccagttactctggaagctgaagcaggaggattgcttgagcccagagttggaggctacagtgagccgtgatcacaccactacactccagcctgaatgacagagaaagaccctgtctctaaaacgttaaaaatgtaaaaataaacctactttgggcataagtcttccctccccaatagtgtttcaatttctcaagcccagtggctgtattttgtgttcttttatatctgattactcatttttcaacaataagagcattctgaaaagctacaaggtattttatcagtagtaaatagttgttgaaaccagttgaaaaaggctgtaatgatttaattagattacagtctgtattgtgtaggtagaagttgcccatcagattaaaaaaaaaggaaaatcctagcccaccagccattctttcaaattttaaatacatagtcaagcaaaataatgcctttcaggtctctgcacacctttctgaatctacaagtttcttctcaatgatttctttcaagaaagtcttataaagagaccatttgaatttttaaaactttaattcaggcagcagtgatcaaatatttgtgattcacaaaggataggataaaataataccatgtacatatacaatcggccctccgtatctgtggatttcacatctgtgtattctaccacccgaggactgaaaatattcaaaaacaataaatggttacatttgtttgtactgaacatgtatagacttttaaaaaatctctaaacaatacaatgtaacaactatttactaagcttttacattgtattaggtattataattaatctagagataaagtatatgggaggatatacataggttatatgcaaatactatgccattttatataagggacctgagcatctgtggattttggtattcataggggtcctggaacgaatcccctacaggtacctcgggacgactgtatatattttgtgtgtgtgtattttcttccctattgcctcagaatagagtttaattccactttgagacaggatggtaaggtatcatgaggaccatagggtaaacttagcaatatacaattgcttagttttcgaaacttgggagaggaaggggctgccactggcgcacaatgggtcaaggccacggatgctgctaaacatcctgaatgcacagaacagccccccagacagatagtcatccagccccaaatgtcattggtgccaaagcggagataccctgagtcgaagcaaagcatctttgttaatgacataagagaaatgctcagttttactcttacagacatttacttgtttgtgtgacccctaaaccaaatctactttgagatgtagagagctgagacattgcagaactcccctcccgccatctgcagatgccctgagtggcagcctggcagcctggcagcctggaagcagccccagagttctttgcacagcgggcttctctcacccatgcccccagcccaactctgagcagtctgggcccgcacatgccagccttcaggctgtttcaacagtatttaaacctccaaaggcttatgaaatattctttaatcccttcccaaaacatgatttaggtgtatttgatattatctgctatcccctagatttcctagtgtttgcagcttattttcaggactaccttccaggtgtagccgtctgtgtcagagacaggagagcctgaggctttcctccaagtggggagtctgcagagaacaggctggcagctgagactttcgcccaaatggcttatatttgatgtataatagttttaattgtgatattattaaaagtgaattatttccatagatcaaaagttaactcattaaatctgttagtctattttaagttggtcttccaaaggaaccatttatatttatatagcattgcgtctttatccttgcaaaactgtggattctaaactcctcaagtcagagacttggaatagcataaatcagatgtgagtcttcattgctgaggctgaatttattcagtcataatttccaagcatttgttcctgctggaaggtactacttatttcacaagaagttcatgtcatgaaagcgctgagctcgaagggccatcacgcatatctagtccagtggttctcaacctggctgcacagggattaccttgggcagaagcccagcccaatgggacaagatcttctggggtgcagctcaggcattggggtttccccaaaactaccccaagtgattctaatgtgcaaacttggtggaaaaagtttattcttttccaattcctcagttacaatgagtaaactgagggtcagattaattcataaaggcagaagtcagcaaacaccgtaaaggactagctactaaatctttctggcattgcaggccatatggtttctgtgggaactgctcaaaagcagccataggcaattcagaaacaaatggatgtggcaggctgccaatgaagctctataaaaataggtgactggccggatttggcccatgggccatagtttgccaacctctggtttagatctcacagttggttagtagaaacccatatgctaggccacagatagactaaccttcaacaagtgatcttccttctactagatgcagttttcctgtttgaagcagtgtctataacatacccaacttctgtagaggttaaataataattatctttatgtaagttaaggcaaatatcttagcataggtactcatagtctagagcgcagaaattttcattatctgtgtctttatgagaggtctgcattttgatggtatttaccaaatttaaagtaataatcacagtatatgtgttttactaaagtaataacccagacaataatattcctatccaagaaattttttcagctagaaagtcagaaaatgagacagcgtgatcagaccaccaaagcaagcaagaaaaaaaaatcagctaagaaaaatggagatctgattttcttttcacccagtaaaggaatcagttgaaaatctcttaattcttccttactgtgctgatgactcatggggagatactttatctcagatttcttttgaatacatctgagtaaatttgaatatgaattatatctaatagctagagatgcttcctacgagtccttgggaaacagcatggactaaggctgaagaagtggaaagaaagccatcacaattaatgtggagagttatgtgtttggtacttatgaaactttgggtatttttcactgtttgtatagcctttcttccaaagtacactcataaaaatagggttcctgaaatgttaaaaagccactggatctggtcattttccttggagattaatttatctctatttggcaattacttcgtatctatgtttttcagagaaagtcactctacctcttcccttttttatctaaataacacattcaataaaagtgcttcatgtcctgaaaaaacaaaactgtcttatttacgattataaaatggtgttcaatcaatgatttccctgaggggataaacactagagatggaaaaacaaaatcaatttgtttttcacaaattgacatccctctgtatgatgccatcattgaactgaagttattgaaaggggccttatagagagggcaccatagagggaaatcatagagaataacatcatagagaggggtatcatagagataataactgcatggagaggagcctcatggagagggagctttgagaggggacatggaacacacagtggtagattaaaataatccagtaatcaatttggccacataaataatagtgatcataatttatgagggcttcccatactaattaaaatatgcataataacaacagttcattttcataattgtacacttaagtcatgctattttttctctttttgcctagttctatggtatgtgtgatcatggccttacaacttttagaaggtactggcaaatgtggttgcagtgaactgtttttctctgaagctttctgcagtaatcctcctggcattattaaggtttccttaatcatacttggttagaggtgatttgcggtcctaccaaccttaatttgaattttctctctgcctcagataagcttgactctggggaggtttctgaacatctttaaatttgagttcccaaattataaagtgggttcagcaatgactgcttttcatggcttatttgagaatatatgagattgtgctttaaaggattgagtagaatgcctggtttgttcattagttttttcttttcttttcttttcttttttcttttctttttttcttttcttttctctttccttccttctttctttctcttcctttctttaccctcccttctttccttccttttttttttttttttttttttgagacagagtctcactcttgtttcccaggctggagtgcaatgatgtgatctcggctcaccgcaacctctgcttcctgggttcaagtgatctcctgtctcagccttcccgagtagctaggattacaggcacgtgccaccatgcctggctaattttgtatttttagtagagacagggtttctccatgttggtcaggctggtctcaaactcccgacctcaggtgatccgcccgccttggcctcccaaagcgctgggattacaggcataagccactgtgcccggcctccttctttcttttttgagacaacatcttgctctgtctcccaggctagagtgcagtagtgcaatcatggctcactgcagcctcgacctccccggctcagcctccagagtagctggaactacaggcatgtgccaccatgcccagctgatttttgtatttttttgtagagatggggtttttgccgtcttgcctgggctgatctcaaacttctgggctcaagcgatcttcccacttcaacctcccaaagtgctgggattataggcgtgaaccactgcacctggcccccaaaactttcaatgatgacaaattattccctgtagtaccattactattattctaccctttggcataacatagcctaggctgcatgttctgtcttcttcaaggaagtgtctatgattaggagaaatgcaagagggaggaacatactggaggatgattttatctctcgcacatatgtgaggacagcaacacctaagtttgctcactccaccctagtaaaacttcactactggcttaatccttgattcttgagtctcagtggggagtcattttctagtactgttgagagttatatagccctaagggattttatgaaataaagtgttcccaaggagtgttctagaagatgagtgatatgagttaataccaagggtttcttctgacagggagtgttaggtgataagacaactgctgaagattgaactgatctttatccagggaagttctgcacttgagattgtctttataggacaggcaacaggcataaaaaaaaagtgctataaaaataggtttgtttgtttcacagtatcattgagaaaacagctataaagaagatatataaaaatatataaatctatcatgtggtcattaaatgccagcgacttattgaacgatgatttataaatggctgaaattcaaagaattttcatggaaccaaaccaaagcatttcagaacatctttcgttctttcaaaattgaatcaactgttcttcattttacagcttctaaatattgtttgtgtgtgtttttgctgttgttgcacaggaaataatttttaccttaaaatattaaaaacttttttttctaaataataaactccatgcagtaaaaggcaacaatcagagagtgtaatgctagaacatttcaggcatgcccaaaatgcccatggcaggatgaaggaggcaacctcatggggcccagccatttgtcttgtaaagtcttaaactaccataggaaatccctgtaggatgttctattgtgtaagagttccatttaaaatacattggcaatatcctaaaaaaaaaagcagtgaaaatctaaactatgtcttgtagcttattcaaatctattattcatctactgcagcagccaacactgctgcatagagctaaaggagaaaaaaaacgaagataaaataagcaagagaatcatgactactatgaactgataaataaaagtgttaaaaaagcaataaaacaaaccaccagcttgttattgggctttcaaataggtatgtttccgcctcctcctcctcctcctgctccttctccttctccttcattcagaagcaatcatcataccacaagcaaacaaaccattttgaaggtgtttaccaggaatgtttccctcccttttaattttctgacctgagtattggtacaattttttctttcatcctttttgcaggcaaaggggttactggatgtgctaaaggaaagtatgattgtagagtgggaaaagggtgaagaacaatgttttatcttcttatgtcaattaggcaggacaaaagacacaggctcccaaaaataccttcagagtttgtcatcctggatcatgataaccttcaatatgttgaaagtctcgttcatctgggttcaagatcccacacttaacgaaagaaaggccgaaatttcccgtaatgttctttactttgggttttacaaaaacacttctatccaggtattttttcttgttgaaattctgaagtaactcaaggtgtacacatgtaatttaaaacttagctttgaagccgggtgtggtggctcatgcctgtaatctcagcactttgggaggccaaggtgggcgaatcacctgaggtcaggagttcgagaccagcctggtcaacgtggggaaacctcgtctctactaaaaatacaaaaattacccagcatggtggtatgtgcctgtgcctgtagtcccagctactaggtaggctgagacaggagaatcacttgaacctggtaggtggaggttgcagtgagccgagatcacaccactgcacttcagcctaggtgagacagcgagactcagtctcaggaaaaacaaaacaaaacaaacaaacaaacaaaaaacacttagctttgaaaggaaatagcctatgtttccacaaattagagttcataattatgttgcatttctactatataggacagcaacattttcacctgatctgagctcatctattagcctttccttacaaatttgaatcaaaactttcgccaggctataaatctccctataattggtagagagctagataagaattatcccataataagagtttgggagaaccttgtggtattaaagggatgctgacatggaatactgtatatatttctactgttaaattagatgcagtcctaatactgtttgtgaaactaaattaggtcaatgactcagagctggttttatttagagtgagctatatattaaaatgtagcaatatttcccttcttctgaaaagccttctggtaaggatttcaattcattgtagaaaaacatttcccaaattaaggtattttaattaagtcctggtaagaaattccaagcatgcttttttttcccctcctcaaaagaggccttccacattgtgcatttagtgtttactaagatttcaaatctctttggttctaaccagtatcacttagataacacatttcacttttttttttctcccttaagtgtaacctgggaaatcccaactttccctttgatgcactaagtctttggcatctcaatctgttaaaccagtgcaacaatcataacaggcattttctggagatgttacaagggatgaaaaaaaaaatgaatgaaatgagttgactttttaaagaacgatgccataagaagcaagacataaatttgctccagaagtcaaatggtgtgtggggagaacaggctttgaaatcaaatggaactggtttggagttccagcgctggcatcactagtcgtgtaaccctgggaaacagcctgagtacattttgtttgtttgtttgtatttttgagacagaatctcactctgttgcccaggctggagtgcagtggcacgatctcagctcactgcaacctccacctcctgggttcaagcgattctcctgcctcagcctccctagtagctgggattacaggtgcatgccaacacacctggctaatttttttttttaaaaaaacagagtctcgctctgtcacccaggctggagtgcaatggcataatctcagctcactgcagcctttgcttcccgggttccagtgattctcctgcttcagcctcccaagtggctgggattacagatgcacaccaccacgcccagctaatttttatatttttagtagagaccgcgtttcaccatgttggccaggctggtctcaaactcctgatttcaggtgatccacccgcctcagccccccaaagtgcttggattacaggtgtgagccaccacacccagctctgagttcatctctccatcactagaaatcagggtaatcatacattccttatcacattattaagaggactagagatagaatatgcagaatactgggcatgtagtatgtgttcaataaatggtagctgctattgttactgctactactacagctgctgctactactaaactgctgctattctcattgttactattatgactcctactattatttctactgccaaacaaggaggactgtggaaaaagaagccactttatccagctctaaacaaatgagttgttacctcactgtagcccacctttctagcaggaataggagaatgaccaagtgttttggaatcagataaacccaagagtaacttaaggagaatgataggaccatcgttgataggagagcctgagtacattcccagtgctgtacttgtgtggctgtgaaaattattgttccaaagttgaatattgtcaagggtgttgagatttatctcatggtcaatatttgatctttcaaagctgacctatacctaacacacttcaaattggttcagtgtatgtagcccttgttacgtggatattattgtgagcacttatataccagggaatgtgtcatgaggaagaattattatgtgtttggtatgtagtcattgaattaagacttccacataatgaactggaatggaattgcattagaaattctttttttcatccaaaataaaagtaaactcaaatataattatgatgttgccttctaatgtgacctgattgccatatctttgtaatgttccgttactcctgccaacctaatgtcagtgtgtactccaattcaattcagcaaacatttattgatcctagtcagggatgggaagacactaagattagcacaaagatacctttgtcattagtaagttactacccagtaaatctggctagtatattaaatctatggtcattttttacattttgcttttcattctaaacatgtaaaatgataataaaaaaagaaagtatttagaacagtaaaggttcaagtccaccccttttttcttcacctttttgtttagacactatttctgacgttaattaccacattaattgggtcttaagttccccttccagtcctcattatgacttccacatttcttacaactggcagaccttgctaagtcgtgaactataagttttttttaaaggttcagagcatttagtccagcaacacaaattaccctatggagacactatatacactagtagcaatgagcaaatgtttcttttatttttataattgttttggaaaatcatatgattgccaaagacagcctacacatggtcaagttggattcatcccagccttaaaaagtctgcgaaacacattaatacttgtgatgtatagagttgagggatgttttgttttgttttaacatgcttcttatatgtacattggtaatgtttaatttaggttaaaattctatgaatgatttaattgatattatccaggtttgttaaccattttaaatggccgttgattttgccaaattccattctatgccattagaacgctgtccacactaagttccgttaatgggggtaaaactcccatcatttgactcttaagtatggtaaaatagctgtctagaaataaatgaaccagagtcctggaaaatccagtggagatgcctagcaatgggggtccccaaagacttcagcgtaaggtgcttatcccttgaagcccccaccctcccacccttcctctatttgtttcttaattgcacattgttgttcagaaaattcacacttgggatttttatattttgtgatttgaactcatttttgcaatttcctttttacatttctagagagctgcttgaaatggatgctaaactacaattccagccttatgtgttaggaaatactttttctctactacaaagtgcaaagaactggaaactactttagtagagttttcatttaaaaaacctctatcgtacttcagtactggaggaaagaaaatgcttgtcaatcaacagccttgtgtttttcagtcttgatatatgtaattgatatatgatatatcaattatatgtaatatcaaaagagatggtgtgcacaaagcctgcctcggagtacattgaataatattttattcagatattcattttaaagttagtgatttcagatatggagaagttgtagtcaccagctgtgatttactggggggtggtgggagggcagggggacctattactggcacctgaactggtgatttctgtttacctgtaatccaaaaataagtaagtgtctgctaatttcacctgctaacatgtgacagcatctttccaggcaaagagtagaggtagccctgagagtgaggcctttcttttcggctcatgtatgggagagaattgtgttttttagcagagaaggagatagcttagacctattgcatttggtaccttccgtagaatgtcagtatgacaagtaactggactcttccagacagatctcaagagaacctgagtgcccattcaagagaactggaaaaactttcaactcccaggcagcacccgcatagctctgaaatttgagagcactctgcactctcaattcattcccaggatttgaaaccaaagtgccaaattgttttctcaaactctgtaggaaccgttatccacctactcacccatctacctgcccatttctttagcaaatatttgttgagactactatgcagcaaatactgtgttcggtgctttgaatccaatggggagggagagcaacctgggtcttgtcctaaggatgctttccttttaagggaattcatgagtcttttctgccctaaattgtctaactgtaagaagaggcagggagaacctcagtatgtgttactagagaacattggcactagtcgatttaattttcaccaaattgactatttggatgagatcctcattatgcacagtgcacatccaacttagatggaaccatctaaattggaataatagacctttgtgatctgtgactccacggatgaaatattgggtctcagacaatcaaagacagactgactctcactttgaagcaatgcatcaggctttataattaaactagtttagtcgcaaacttcttactatgaacctcaggacgttctgcaggtaacaactagaattatttgtgtggaatactaacagcccaggaaacagattaaagtcacaggcagaattctttagccttgttaagtacttggtgttaggaagaatatggaaatttcccagatcttgaaacattgtaaaggccctgggatatactatctaaaggcctgcaggcagtatccagaagtcttccacgatccttttttctttttcttttttgagatggagtctcactgtgtcacccagtctggagtgcagtagcacaatcttggctcactgcaacctctgcctccaaggttcaagcgattcttgtgcctcagcctcctgagtagctgggatcacaggcatgtgcaaccacagccagctaacttttatatttttagtagagatggggtttcaccatgttggccaggctggtcttgaactcctgacctcaagccatctgcccgcctaggctaggattacaggtgtgaaacaccgcaccgagcccaggtgtcttccacaaaaattagccaggcatggtggcacctacctgtggtcccagctactcaggaggctgaggtggaaggatcacttgagccagggaggtggaggctgcagtgaactgtaaccacaccactgtactccagcctggctgacagagtgagactctgtctcaaagaacagaaagaaaagaaaagagaagagagggtttgatttttttttggctattgaggaaactgtagctgtaaatagtgttaattctcagaaaaccagttaaatggtaaaattcaggagatcattataatcaactttaatcatgaagagatagttacatatgtggctcagtttctttttttgtttgtttggttttgttcttgttgttttgaattcagaagcagctttattttaagaatctcaatttatagtgaagtctcaatctctttagtcatcattatgtaaaatagaataacattgcaaagaaaaatcaaataaaagattaaaaatcctagggctagcacatgattgaagcaatattgaaggtcacagatagtataaattctctgattattaacagaggtgagctttgttatagggagatggatcattattaagtcatctgtctgatctagagccagccgcacgatctaatgatttcattcttggattatttttaatatgtagaattagagatgtttgggaagtgtttgctattatcttgatagtacagtttcctcctaaattacttttgtaaagtaaaataatgttacattggaagaaagtgtgtatttcttagtaatgcttcacaattcctcatcctacatttcaataaatcatcttatacctgtcagcacatgtagtctaagatttattgcatggtccattgtgaagcagatagctccttggccagagagcaatttctgaaactaatttaatcaaaatgtttttataatacagtgaactatggcttgatgtcttaaatatgcattgatgtcttcagaaccatatgattaaactctatccaattttgaaatggaattaagatttggcttcatatgacttctgttatagtcaggaaatctttggttgcattaatattatttatgtactgttattgagcaaacattcatcagtgcctctatttgcacagccaacccgctagatgttaagatgttgtgggggaacaacaacaaaatactagtttagtagaaagacgtaactgagagcttggaaggagcagtagacatggcacaatttattggccaaaaaggaatccagttttgctgaagttgaatgttcattttgcagggtggtggtaattatagctgccttctactgggaaagttttaaacctatagttttgatgagtttgcacgccaactcaggagtttgaacttcatcctttaagagttgaaaaattttggagttttgagagtgatgtaagcttactggaaagattacgttgacggccatgtgtggacccaactggacaaaaattagaggaatgaaaaccagtgattcatggaagattgttagaatggaaaccttgggaagaaaagggaaaactgaagtcaaggagtcttttaaaaaaacaactccccaaaatctttagagagtgattagatagaagacatgaagagcatagtaatatcttttgtaaagatcgaggccgggcatggtggctcatgcctgtaatcctagcactttgggaggccaaggtgggtggattgcttgagcccaggagttcaagaccagcctgggcaacatggcgaaacctcgtctctaccaaaaatgcaaaaatcagactggcgtggtggcacatgcctatagtcccagctacttggggaggctgaggcaggaggatttcttgaacctgggaggtcaaggctgcagtgagctgagatcacaccgcagtactccagcctgggtgacaaagtgagacactgtctcaataaaaataaataaataaataaataaagggaaggtggggagaaatttcaaaggaacagatgatgcatttaagacagttgagtttaaaataacaggggaccagcaaagctgaaagttggtattgaactgatagtgagagactaaagcttaggtcagagttgagatctgagatcaaaatctgaatcgtgtcaggacagaggatggagttaaagctgtgaaaaagaatgccattgctgatggaatatgtacatatgaagccactgttttattataattgtttggatagaacatgttctggtgggaaactcacttgcagtcaaaattgcacagtgctaaagtctgcctttaattatagtaaatgcattcgatttgagaatttgttcattacctgtatcagtgacactttattcaaataaaaacagcacactggagaaagataacagttgtggaaggccaaaagtcctctttgtgatttactatcaccatttaattattaagctgtctgatgtcatgtgacactgcctccccagagtgtcctatcacagtgatagacgaaggtcacagacatttggaaatcaaattataaaagtcacactaaaaagtcctgagagcaaagtttaacatgtttgttttcagctttatatattttctgtcaagctgaattttgaattttgaagaggtacactgagtccaaccaatggttgggggggcattattttttcatcataaacagatgagtctggatcctctgctggctggttgccctctccccctttcaataccacttaatttttttttttaagaacgacgtttataagtaatcaagaatacactgggagcaacttcagcatgactgtttttttgcgtgtgagagagggcacgttgtgaacatctgagttctatcttcatttttattagaaaaagcaatttagaactgccagtcagatgggttaaaaagcacagctgatcgaggtgcagcatccatgcctgaaccttctgtgtggcatgacattggctcataacccccttacaccttctctagctctctcttcagttctgcttcctgttccgcagtagagactgaaggaactcgggaaaggcccaagaatgggacctgattacaaagccttagtaagtaataagataacaaaatgtccacaagaaagggaaagtggggagagaagcagagcaattgcttacttcctacttagcttttcctctctttctgttttcccaggggaaggtgcccaacaatttgtatttttaaccggctccccaggtgactgctgtggttgggccaagctacattttgagaactcctggtctaccttctagattctacagaaaagatgagactttgcaatttgtaattgttataactggcaagtctccttccacttctgagtattggacagttttctctcactggattaaaagcaaatggcttggtttttaaaagtttttgaaagtaacatttattatttgacttccgctttagcaacacgttgtatatgtaaactcaaatatagttcagggaactgagagctagttcacttccaaaatacagtgacccataaattgtctttagtcatgtataaacaaatgaatgctattgggaaaatgccttagtaaatattttttgtaaaacacagcaaattaaatcactttctagaaaatctattttttttttccccaggcaagtggccatcaatcaaagaagcagaatactaggtgtggttttctttgtttttgttttgttttgtttgaggcagtgtctccctctgttgcccaggctggagtgcagtggcacgatcatggctcactgcagcctcgacctcctgaactcaggcgatcctcctgcctcatcctccggagttgctgggactataggtgcatgccaccacgcccagctaatttttaatttttttttttttttgagacagggtctccctatgttgcccaggctggtctcaaactcctggattcaagtgatcctccagccttggcctcccaaagtgctgggacaggtgtgtgtcaccatgcccagcctcagaatactttatcactttggtttccaaatattgggaatattttgcaatttaccttttagactacacaaggcttcagggcaatgctcttgcctgagttgacgtttgaaagtgaatagagctgtaaatctattcttttgtcgtcagaatttttttaatgtttttcctaaatatttaagttaaatgtgttaaaatattgttgaatgataaacatctgtagtacacttctgttgtgtttctggtgaaagtaactactgttaaggtcaacagaccaaatttgtatacaaatgctttggcaaattagaaattgaggtgaccattcagtagctctttttaggcattgggaatactcgaatgcaagaaagcattcccttatattttcaagtataaaaagtcctctaaattccttaacagcaacaatcagtgtttccccgctaagcactgttttaataaagttgctgggattttctatgataaaatcacataaatttatacttctacatacatctatatataattttattcctgtacttgttatatacatataagctgcattacaaatatatttttattctgaataaatcctaaagtataaaagtagtaaattgaataaattattgattttccttcactgtatcacagaacctgtttctccattttgagcaatggttctcgaacttggatgcacattggaatctcctgggtagctttcacaaatcctgctccctggacctcactcaggcgaagttatttatactctccggttgggaagggaggatagatccaggtgattgccatgtgtaggccagaatgggaactactcccctagtagacactcctcatcttctttccttccatgatttccacatttctttcaactcagtcgaaatcatcttgaatagacaaaggcagtgtcggtcctactaaaggttgaggaaatggctgagtaaagatgatgaagtcagggacaaaggatgcaatgaattttaagaatttgagattcaaacttcaaaacttaggcaagggtctgtttttgaaggttcagagctgaaaaacaatggcatgctttcatattcttctttgattctgtaggatgtcccaaatggggaattctcttacataatattgattttgtaaattcctgacagatcgtacccactttggatggaatggaattttaatctatttttttgagccaaagagtgtgacctcccttggccttaaatatttttttgtaccacacatgtggggatatgagtattgtgaaagctacgaacctttcctttgaatgccacaattcaagaacaaagctgatcatgtattgaattttaataatcattttcagcagctggtccagaaaagggcattttcctctaaaacctaaaaaattcagaagataaattcctatagaaaaaaaggaaatcatacttatctattcaaaattattagatcaaagactttcaactattttagcttcaaatatgtttaatatattgagtttaactgacatgaagtacctgcaggatgcgtggtgctggcttagaaaaagatttggttttcctacagtatctgaaaaacaaaaatgtattttcatccatccaaggctaagcatccactatgagactaatttgacattcaggtctggtaaaaatgtttgatggtatcagttaaaaccctgttgaagtaggaagaccagaacatgttcattagtgagtatctggcaatgttatcatctacttaagatggaagaaaggggataagatcaaaattattcaatccctgagtgatggaggaagtaaagcttgaaggggcctatacagacaacatgtatgacatccatcagtatcaggggattttatagacattaattatctagtgctctacaccctccctgcctgccttttaaggtgtattttatgattgaggaaaaaaaaaaagaccaggataatagaattgaggaagatagcaatcaatgagtaattccttatccagtcggcacttaaaactcaatgctttatatatttatttgcagagtggtaggaactaactaatcctcatgctgtgccttccttactcacttttgaccatgtttttgctatagcaaccttgatacaattgaagattgtcatttcttactcttcctcagtttgaagctcctgctttcctggacaaaagacacaaataaaacaggaatttattcaatcattgcattttatccataatttaagacatcttatctataatttttttctgagttaaaatttattttggtggttaacaaaaagagtctttagaattttgagtacctgaaggattggaatttgaggcatcctcctacactcccatagtaggtgttgaaaatgttaagttaattgaattatattgaaattttaaaatggcttggagcaacagaaaaaaaatgttatgtataaattaattaaaaactacatggactgtttttttttttttaccatccacatggataccagggatttcttttctttctctttctttctttctttctttctttctttctttctttctttcttttctttctttctttttctttctttctttctttctttctttctttctttctttctttctttctttcctttctttctttctttcttggattattaaaaagagaaggttgttttttaaataaggaaaacaattttctgcaaatggccagatagcagatattttggtctttgtaggtacaagtcctcaactttctcattgtactgtgaaagcaacagtaaacaatactttatggctacagaaatgtgagttttgtatacttttcatgtgtcataaaatgttattcttttcattttaaaaaaaattatttaaaaatgcaaaaatgagggcgggcacggtggctcacacctgtaatcccagcactttgggaggctgaggcgggtggatcacctgaggttgggaattcgagaccagcctgagcaacatggagaaaccccttctctgctaaaaaatacgaaaattagctgggcatggtggtggcacatgcctgtaatcccagctactcgggaggctgaggcaggagaatcgcttgaacccaggaagcggaggttgcagtgagctgagatcgccccattgcactccagcctgggcaataagagtgaaactctgtctcaaaaaaaaaaaaaccattcttagctaacaagccacacaaaaacaggcggcacgcaaggtttgaccagtggaccaaccatagtttgccaacctctggtttaggacattgaatatctcctgatttgaaagttttcacttgaacaaaaataattaactactattagtctgttctacaatatcctcctcaccatgtaattcttaactggcaagtagattgcctcttttgttttatttatttatttattttaaaagacagggcctctttctgtcccccaggctggagtccagtggtgcaatcataactcactgaagtgttgaactcccaggctcaagcaatcctccctcctcagcctcctgagtaactgggattacagatgtgtaccagctgtagtctacaaatttgacctgtacccaatccttggcttaatattaatttttaatttttaaaaaagtttttgtagagatgggggtctcactatgttgcccaggctggtcttgaactcctggtttaaagcaatcctcccgccttggcatcccaaagtgttgggattacaggcatgaaccacagtgccctgcctgtggcctcttttgatattgctatggcagcccagagtactgtgttgagaaggattcagaagttgaacaagggcaaatgagcagagagggctgccagagagttgcccaattggaccatccacagctcttctagctgtgttatagtcttacaaaatgcttcctttatgtcctgctgataaaagttatagacttattcttagaagcatttttctgcaggcataaattttgcaactgagatcattgtttttaagttagagaatttgaaaggattctagtaatatagcttcatgtgatatccattctcaaaaccaacaaatgtatttattggtcatttgctcacctctcttattataggcagaaatggggctggggaggaggagtgaataaaaaaggccattcacatctctaatacctggaaataactagtcgtcattggatctgctaaaattataactaaatgaatagaactatactaagatacctatttatctccattaaaataaaagctcttctagaccatacacagtatttaaaagttgttctctgtatgttattgactaccaggttagaaaaataaacactgaactcctaatgatggaatttataaatatatggaacagattctgtggtgttaatatagaaatttcaaataaaacctgacaaggtaaacactgtatcacatatcaaaatgacttaaattgtagtccatggaatactagacttaaatttatatgcagattgtattttattaggtttttgaagttccctcggcggcctgtcttgccagggcatttggaaatggtagctattataaccaatgaaaaaaatgcattaaaaaattaaaacaacctaaattacatgtatttgcggtctgtcgagtcaaacctgaagatagtctcagcctcctgcagtgcaattaaaacatctttaaaatttagttacatataaagaatttatgcttttatacaagtggcatgtgttaatatgggtgtgttttcatattaactattgtgattaaagtttcttagaagaaaatatatgggtcgtggcacttgacgtgtccatatcctgatcacgctggagtggtggtgttgggtgccagggctccgaatacagttgctgaatgtcactctgaatattatggaatgaaacaagccagatctgtgtttgccttgaaaggtatccagacctaatattgtactttaaagacattctgaagtattgacttcggaataagagcaagcattctttaagtcctgggcaaacccaaaaggaattactgaaatctcctgtttcaagcatacattttaatagtagtgctcaatgacaagtcattaattccctgcaacctgactcttaggttcaggtctccaaaggctaaaattaggggcatttgtctgcttcccttgctatttgattgggtatcactgtatgtagaagtacaaagctcatctgttaagttggatttactattctctgctggtgtccctatccatgcctaaaggctcatattgagattggtgtaaaatcagctgtcccaacatgaattgttcaattatcagctcaaataagccttactaaaaactacctaacatgaaggaggttgactgtggctctgtgaagatgcatccaaaatgtgtgcattaaaaataaaaattataagaaaaattaatcaccctttttgcataaagtatgtaaggaagcctcattctttaagcaacacatgttttataactttgccttccacaaatttgacctatacccaatccttggcttaatattaagaaactaaatctgcccacaggtatccttgccttttataaggaccattttgaattatttgtatttcttttctttggtggtagtggtgggagggtagtattgaatgccaccaagtcgtaaacctcacagaataagagcactatgaaaaaatcacttggggaaaaggtaatgaattaaggctgggagcaacttgactttgggtttagatggaacttgaagttgatgtgttagtgataattgctatagcatctctctatttttataaatcccggtttggaaaaatttgtttgataatgttatatttgccttcacaggaatcctgtgctctggacagtgttatataacattcctcaaaaattcttctaaactctcaaggccctcttcttggggtcagactcaacggtaccaatgagaaaagcctgaaagcatggaagacttctgttgtttagcaaagctgagagaagacattgtcttaactatctacactagttgttaaattaactaatcagttgatttactacattggatttcagaagggttgtccggtgaatattcagttttccatgctaattggaaatatcattgcatatttaagggtgtacggtgggaagggactaagcaatgatgggtatacagcaagtactcaatacatcctgtggctttattatactctctttttgctggtagaattttctgctacacacatgcattccaggcaaagggaagagactgcgcccatgctcagacccagaaacaagcctggatccataaaacagcttgttcacaatggcaggagcacagcacaggagtggggaaagtagaggaaaagaggtatgagtaatactgaccacgaaaggaaagggagttgcccattcaaactaacagatgagaagggcttcatggacgagatgacaacaaatagtagcattagcattcattgagatttaggacattgcacaacattttagaaatatgtacacttagtctaaaacagggacccgcagtccagatgggaattctgacaataatcacatcatgagaaagctgagcaaataggattcagtgtttttggaaaatgtaatcttagggggaaatatattcttgtagctatgtactactaaattgaaaatctacagaacaaatcatttatgaaatgtgtgggcatgcttttaatttggtggtggtttaaatattttattaactgtatgggcatgcttttaatttggttgtggtataagtgttacaaattaagctttttttaaaaatcagtctaaactcgaaacttgaaaaacaagttttttattttatttaacaagcaccgatacaacacatcgtgagccaggtactcttcctagggcttccatgtatctcctcctctaatcatcttgacagccccatgaggaaactgaggcacagaggttaagaacttgttgaaggtctcagagctaggacttcaaaccaggcagactggcaccaggttctgtgtacttaaccattatgctccttaaattagaatatctacgagtcaaaatgctgtttaattttcttcagattattgtgggttctgtcaagctaagctttctgcccataagtgaaagtgctcttagcatcttgtacagaaagaattcttcctagaggttcattgagtggcatctatttcagacttacacaaaaagtttgggacaaatgttagtgtttaacagaagcagatgtttatcagtggcccagacaatattatcattttgagttttaccttctaggctgggggcgtggcaaacaacagttgtgggtcaaatctcactcaccacttgttttggtaaataaagtttcattgaacacagtcctatccactcgtttacatgttatctatggctgctttcatgctaaaacagcagcagaattgagtcattgtgtccaagaacatatggccaataaagcctgaaatatttactacacgatcttttatagcaagtttgccaccccctgttctagaccagtgaggtagccaccagccagatgtagctcccaagtgtttgaaatggggctggtttgagttgagatgtgtcataagtgtaaaacatatcagattccaaagacttagtaaaaagaaagaacaaaatataaaatatctcatcagttttcaaatattgattgcaggtggaaatgacaattttattaaaattaacttttcttggttctattttttttaatgtgactactagaaaaatttgaaatgtgactcacatttgtggctcacattaggtttctattgatactgctgatctacagcctggaatttggaggatatgtgacctctaggaaaagcagaaagaggaaagatggggaaagagagaaaacctcttgtatttgcaaatgtctttctaaagcaataaaatattttctgatttggctcttcctcacagaaaggcatacgcaaaaatgggttaggtggtctatggagatgatcgtagatgagttctcccagaagcagactctgactcagaatttgaattgggaggtgatccaggaagcacctggagggagaggggatgcaaacagggaagagattgaagaggaaagagggttaatgagcaggttgttgctgtggacccatgtgctgcctcccaattgcgccctgtgggagattttgtagacagaggctcagagtggttccacccaggaggtgaaaaagctgggctgcatatccaccaattgccagtaattgccacttgagggctgctcctaggaacatcagcttcttcttactctccccagcacctgccttgcctgaagccaggtaaggccctggggtgaaaaggcacaggtgcttgcaggaaaaagccatgagcaagctggagaatggtgcctcccagaggcacagggttgggcccttctagtgtctggaactgtgtccaaactaaatgttccatcttctaattcataatttcaacagacattcatgtagttctctggtgaatgtgttcattttctcatttgatcttaacaatagtatagataggtagatttatcattatccatacattatggatgggaaaactgagcccaagacacatccagtcatttgccgaagagagtccagctgggatggtagtcccggtctcctccctcttcatatgtggtcactgactccttggatttctacaaaacttgccttgagtaaggagatgtcaatatattgatgttttcaaggtgagaacaggaaactaaaaccaatttttcttgtgctctgtagaatttttttagatatccatagggcagtatagaaactgatatctacttaatcccatgacttttatatggaaaagtatgatctctgttttgcacaagtcacaatcaaaatcaagagattatggagactgctgaccactaccacacaggatgttagtgatagagttaatttccagaaaatcttcagagaagtccctgtagtggaagcttatgggtgcatggctcattaaggactggattttgttatcttcccattacccaggttcccttcaaaggtgttgtcagcccctttggtaccacttggaaacaagtctctctcccagcttaatttccctttattatgcttctaactgactcggtaattctttgcagacttcagtaacacttgtactatttaaatttgaataaccccaaaggatctggataggtcaatgtgtttaaaccacaggctttagtctatgtattagttgattaaaaacagatttgatgcatgatgtatacttaataaagggagggggaagcaagcagatgtttgtaaaatctcaatgtgttggattgcatttctttggccctcttttgctgactaactttagaaaagtcatacttatgacaattgaactgtaaacagttagatgatgtatttccctagaaatttcctgctgtgaagggtcagccaaaaagaaaagtatcccctagtattaacataccaaaaaagttgacaaatatacgttataatggttatgtctatatcaaggacattgaagaatgggatgcttcaaaatcatcctctagtctctgaccataaagtgattagcagttgcgattcatttaatccaaacaataaaaaaaaaaaactttggcttttgttgttgttgttgttgttgttaaaagcaagtttttctttgatgcaagcataagatcaagttgtacataaatcactgtgtctagttcattctctgactcttcagcctcttgtatcccattctttaagtgaaaaagttattcttcccctttaaaattgtcatatttgaaatgttttgagtgattccaagacagaattgaaggtttcttgttggttttccagtccagatgaaatgtgcacaaagccttcctctgaagtttgaacacatgagaattacagataaaatattttaaaatgtattttagtgaatacataaccaagcataaacatatgtggaaagcctccaaggaccggaaatgaaagaaagtgtagagtggtgagagaagactgacactgggctactcccaagaagtggagatgacatggggcaatggtgacttcagtggacacatagggaagtgaacatcacatgtggcaagagccttgtacacctggaggccaagacccccatgcatagactggactcaaagggaacctgacatcttctctggaattgaagccagacacagaactctcatggaaggaagcagaggcactgagtcaaactaggatctgtgcctctgttgcacacgagtgccttgtgggagcgtcttctttgggaaaagaacctcacgccctaacctcagaatatgcttcttatctggctgggctatgtcaatccccaaatcacagcacagggaacaaagtttacatcgtatgagctgtcagacaaaaattacaagacaaagataaaatcagatccttgagaaatagtcaacaagcacagggaaatacagaattgccttttctcaaaagagcttaagaataagtaagtttagttgttttgagattatggagaagagaatcgtgtttttgtaataggaacagagagaaattcaataagaaaagggagatgtgataaagaacctactagaaatgaaaatgcattcattaaaaaattttaaaatcagtcaataggataaacaccagattaataagtttaacttgttttaaaaataaccagaaagttctgcttttgacatatgcattttaagccttagatgaaagtggttcttttccttaatatacttttctaaataaaaaatttagggaagtagaatgagctaaaattttcataaataaattttacagcataatgaaattaacacctttatgaacttgttagttttcaaaatccctcaaactctttctaaatcctctttcttggatggcattataaatttgaggtctgttttcttttccatgaaatttcctgttgttccgtatctttgccatacttgtggaactgtctatatgctaaaacacagtttccctaatcttttgccctctcaacctctctgatgttggcatacgacattgttctattccctgcccatggaagattcttccacatgctcacttctttctttccaagaagtttccactgttgtgcaacaaaaaacccctggacatccttcaagcctcagctgcaagacttggccctcttggaaacctttaaccagcagccatcaactctttcccttctcttgtttgcagcatctttctcccagtttgtacagtcatccatttccttgtggacagggaatagatattaatatttttatttgatttccccactgtctctttcagagtctggcatattgtagaagcttaataagtacttgttgtatgaacacataagtaaatgaatgaatggtaggaacacataagtaaatgaatgaatggtgtaaatcaagcttgtccaacacgtggcctgcaaggccacctgcagcccagaagcgctttgaatgcagcccaacacaaattcataaactttcttaaaacattatgagattgttttgtgatttttttttttagctcatcagctgtcattagtgttagttattttatgtgtggcccaagacagttcttcttccagcatggcccagggaagccaaaagattggacacccctggcaatcaagagcatgtgaatgagaaggaacagagaaatcttagtgagtcttacccagaacagagagctattgtgtttgaaaataggattaaatagtcattccagagaactttaagtttgatgctctaaaggaatagggaataattctagagtcttatgcaggataatgagtggtaaatacagtgttcaaagaaatttgatctggcattgatggacaaagaatagaagcatgaacaataaaatgtacaattgtttgttggtatccataaaggattaatttcagggtctctcatagatactaaaatcatggatgctcaagtccctgatataaaatggcctgttatttgcatataacctaatcacatcctcctgcataccttaaattctctctagataacttatattacttattacaatgtaaatactatgtaaatagtagttatattctatggtttagggaataatgaggagaaaaaagtctgtacatgttcagtacagatgcagtcatccatttttttccaaatatttttgatctgcagttggttgaatccaggtatgtggaacccagtggatacagagtcaactccactacaactgaccaaatgtgtgtgtgatgaggacttatcataaatgtctataaatgaccttattgtcagcaagagctaaacaattcaaaccttcctccaagggattagcctcagcctgcccataaaaggataaatctgaaaaatccaatggtagttgatttgatgtgggaatatattccttatgttattgccagctctgattcaagtaaagggatagaaatccaattacctcctttcttcctaggtcgtgacctagagataacctataactaattattctgttaagtatccctgagttagtgcaagaagcaggaacaaaaagaataaagtctgagcgtgtctaaaaggttcttttaaatgcaacttttgaaaatccagtttaaatctataaatacttgaaattatgtcgatttcactaaggtttctgaaaaatgtatcagtttttcctgagaatgagtaattttgtgtatctgaagtataaaagtatgcagaataatatttttcctcttttttttttttttttgaacagcaaaacttagagagtaacctcaccaaccttattaagaggaacacagaactggagacccttttggctaaactcatccaaacctgtcaacatgttgaagtgagtatctctgtatttctgtatggtatgtttcatatgaaaactgccagatcaaggttttgatatcctcatgctttataattttaaaacaagaatctttcttaaaattaaatattttgcaaaagccaaaataaaagatggaggaaattaaaaggaattagaacttcagagagtctttcccatccagggctgcttcccattcccattatagctcttcctgatctagcattacatagcagtcctaatgttggagattttaattgcccttacaaagaacagtcaaaaaaggtattgtaggccgggcgtggtggctcacgcctgtaaccccagcactttgggaggccgaggcaggcagatcacgaggtcaggagatcgagaccatcctggctaacacagtgaaaccccgtctctactaaaaatacaaaaaattagctgggcgtggtggcatgcacctgtagtcccagctactccagaggcggaggcaggagaatggcatgaacccgggaggcggagcttgcagtgagctgagatcgcaccactgcactccagtctgggcaacagagggagactccgtctcaaaaaaaaggtattgtattagtgtactatggctaccataacaaattaccacaaactgggaaagtatgaaacaagactaatttattctctcagttttggagactagaagtctgaaatcaagattttggcagggccatgctccctacaaaggttctaggggaggatccttccttgcctcttcccattttctggtagttgcaggcaattcttggagttccttggctttcagctacagcgctctaaacccttcctccgttatcacattctcctggtgtgtctctgaatatgtgtccaaatttccttattgttataaagagcccaccctactccagccttacctcactttaacttgattacatctgcgaagactctattttcaggccaggcatggtggctcacaccctgtaatcccagcactttgggaggctaaggcaggaggatcgcttgagctcaggagaccagcctgggcaacatggcaaaaacccatctctattaaaaaatacaaaaaattagccaggcgtgggagcacacacctgtggtcccagttacttgggaggctgaggtgggaggatcacccaagcctgggaaatcgaggctgcagtgagctgagattgcaccactgcactccagcctaggcgacagagtgagaccttgtctcaaaaaagaaaaaacaaagattctgttttcaaataaggtcccatttacaggtaccaagggttaggacttgaacatacctttttgcggacacagtttaatgcactgcaggtgtatattaatgcatcttagttgtcagatatgtttccatgaaataaaccacaattgcaacaacagcagaacctgcaatgactacactgaataaggaaaaaatagatgccacttcctttatgtgattttcaaattcctcttccatcttctcccaaactgtcttttttaccaccccaccccatgaactgaaactaaacaattatcattcattacacttttaagccttctggcccttaaccaagcagttccctctgactggtaggcccattcctctaacccatgtctatttgtcagaatgcttcttgtgtatcctccaagtcctaagtcaaggggcacttcagttgtgaacgtttctctggttccctggaccagagtcatcgctcctttctctgaatcacgtaacattttatgataccgtgtatgtgattcagagaaaggagagatgtccccgccccaatctcatgtcgaattgtaatccccaatgctggaggtggggcttggtgggaggtgtttgggtcatgggggcagatccctcatggcttggtgctgattccatgataatgagtgagttctcacaagatctggttgtttaaaagtgtatgacactcctcccccaccgcccgcccccctcccatacacactctttctcttgctcctaatttcgccatgtgacgtgccagttctggctttgccttctaccatgtgtaaaagcttcctgaggcctcatcagaagccgagcacatgcctggtgccatgcttcctgtgtagccctgcagcacccgtgaaccaattaaaccccttttctttgtaaattacccagtatcaggtatttctttatagcaatgcaagaatagtaataatcttctcatggctttatcattctttcatgtaccagttccatttttccaaccagaatgtgaggtcttagaggatgggaatcaaatctaattcgtctttgtatctcacagactctgatgcaatgattttcacacagtaggagctcagggaatttgttttagatgaatttgcatgatgactctccaaatggcaaattttgaacactatttgaatgcctgcaagttcagctcccctaaaatatctaaagttggagaagcaaattattttgagcaggcatttaaaaattttgacagtaactccatttttgcaataagaattccttcaagtccctttgatcgtctacgcagtaattataagtttatagcctcctatgtgcctataactgtcagtagatgcacaatgtagcaaataataataaagattacaatatgttagagaacagtgtacacacatataacaacatatttaaagaacagtagagtagccaatcaggtgctcagctagtagaatattgcatttatggattctaagattagcatttttttgaagactaatattgctgaaattgagctgcaacttaaatgaatggtgagacagtttaatgggcaacatttgtttgttcctactggcacacaaaatatagatgagacagttgctggtatcttagattagatggagtatggtttgagaaggggggattaaaagagaaaaaaatgcgaatacaatttttctgaagctttgtggaagagtcaggacttgagccagttcttatagatttcacaactattatttttcagtaccctaagtattgaggtgtcagcttatttatgcaacacaatgatgtttgtcagtgatacattcctcagcatagcagaaattagcaaagattgctttcagaaagatcctatcagtgtaaaagcatgtctactatgcaaatactggtgctttggtggaaggcttaaaatactttgtgtttgtaaagtctgtgcttttacttacaagtgctccccttgtgatcagaaatgtaaaactggttactaagagaaacacatgagttagcaactttttccaactccaaatttgttgtgttttccaaggataatatccagggagacagaaattagggatgttctcatctcctacctaagccatctactccagctgttcatcatttgaggtgctgatggaggttatgataggtggaagagggaaaggcatacaaaaggaaagaaagggaggaatcagagtaaaacataggtgagagagcagattaggattgtccagtgagcttattggttcacttagtagaccctcttgctttaaaagctacatgattgtcagggtagaatcagtgtttcatcatgttgagatgaagttgagagtgtgaaggcagcagtgtgttgcagaatccagaccttttgaaccctctgcttagactggattctcttttggcaagcctcttgccagggaacatgttgagccttgttgattaaacaacattggaaataatagtgaacaagcataatgttttcattattatagggtaaagttaatatgtattatatgaataaatggatgaacaaaatggaataatctgtgtgccatattttatttttatgatgtgatggcatttgatgtttaggatagtaagaaagaattatttctcttcagttaaaaaaaaaattacctgagctttatggtaaatcttataaatgctttatggattgggtgattatgtcattcaatttcagctagttactccttaaagcattaatgtctggtttccattatgacctgttgtgatttcagaacaaatgcattgcttctaatgcaatattattatggcttgaatttacaagacgctattcatcctaacatgatgtaaaattacattctaagatgttcagtaatttcaaatgatagataaattgaagaaatttacagggagattttagttttattttaatagatcagatatgattttagttgcaatacaggcttttcaaataaagctattactgaattgattgtagtggacttgcatttacaaggaataaagaatattcattcttttctctgttgtttttgtataaatccttgggaatggaagcacatgtttatgggtgagtaaatttggtatttgggaaatttattctagataaaaattaaagaaaattatgagtacaaaaataatgatacttacagtacttatttttacgtttgtttttattcctaattattagtattctgaaagtataattttcaaaagttgaacacccaattctcctataatgaatgaattagtccacatcaaagatttttttaacttcttaatgaaggaaccagcaagatgataaagctgcttccaaggaggatgccagaaacggatacatataaatgtggggaagggggtagtagggggaaaagaatgccagactagcatagctaatttggatacaaaactggttagtgacctacagggcaataaacctgaaacatttggacaaaataagttgcatattactgggtttctctaagttaacatctaacttcgcagagtctaagccctaaccactagtaaatagaaagtcagactctgttacatcccagtctggagagtcagatgaccctgacttaggctgacttcatggaatatgctctcgtgggactttggaagggctcacagtcttctctttctcttttttccatgttttggataattttgcttaacatgactttctgttctagagactgttggtctaggagcagtgtttgctaaacaaatatttctgggaggggatgtacatttttgcctgtggacagttactttaatttgttacagtgtcttgctagtttgttcattttggtagtgcggttggagtacccactgtgtgtgtgttgcactgtgttaggtgccaaaggaccctgcccacaggaagtttactatcttcactaagacagaagagcacttataacacaaaataaagtagaaagccataattaccatgaagaaggtgtggattatctacttcaaactttcagagaaacaagaaattatttctagctggggactggggaagcagcgcaagatctgagcctgccttcaagggtaggtaacatttgagtttatggaagcagcactgcttgccaggcaaataaaggcatggggatagaaagacgaggaatgtatgtacacaaagcaagtagttcattctggagaaatggaaagcatggaagaaggaaggatctgtaggaactagtttgggagagttgagagctggaaaggctttcgtgttgcatctgaatttgaactttggttttgaaggtttagtgagggttcaaggaacacatagacctgtgtgagtttcacagtgacaactggcatttccaactcttttcaggaaatgacatttttggttattgagaaaataatatggatattgtcatgcaaaacaatctcatgtccaagggaaaccttcacagcactaggaaactccaaaaaggccatggagtttgttaggcaccagcatgctattcttttaaatcagtgcagtggaaaagaatttcctggtccacatccttggttcctagatggtacttcttccttttcctcttcctgaaggtgtccttgtatttgggtatgagcattccccgggaaaataattcccatgccagctggagctaaaaaaaactcacagcacagaggcacctcctaattgttgtaaattaaatcaatgaattccttcccacgacccatgaggaaatgccacatccttataagtccacatctcttcccagggatttacctctgcttttcttcagaatggaaaacagtttgaaggttccccttcagccacccaactctccccacccctgccacattgttttcataacttgttttttaaatgagggtaagcaaatgaatggctttttgattgtaagtgccaaacatttttaaaacggtggataacagagaatggcatgctgtggctcatgcctgtaatcccagcatactttgggcggccaaggcaggaggattacttgagcccaaggattcaataacagcctgggcaatacagtgagacctcgtctctacaaaaaataaaaaaactagacaggcgtggtggtgtgcgcctgtaatcccagtaacaaaggaggccaagactggaggattgcttgagcctgggaggtcgaggctacagtgacccatggagtgcaactgctctccagcctgggtgacagagtgagaccctgtctcttaaaacacacgcgtgcgcgcgcgcacacacacacacacacacacacacacacacacacacacacacacacacaagagcagagtatgaaggccaagacagtttgggactcaggaggcagagacattgaaagagcaacttcaggccaggtgcggtggctcacgcctgtaatcccagcactttgggaggcccaggtgggtggatcacgaggtcaggagatcgagaccatcctggctaacacggtgaaaccctgtctctactaaaaatacaaaaaattagccgggcatggtggcgggcgcctgtagtcccagctactcgggaggctgaggcaggagaatggcgtgaacccgggaggcagagcttgcagtgagctgagatcacactgctgcactccagcctgggggacagagcgagactccgtctcaaaaaaaaaaaaaaaaaaaaaaaagagcaacttcaggtagactcctaagaaatgtttgtctaggattgtaaaaactaatgggttttcaaccactctattttgttttcttcaggagagaaataaggtagaatggatgagtttgtagttacactagacaagtttggagttaattatatatgtagtgaaagacaagcttatgagaaatgatcaaaatttgggtcacctgtagaacttaacttttctaggtcagataaggactgtatctcttcatcacatttctctttccattttctttgaaaaatcagaagacacagtttattagctaagcaaacacttggaatcactgatatgtaccaaattttctgcacattccaataatcaagttcttttacagcaaatacaacaccttgacacttaatagatgttcgttttggaaatgataggtgccagtgactctaaagatgatggccaagaacaactgggaaagggtggccaattgccataatggtttcaagaggataaaggctcagcagtccttaccattcttgctcaaggtcatcctagaagggcattttctaatccaacatcacttcaaagttccagcattggcccctttggtttatcttgccttgtttgtaatcacttcttaaaattctttttgccattatttttctcactaagtttttaatctatctttgttgttgttttattttaatggaaagtttgctctcatacggctttctctgagtttctccagtgctagttgtcatgtaaagtgacaaggttcttgtggaggaattaaggctgtttaattagatttctgctcagatgatgagttttgtaaattgaaaaggatgagagtgaggtgttacttgggtgatatgtaccttgtaagaaattgtagaaaatcacttggcaaaacagatgggagtctgtagaagacttttccagtaattcaccaagccctaaaagcattcatttgtaaactttgaaataatgaaaaatcactgggttaaaaagaaagatgaaccatttgtttaattttgttgtgcagttttgtaatgccaaagcattctctctccgtagaaaacttggcaatggcttcatccggagtcattggatgaagaccagcatgcaaacaccaaacgagctatttgtgtcttgtgaacgtgtgtctgatcttggatgaagtatatcctgctgggggccgacatgaatgtccaaagttataatccattttcacttgcagatgagggtcagattcccacccgatctgaccccctgtgagaatgctttcaaggtataattagagtcagattctgggcctcattaaaccacatcatacaacccacagtcagctctggctctccatgtaataggctctagaattatgataatgtgatagtgcaaatatggtggctttcagaaactggattatgacgagccactataataatggttgatttcccaagttcacgtcttaggattcccatgacaaaggagaaaagaactgttggtctgcacagaaatttatcatctctggagaagatttgtttttactattgcatttgaataatgtctattcatatgcaatagtaagacagttgaaacagtttactctaccaagtttactaaaattgacaactcatgaagcaaatgtagtttttcttggtagaggttaaatttaattattaaagtatctaacacatacttgaatgtctccctttggattcagtgcccttgacttagaaaaatttgattcataacaggcattggatcctgtttctttcttgggcatattcataaggagtaatgagaagatatcagcaaaaatctttgagtattttggaatgagattaatcttatgaataaatgaatataaggcttagtaagctggtattacttttagaatgacattcccaagtttcagttttgaaactttatataaaacattatccaaacctttcatcgtctgcaaatctttctagtttgggtggtatgacctattgcatcatatacagaatcctacctagtggctcagattggagtatgaacacttgtacgtgcctctgaagacaaaccctctaatgtttgaatttggtagtgcagatttccaaggttaatacttaaatgtgaagcaataggccttaattggaggcccaaaggctgagcattagaaagttagagagaaagtgtgcttttttctgatatatcttattgtgctccctccctccacacaatacaagaattccttatcctgtctccattacagtattccacacacaaccttctttacctggaaatatttacttgcgtgattgactagagcagcagagatgtttctggcatgatataaagaataataggaacaggtagtgatacattttttaaaatagccattgttggccaggcacagtggctcacgcctgtaatcccagcactttgggaggccaaagtgggtggatcacctgaggtcaggagttcgagaccagcccggccaacatggtaaaaccccatctctatttaaaatacaaaaattagctgggtatggtggcaggcgcctgtaatcccagctgctcgagaggctgaggcaggagaattgcttgaacctgggaggcagaggttgcagtgagctgagatcacgccattgcactccagactgggcaatagagccagactctgtctcaaataaagtaaaataaaataaaatggccattgttatttctaactcaacttttatatgagatggtcttagctggatggtttcaggtgaaagagtcagaggggaatggaatgattgcaggtgagaaggtaactctcaagtaaaagctttggttcacttattgctcccattcatgacattcagaaacaagaataatcctaacaatcaatccaccattttgttactgaaccaaccttttacttctgggtctaatatctagtttaaattatttttctcaataaatgaacataaaattgtcttccaatgacaatcaagttgaaattatctctgtgtataaaataattacagattatgaaagaagccagacatatcattttttacctgattcggttgacttctatttttaatttgctaaattaaatgttgtaggaaaaaatgaagagctttgttctaattttgaaattccacagcaaaataattgagtcatgcatataaaatgtccgttaacaagaagacaattgtagtactggttatttttgtttgaaatagaaatatgaaattttaaattcagctatttaaaatgcccgaggctaccatggaatgtacaaggctctcagtgaggagcaacacaaagatttttacaaccaagtgaggtaacttcttggcctaggaatttatgatagagcttttactatgcttttaaaagtattttccctagatataacatcaagttcatatatgtaaagtcgtgaaaactatatagtggtctaattctctgacaaggcaagcttggtattgagatgtcataagttcattcaaggaagccttctgtcaatttccataggattgggaaggtggtgccttgtccatctttgcaggtgttggaaggggagcattattgcatagatctgttccagtttcacagcaacacatagactgtagtgtaaagaaagaaaaagtgataggacttatgtagatatgcactacaagcagttatgaccatgaccagctcttactgtcacttcctgatttaattatcccaacagtcttttgacataaacatcattcaaataaccacagatacgtggcctgaagccagatataacaagaatcagccagtaaagaaataggttgaatttaaccaagtaataagtaactggagttgttactgaacccaaaccaggtgattagaaagttagattcccaggggaattctcattacaagaaccatcttatcagataggtaattggaaaccctgttaaacccaccataacaaaggctcagcaagtgtacatctgcagtgccagtacaatcagtgagtcttcagttcttatgaacgttctgaaatcttttattattaaccattgaccctctaacctcaacttctttgagatgataaatttgtttcctttagtaaataagtaaattcctttttttcctccttcccaggaagtttgagattcatgtataaagatgaagaactaaataatactggctgagccaccctaatttgaaaatccaaaatccgaaatgctctaaaatccaaaactttttcagcactgacatgacgcgagaagaggaaaattccacacacaagtacttaacacaaactttgtttcatgcacaaaattattgaaaatattgcataaaattaccttcaagcttatgtgtataaggtgtatgtggaatgtaagtgaatttagtggtcagacttgggtcctatccccaagatatctcattatgtatgtgcaaatattccaaaatccaaaacacttctggttctaagcatttaggataagggatactcaacctgtagcataaaatcaatattttgggttatgactgggtgcagtgactcacacctgtaatctcagcactttgggaggccaaggtgggaggattgtttgaggccaagagtttagaaccaacctgggcaacatagcaagaccctgtctctactaaataattaattaattaaccaactgtgagtggaggttcttgcctgtagtcctagctactcaggagtctgaagcaggaggatcactagaacccagaagaagttggagattacagtgatctatgattgtaccactggactccagcctgagtgacagagacagagaccctgaacttaaaaatatatatatattacaacttgggactgaaatatttgtttgtatgttaatagttcatagcatttaagataatatgacatattacagaaatttgacagatttgctttgaaatgctaatttgaaacacgtaatttttttttttttttttgagatggagtcttgctctgtcacccaggctggagtgcactggtgtcatctcggctcactgcaacctctacctcctggggttcaagtgattctcctgtctcagcctcctgagtggctgggatcacaggcacccaccaccatgcccagctaatttttgtatctttagtagagatggggtttcaccatgttggccagcctggtcacgaactcctgacctcaagtgatctgcccgccttggcctcccaaagtgctgggattacaggcatgagcgaccacgcccagcctaacatgtaatttcttttagaactgttattttaagttggatctgtaagatagtttaggtttcaaagcaatattgcaatgttcaaaaaaccttaggtttcagcattttcttttttttttttttttttttttttgagacagagtcttgctctgttgccaggctggagtgcggtggcgtgatctcggctcactgcaacctctgcctcctgggttcaagcaattctcctgtctcagcctcccaagtagctgggattacaagtgtgcaccaccatgcccagctagtttttgtatttttagtagagaccgggatttcgccaagttggccaggatggtctcgatctcctgacctcgtgatctgcccaccttggcctcccaaagtgctgggattacaggcgtgagccaccacgcccggcctgggtttcagcatattttttaagtttagtttattagatttataagagctacttaaggacttgggaaggtataacgtgttaggattttaattttatcctgttagcatttgaagtgcttataaagtaaatcaaatgtgttaaattgataaatgcagtttaaagtgttacaggagtaatctgaacagtgattcctcataggggtgaggattgacctgaagagcggctcgagggtactttctagggtgatagaaatgttttatgtcttgattgagctgtcggttatcaaaatccattaaactgtcccttaagatctatgcatttccttgcatgtaaattttaccgcaatttaaaaatatgtgtgtaggaacttaatcagctaatgtatagacagaattgattgtttaatggagttgagtctattcaacttgagttaatcaaacattgattcaaggactcccgagagtgattattcttggtttcataaaatttattagatgtatgaatagaataatgagatcataatttgaacttaaaagcttaagggaaactacatagtgaattgttgacatagatgcagttcttgaacaaaaatcttgatggtctgtaagtctgtgtctattccttctcctagttggttggactcctgggtaaataggacagtcttcctagtatgctgcgtttagcatgcagcacttgactattgatgagtgaatggaacacctctagaggccaactacatcatccttctgtcctccttgtagcactagctcatttgcatagatcagcatgtccgataagctcacaccttgaagggcagaaaggacccttcttgagaagactgtacacagcactgtgtttttatgacagcaaacctcagtagccacaaatccctggaggatcagtaatgctagtgcacacaaggagctccctcccagcctgagggctctgccacccaggtagggctaagaggatggagttgacaaagggaagtcaaaaatgagagagctgtccatcaggagtgttgctgagccctgaatagagatcgatcgaggtgggtctttccttcccccttattataaacctgtacctttccttttattctctaggataccttctctatcttttctggtttgcaaaagaaaaaaatagttagatagtcactttgaatcaggcttgggaaaacacttataaataataattccacacatgtaagatggctaatcaacctaggtctgaaaatgacttaacaggaaaacattttcaatatcagtctctcatgattcccaaacacacacacacactcacaaactcaccacaacttcaaaattagcaaccaaaagacatctaaatgctgtgatctttccttttctcttccagatcagattagctttgctcttcactgtccttttgtcaaagcccctattgtacagctctccagtgtccttcctgcctgcccttctactgccattgtaacttttaccagccccactaccatttcagaagaaaactccaggaaagcaagtaagcatggatagctttaaagatcaatgctgaaggcccactaagaccaggatacaaagggagtcaattagaaaaaggtgggggtcaaggaagaactccccactcccaagttaaactcctcaatttgctgttttgttttagccagactctatggagctcagtcatggctagctctctgcaaatggcccccaaaaggcttttcacaaggggcagtaagatataactggcttcggtatttctgtctccccattcccagataaccaattcaagatgcatgcccactgtaccctgcatgttgttgaaacagaattttaatttcctctgtcttgcaaaaatgttcttttgcctctcttccctggtgccttttctcatcttcctcacccctgggtttcctaactctgtcttgcctactctgatctccaaagaccagtctctccttcatatttggcatgaaaccttcctcagctactcacacagtaattgcctcatttctcaaactctccagagtcacatcatccaatcaaagtactgtgtaatgtgagccacatatgtaattgaaaaattttcaagtaatcacattttttaagtaaaaataatcaggtaaaattaattgtactaatacattttatttgaccccgatatatttaaaatgttatcatgtcaacatgtaatcaatgtaaaaatgattaatgtatgcatttcatattcacagcacatctcaattcagactaaccatatttcaagtgctcaaaaccacaagtggctagtggtggccatattggaccacacagctctagaacttctgtagcccatggtttagcagttaattatgtgtgcacttggcatgttcgctgcttgttctctagtgaagtcattctttctagcaggccaagttctgtttctaccacaggtcctagcatggtgctttgcacattgtgggcactcaacaaatccctaagatttgcttcatagatgatccctgtacattgatagcatcttcctcattcatggaataacaagaatgacctcatctcctctcactttcattccttagctactaacactgttgcaaagatctctggaaaccggaaactttggtcacctatactttaaatggagagagaagtaaaacttgctgctgagaagcaaggactgcatagaaggtttagtttgctggtagaatcaaaataagcactgaatgaagatgtgtgtggttcccagttttataaataggttttgcaagaggagagtgtttgcttctttgtttttggtgcgaaacatttcttcttttagcatgttatctgaaagtattgctgccaaagggatgatttgccagagaaagatggtttctgtccagttccttcatatgtcaggcataacctccaattaatctgaatgaaagagtgggtgcccatgcagacaatgccaacaaatgcccctgtagagaggacacatacagatgccaacctgaaatcagacactggctactgaaacaaaggattgctttaatttttgcagaataaactatttttttcttctgcttttcacgaagtggccctaaagaattcctcttgtttgtggtctcgaaaaaattagaactatgccaatgaggcctgcctttaagggttctattaaacaataagaaggctttgttcttggcaataaaattaaagcaagcagtgtttccattacctggcaggctgccctctcccttcccacaaccctgaccccgatcctgacaaacctcaacagaccattctgtttcccaggtaggaaggttagatggtaacatctgtcaggtttgtttatagaaatatagttgaccttaatgataatgtataaagagggagagatgggggcggaggggggaggaaaaaaagggggtagggagagagagggacacttctccaaataatccttaactcaagctttaaaaaagtcaagtttactgcagaggcttcaagttctcaaaccattgttccagaaagacaataataatttcacaatgagttgaaatgatggaagttaggagtcactagatgaggaaatatacattttggtctgacacgctagatgtcacgtgttttctttttcagggaactttgcctaccattgctcaaacttagacccacttacagtcagttgcaaatgagtgcttgtaggtagattgtgaccctgaagtcaggaatgaccaaggccagtacagaaagcactgtccgatgcaaattctgtttagccccacagttagtcacaagtcattggaactgaaaaattggatgactgtgatgccagctctctctgtcctccatgagagctcaaaatggttatattgtagtctcctctagtgtaagagctcctgcctacagctgtcaaggccatacccatattgcactcacaggtcctatctccctggcctgggaactttttctgcccctcccaggaccaactaattccaaagggaagttaatgcctaccttcccccaacagctttcaaccagctcctgatgggagatgttacataaatactctgcttcttccctattagctggaatgttctgtactgtttcccagagttgcccaatggggttaatctccagttgcccaaggtggtcttggtaagtcacactttactggcttcgtagttgtccctgtttcacttcctacccagtactggtgttttctggcaacaatttgaccatccattcttgtctcatatccttcttggggaggatacaactgccaaccatgtctaaaatgaaatgatagcacaagtctctttttctagtcatggctatagctcacatgttcaatttctctaaactcaagtctctttcattgtgtttgaataaacgtacatgtgaatcactggacatcaaagatatttaaaaatcaatctactcacttctcctgatattctagaatgacaacaacagggcaagatatttcatagatatcacttgtgggtgcgtcatgaaggcagaacaaagcttaacattttccagttgtacctcccagttaagttctatcagtgacgtaatcacgtgtatttcactcactgtacggaataccaaagagcagaaacccaatgttcattttccagaactttgcagaagcagatggcttctatacctgagtaactgaaacccaaaaaggggtccaactcagtatttttccagtacatcacttttcaggaatcatggcacaacaactaaaaggaatgtcacttaatgagaaataacatgtaagattgaaagtgattaaggtaaagtcatagagtagaggtttcctctttccattagaaataacttcccttcccttaaacacgtcacctccatctttcctggcactccattaatggtcatctgctaaaagttattgtttaccctctgaccacaacatcaaatgccaaacacatttgttgaaaattatttaatagaaatcgctacttttcagaaactttatgaaaaagacgtgatagagacaaacacccatggcaggttaagtagatttcttttcattcagtgtgcccagcccaaacggaagggtgtgaagcatttgttttataaagtgtgtaattaataagagaaaggaagggaggagtttattgtttttcaatgaattatgagcaaccccttccattctgcttcttcattttggaactgcttctaacaaagttaccattaaacacaaaaagaaaaggctgtgatattgatgccaagaatataagattgaagtcagttgagtgtagcctaggaaaaacattacagaaggagtaacatttattataattgtgacagaagtcagcaggacatcatggggaaagtgaaaaccataccgcaagtatgttgtcattttcaaattgaaattccattaattcagtacttgtagctattcatgccttaaaagaagaaaactaatatttattgagcatctactatgtaccagattgtttacagatattttcatcaaaagtatgcaaatgaggaaacattctcacagaaattcaaatatttttcatacctgcagtcctctgaatataaagtccatgatttttcctttatgccagaggtcagcaaactgtgacgctcatgctaaatctgactgtttttgtaagtaaagttttatttgaacacagccacgtccatttgcatccgtattgtctatggctgctttcacactacaatagcagagttgagaagctgcagcagagaccgtctggcccacaatgctaaaataattactatctaggcctttacaaaaaaaaaaagtcccccaactcctgctctgtaccacggaagaatgttctctacccttcttcttcccccatccaaaattgcatcaggaggcagccttcaaggaacccagttaggatttaaaagtagcttcaaaaattctggagttaagcctcatgttatagcttccaaagctattattttgatgatgtagatgcatcaaagttttgattcatgctagaaagtcctcaggtaaccagcacaggctgactggtcctagaacctctagttttaattatctatggacattccagataaaaagagtttgttagcaatagtgatcgttcacatttatgtagtaattattacatgccaagcatttgtcaagggcttttcatgttttcactcatttagttctcaccacagtctaacccaggggttctcaatcttgacactagtgggatttggggatggacctttcactgttgtgggggctgtctaatgtgttgtaggatgtttagcagcatcgcacctggtctgccaggtaacaaatgttattttcctcattatgcaggtagggaacttgagatgtagatagttgaagtaaatgcccaataacatacaactagtaagcaataaaaacctggtgtttcaatcccgggaagacttcctcaagtccctgaaccccaaaccactgcctccattagcccttgctccctctaaattattttacctgtttgaagattttgctttactgaaaaactaacagcgacatcaacaacatcgtgaatggccatgttctgtatgctactattggaagtaaaactcctttatgtgaagtttcaaagttttaggcattagcaatggcattttttgctaggcagttttattgccttattacagttgtatttcattcataagaaagaatttaattgctctactcaccacagtgtgttgccatttttgatagtgtcttgcttccttgtccagcactcaagcttcataatcttagaaacctcaagaaaagaggatttatcatgaggttcctcggagctatttttttagtcccatagcaaattcccatctggataatcaatatgtagaattgatctcctctggtccaaataattttccactacgtcactatgctaaagcaggattacatgtagcttctagttgtatcactatatcactgctattacttcccaccaaaagcactttatgaaaggattccatttttaatttttctgaaaagcctttcttggagtttaaaaagatttgatcaaaaatgttaaatattaaattaacacattaaacattaaaaatattgtcccgtactctggtttgtcctccaaagacagagacctcaggagccaggccattctctctctctctcattcacttgagccaggtccacaagtatttgactttggtgtgaaagagtttcagagtgaagattacatataaacatatcagatgaattacggtaatattgtctgctgttcctcaattctccttggctcagttttatatacagactgaagtattagaatccctttcattgttcctctggcagctctgtctaacttttgccccagagtctggaatgttcatcacagctgtctttggcaataaaacccaaagcaccctcatatcatcatatttctttttgcacctggtcagtggtacacagcggggtgtagagcccacttgcatacagttttctccctgtaccctcatccacaggccaaatatcagcttatataaagctctgttttgtttcagttacttcagccttgggcaaattggaattaactcctccaatgtttttcctttggagtgagatgggatggttatgccacattatgtagtaccactaaccccttcgaatttggatgcagactcaaaattacatattcttagttatagagaaaagtccttttgagtctaaacaataacaagaacatcaacctagcatcatgtataaaaatgtttcagcctttctcaagatcaccttaatttgtgaccttggaatggaaggtcacatttattcaccgtggcatgaaacagcttttgtttttgccatgaggccgaatctaggcaaacttgtaaagtagacatttgtcttttaaactcccaactccttggtaatggtttcaaagatggcaaggttcagaatcttaaactaaagggttcacagtttgatggtgcaatttcaagagtgcagtaatggtgggccggggtgagagaggcacaactcaaggggtctaccattcttgcggaattcaaagtgaatagtagcctccggatttgtgcagtgcagcaaccctcttctcaacacccagaaatagaatatcctgtctccaacacgttggggttatcctgtcccaagcttacttcagtgtttccgtctgtgtacgaataagaagtgatatatcaagtcagtgtgtcattttcacaagaggaattataaggctgtattctgaaagtctatggatggctaacttatttcaataaagcactgcaaagtgagaaaatgagagtttctaaaatgcatgctagatcaatttcacctgtgaaaactggccagatattttttttccttcactcatgctccatcctaagagttccaaatatttctaaagattttaagcccacacatgtctgaaatctaatgatgtttatactctgcactgaacatctcattttgcagttgaatacaagtcaaattaaaagagccaggttttagaaataatacttaaaaaccacttacagactgctaaagaacatttcacagacacctagtccaatttctagtatatgtatgtaactaaatccctttaatgtttatacatatatgacaaggaaaaaatatttgtcctctttaccccacccattcctcaaaacactgtaacactattacaccataaaacttagcagggagactttgggcgttgctaaccaagtgccctcgagaaaatagctaatccatttatgtcatcattaactaatctggggaatgattacgcgtaactgcatttctagaaagggaaggtaaaccgtgcacccagtagcaacttacatgggactgcaactgattattggtggcagatatgagcattaatgaagccgagtgaccctcaatgctgaattccatctcaggactaggcaggccagatatgattgttgtgcttctacattcacatcattattcaattttgtaatatctctttcatcagactgtaaaggatcagaaagtcattggcagagagaagcagcagtattaccctaggaataggagaaagtgggtcagcaactccctacaggcaagactgatggggagaagatgcatttcaagacgcgaaagaaaactgactctagatgtagagaaggtatgtgctgagcagatgggtgaggtcaaaaatgagatgaggtgaaagtgactgagtttctcatactggtgggctaatgtgatatttgctcatgagtgtacttgaggtgagaaaaaaccatagtattgaggagcctagcctgagatctcggctcactgtaacctccgactcctgggttcaagcgattctcctgcctctgcctcccgattagctgggattataggcatgcgccaccacacccagctaatttctgtatttttagtagagacagggtttcatcatgttggccaggatggtttcaatctcctgacctcgtgacccgcctgcctcggcctcccaaagtgctgggattacaggcgtgagccaccgcgcccggccaggaaggcctaattttaagctgtatttcatcctgagaagtcaagtgccccatttccagtgtggtccaaaggcaggagacagtaattacccaccactggacatcattcctaattatcttcatctcactcttgccgttagtttaggggccaaggaggagactgatggcacaaaagtggaaagaagagtttgaacttgttttctgcatccttagattggccctcctcagagcacttccatcagccacaatgatttctgaatcaaaagatgtgaatcagaaatgaaagcaaaaatcataaccaggagctgctagcttccaaaccaaacctgggaactagaaacaccagaacataactgcaagtaaccaataaaccctgccatatttgaactaatagaaattaatgagaaagtccaatcaaatcgttaattctttgtttaagtgacacatgaaacagcaaaactgtggaaaacttctttgtagtagaaaaaattctgaaatatagaatagtatttaacttgttttattgtatcttttggaatataagaatactagagttacaagaatttggaaattcatcaaagtagaaaacaagattcaacttccctggtttcaaaaggaaagctaaatctgtattctctgaaagatctaggaaaaatacttggcctaaaatgaatagatcctgttcccaaatttctaggaatttacatattggggtgatggtgattgtgataccagttttctcaaaacacatttgcctcaacaaggaagatttcagcccacttttttggtaaagcaaacatatccattctgtaaatcaaatagtcaaaatttggattaaattgagccccatattacaatggcaactgggatactttttctaccatgcagtaactcaactcccaatgattgtgagagtgaatggaccctaaactaaatcataatctgtttacaaaatcccttctcaatgcagacaacagtacctcagatttgtcaatggcttcataagtttaggtgtttcttcatatattatttcatgtattcaccacaataattccacacggctaagagagcagatattattcagctcattttacaaaataggaaaactcataaatggagatagcctaagattttcctaatgtcaccatgtgggtatattacacaccacatttcatttcacagcccgtactctagaattagcagtgggttctcactggacttagtcaaagccagaagagcttgaagtgtggaatatgttagtgacaacattaaaacttgaggacctcacaatgtggtcaattgatttttgacaaaggttctcagacacttcagtgaaagaaagaatagtctttcaaaaaattgtgctgagacaactggctatccatataaagttagaagcctaccctcacaccatacacaaaactgacctcaaaatggctcatagacctaaatataaaatataaaacttatagaggaaaacagaacagtaagtctccatgaccttgggataggcaatggtttcttaggtacgacaacaaaagcacaagtaacaatagaaaagtagataaattaacttcattaaaatttaaaaatgttttgtgctttaaagggtatcataaagaaaatgcaaagataacccacaaaacaggaggcaatatttgcaaatcacatatttgataagggacttgtattctgaatatgtaaagaaataatacattctattaattaaaagacaatgacccaattacaaaaggagcaaaagatccgaatagtcatatctccaacatagatacacagatgtccagtaagttcacgaaaaagatggtcaacatcattagccatcaggaaaatgtaagtcaaaaccacaatgaaataccacttcacacccactaaaaataaaataaaattaaaaagacatacgataacaagcattaacaaggatgtggagaaattggaaccctcatgtatttctgatgggaatataaaataatgcagccactttgaacaatagcttggcagttccttaaaacattaaacacagttatgtgacccagcaattccacccctatatcaaagaaaaatgaatatatatgggcacacaaaaacttgtacatgaatgttcatatcaatattatttatagtgaacaaaaactagaaacatcagtgtgcatctattaaagaagagataaaaagtggcctgttcatacaatgaaatattatttggcatagaaaggaatgaagtactgataaatgctaccacacagatgaaccttgaaaacattatgctaagtgaaagaagccaaacaaaagattatgtattatttgattccatttatatgaaacgtccagaacaggcaaatccataaagagacagaaagtagactagtggttgcctcgggctggagctagggcaggtagggaaaatgtggagtgactgcacacattatgggtttcttttctgggcactgaaaatgttctaggcttagattgtgatgacgattgcacatgaaatcatctgtgaatacacgaaaacccacaaaactgcacattttaaatggacaaattttatgatatgtgaaatatattccaataaggcagttttaaaaaatcaattcctggccaggtgcagtggcacactcttgtaatcccagcagttttaagaggccaaggtaggaggaccacttgagcccgggagtttgagactagcctgggcaacatagcaagacctcgtctctacaaaaaaatacattttaaaaaaatttagccgggagtcatggcatatgcctgtagtcccagctactcaggagactgaagggggaggattgcttgagcctgagaggtcgaggatgcagtgagccgttatggcaccagtgcactccagcctgagtgatagagcaagagcaagaccctgtctcaaaaaaaatcaactcccttcctccctccccctcaaataaaacaatccttaggtcataattttgtgtctacacagtccttggaaaccaatccattacctgcatgttgagtgattactagtgataactacttgctccattacatttttgccctgtctcttcttggaaggtcattttccctatttatttattcaacaaatattttttgaatgcctattttgtgccagacatggcaccaggtgcttggaatagataccttatttaatacaacagctgaagatccctgcccatatggagcttacattctatcagatttaactcgtattctcaagtacaacttagctcttcgggtttattctagtagatacttttcaagtgtggggtctgtcaaagaaaaactagagctggacagtagttaaagctgtaaaaacattttattcaggactattgtaataaggggaaagagacctcagtatagaatgggactcaactcccaatgtcacgtggaccagtggggatttacagccaaggagcagggtgatgataagtggatggaaaattactaagaggaaacatcaggggtaagggagattctggttaaactgacctaaaaggattcttgctgaaggtaggccaagttgatcagacatcctctggggcatggtgaaggatgaagaacccaatcagatactgagagtgatcagatatggagatggaggattctggctaaaccaactcagcagggttcttgctaaaactggtttacaagaaagtgcgcagaagggcccaggagaaagttcaacactaaagtttggtcgagcaaagaagcttcgtcagtgctactttctagaaattttacttcctccatcataatgtgctcatgttatcaatatggtcccatccttttcataactcagttgtagtcagttattaaattcagtttgaggtcaaaaggaaacagaagaaatttactgagtgtaagtttcaagtaaatatgtcaatagctaaatttatttgagaaacctcaaggggagctagaaatgatgacataaaaataacaataagagaaatgaagcctaatgattatcctccttgaaatattagcctgagttccacatttgtacttctcagtcaatgcatttttaatttttctctttgttcattaaacaaatacttagcaaataactctgtctgctaaactgatgtaggacataatctcatggtttactgcaaatggccaatgactatcatcttctcaataagatgtcttgagtagtctctatgttatgtctgaacaatgatcaggaataaaattcaaggaatcctgggcctctggaaacaggacatggtttctgtgaacagccatcagtggatttttatcttgaactcatgaccctacttccagtttatctcattcatagagaatgaaattactccaattaaagccttccaaatcaaaaaggctagggactgggccatgtctcctccctgagatatgctagaataatcaatgccattgtcattctttgtaacattgcaacttctcctgtggctgtgttaaaataataaacctcatgcctgctatctccatctctcacagctgtggtttctgggtttctgtttgtgaataagcatttcagaattgccatgagatggaggaaatagcatgtgcagagtatttcccaggcctagttgccaagaatgagctaattgtaagcctcccttgaatgcaagtcacaaaaacttcaaatacaagccactctaatgatccacctttccacatgaatgttatgctttcgttgtagaaccttgatctttcagaagtatactaggagtataattttaaattatgtcataagattaataaactattgaaccatctttttgtgctttttatgttttatagtgattagatacaaaattgatgtttgtatttaagagaaatgtcaaatgtgatacaggcttgctacattgcttacggaaaatttgtctaaaagagattgatagtaatctgtcctccataaaagaataatattgattttttttaacttactttttttatgtttaacagggcaaatttgatactttttaaaaatataaaagtaggaattgcaaatatatttcacatgacacatcattttccaactaattggtaatggctatgtacatgttatgttaaagattctgcagctgagtctggcttagtagaaaagactgctgtcattggataataatgttttccaaggatgcaaattaggaagtggccatgtaagtcctatatttgcaatccttgcgtaatcggacaaagagttaacatttaaaatatcttttcagagattactagaaacatcctagtatacattaaaaatagcacttaactgaaaaacaaaggccaaattaacacttaccattgtacttatcctgtaggtcaatgcatcacgtcaagaagccaaattgacagaggagtgtgatcttctcattgagatcattcagcaaagacgacagattattggaaccaagatcaaagaagggaaggtatgatttctagggcagaagatttcatattctctacctggagaaaataaatcctaatacactccagggactttggaaatgttgagaaccctctttttctatacattctataattccctcttaagtctttaagacttagttaaaaggcctttgcttggcagttttttctccatccttttctttgtactatggtctcctgtgaagacctgtgatacaagggctgctccattgcccagcgccaggaggtagcataaaggtcttgtctatcatggccattgttttctatctcacttgtctatgagaaggtgggttctgtggaggcagagtttattttgtattcattgtgatatcctagaaactagcatagcattacataaattaaaaatgaatctgactttatttatagaaattatgaagtactttcccatgtttttgaggaaatgtatacaggtataacttcatggtcccaaaacccctggggtttcactatatcatatactcctttgtggatatagtaataatacttcttttctaatgttctaatgtttctatgttttaatttcctattgttttacagcaaactatatttttaagataaattgacatacattctttatagctgctttcttatttattcaaaattcattcacaaactgttggtcactttataatccatcagtttattctattttaaaattagtcatgtttttattgaaatacttatgatccttttaattttacccaattctctgccacattcagggataatttttctttcttttttcttcttctttttttttttttttttttttgagacagtctttatctgtcacccaggctggagtgcagtggcacgatcatggctcactgcaactgccgcctcccgggctcagacaatcctcctgccttagcctcctgagtagctgggactacaggcatgggccaccacacctggctaatttttatattttttgtagagacagggtttcaccatgttgtctaggctggtctcgaagtcctgggctcaagcaagtcacctgcctctgcctctgcctcctaaaatgctgggatgacaggcacgagctactatgcctggccaaggataatttttctatggatttttaaaaatagaagcgtttatttatgatccaataaattcatccatttctattattattgttcatagttgtactttaaaacaaaatatatataattaaaacatactagcaagttttaagtgaaacacagagataaccgtggctaatgtatgtggttttctgtgttttccacaaaatttaacaggtaccttctaatattgtacaatgttttagattactctgtctatatagattacaaaatatttatacacataaattattaaaatgatctaaaaaatagtgaaatcaaatagttattgatgctggtatagtagattaacagattaacatgaaattattccctggccaaggactcacatgtgccgaaaagctacttttccccacatacgaattgtccaatttagaagagcactgagtgtccatctggaatccttacaggatatatttcatcttccatcatcatcgtgcatcataggtgcacatctcttaattctggaagtattccaggttctcagacacatggccacctgaagtacagtcacaattaattattcatatgcatacagaaggtaatttgctatctttacatggttgcatgcagagattagctctcagtacacatattagtttattttcatttttaattttaaattgacaaacatttatatttatggagtgcaaagtgatgttataatttatggatgaaatatggaataactaaatcaagctaattaacatatccatcatctcaaagccttttcttgtggtgagaacatttgaaatttacttgcttagtgattttgaactgtataatacgttattatttatttgctgttttcaccatgccatgcaatagatctcaaagtaaaaaataaataaataaataatttttttgaaaaagcacttcctcttcctctctaattgaggttttgcaccttactcttactagtttcttattgctgcaataacaaattaccttaaacttggtggcttgagacaacatagatttattatctcagtgtgctgaaattcggaaatccaaaaatcgatctcactgggttaaacaaaatcgacagtcaaggttttggcagtgctgtttctttctggaagctttaggggaaaatccattttttcttgccttttctagctcttacaggtagcctgcattctttggctcatggtctctttgcatcaatctgacctctcttcccatcctcacgtcttctctgacacaggccttcctgcctttctcttataacgacccttgtgactacattgggattacctggataattcagggtaacatccccatctcgtgatccttaatcatgtctgtaaagtcccttttgccatgtgagtaacatattcaaagattcctgagattaggatgtgggcagcattgagagcccttattcagcctgcaagggcactccaccacaacttcctggctagcttgccttcccttctcttacttagcttggacttcccaccaccagggtttctctcatgagctagatcagagtagtgcaggtgtccccaagttccagccatagtgatgcatggagtttatgcttcggtgcactcgttctaccccaaatacatgtcagtaataaagaacttaataaaatgcaaaagcaaagacatatagctgaaccaaaaacaagataaacatctccacaggccagaaatgagacaaaactgaaaagccatgactgtggctgaggatacaggctactgggatttggtctggaagaggccaaagtagctttggctttagctcctgtggataaatagttcttgaagctttggggaaaggacctagaagtgctccagatgggatggggaatggaaatcaggctcattatttaatgccatgggctatagaaggcttcatgcttcagtcaaaaattattgccaacctttccctcatatcatagcttttagcaaagtcacattgttagcttgaagcctgtgttcacactgtttctgatacccacacagaacaggagcacagagataaggatgggattcctgaataatgacctcaagggccaggtgaaggcaactggaaaactatcagagcagggtaggctgagcaaggagggtgagagaggaaagaattataaattacttccctttaaaactgaaactctaagtttaatttcaaagtatataaagaaatcttaaatttctaaacatacagccagcaaaatcagcagacaacattatcttaccccagataaaattaattttataggaaaataagaaaaagactttaaaagaagtagtcttaagatgttcaaagaaagaaatgaaggaataacttctctttcaaaagagcaaaaaaagtgaagccacaaaagaaggaaatgaaataaaaaaatagataggaaagcaacaaattagcagttttggagggaaaaatatagatattgaaattagaaagaaaactcagctgcagtggaaatttggaaactgagttttggtcaccaccttgggaatgccataaaacgcattcttttacgtctgagtgacattaaagtttgacaaatgccgactgagtttgaactcaaaagataggaaagtatataggaaaacctacacatggggcatttttaaaataataatcatgcacttggttgaaagcaagtatttcagcaaatttcaaaaactgaataccatagaaccctgcctctaagaccacacactgtatctcattagatattatcaacaataaaataatagtttctatagttttttgacactaaaatctattcatatataaatatatcttcacagtaatattttttaaatgtagaagtaaaccacagtaaaagaactataatatatcataagtagtaagcagcaaaaaagtatctgaaggcaaacttacaggctttaattcttttgaaaaagaggctgggcatggtagctcacacctgtagtcccaacgctttgggaggccgaggcaggaggattgcttgagtccaggagttcaagaccagcctgggcaacacggcaagaccctgtccccccacccccaaaaaaggtaatactaaaagtaaaaaattagctttcaaataaagctagaaaaagcacaacaggataaacccagtgaaagcagaggaaagaaataaaggaagaaaagtaaatgaaagaaaaacaggaaacaaacaagaacagctgtcagcaaagaacaactcgcagcctaattttgaaacatctgtgaataaaaaaagtgccttttcccccatttttaaaaggttgttaaaaaaaataaagaaaaacaatatatgtgtgacagagacagtatgtggtcttcaaagcctaaaatattgactatctggtcctctacaggaaaagtttgccagcccttaatcaggaggagttttacttgtaaaaaataatttaaaagaccaatctgtagttaaggttgatgaaggaaaaaagagtgtggggccccataaacaaatataccataaatacagtagagacttttttaaacataagaaaattgtgtaaatgtcttcatgccaataatttgaaaacttacataaagaagtagcggaaaacctgaataaaccaaaaatttaaaagcagaagacatttaataagtcattgaaaatgtccatcaacttgcatttctgccccaaaatggcaccagcctcccacagttctatagcttactttaacagaagttccaggaactaataatctcattctcatataaactacttcagaaaatagaaaaaagacattttatgtagagtgtatgatcttgataccaaatacatacaacattaaaaaatctagagtgagagaatatcacccatgaatatagacacaaaaattttttttaatatgagaaaatgtaatccatcagtgttttattaaacacatcaaaatagcctttattcttataatacaaggatggctcaactacagaatatctgttaacagaaccacattaacagaaaacatacatatgatcccagagtaggagggatttttctttttagaccaaacaattttaaaaaaacaaccataaagcaaagactgaaacatctgacatagaataagatcacaatacaaaagccaatttcatttcaatatattagtaacaattgaaaattgaaatttaaaaaaagaaattccatttaaaacagcctcacaaatatgaaatacttagtgataaatctaacaaaagatgggtgagacttgaaagaccttgaaaactacaaaatattgctgagagaaattaaagacgactaaaaaatgaagccatgtatcatgttatggggtaaagactcagaaaagttatgatttctgttctttccacatcaacctgtagattcaacataatctcaatgaaaattccagcaggttattttgcagaaattgacaagccgattctaaagttcatattagaatgcaaaggatatagcataatcatttaaaactttgaaaaatagaccgggtgcggtggctcacacctataatcccagcactttgggaagccgaggcgggcggatcacgaggtcaggagatcgagaccatcctggctaacacggtgaaaccccgtctctactaaaaatacaaaaaataagccagacatggtggcaggagcctgtagtcccagctactcaggaggctgaggcaggagaatggcgtgaatccgggaggcggagtttgcagtgagccgagattgcgccactgcactccggcccgggcgacagagagagactctgtctcaaaaaaaaaaaaaaaaactttgaaaataataacaaagttggagaactaacatcagctgatttcaagatttattataaggcttcagaaatcaatataaggtggtatttgtataaagatagacaaatagatcaaaggatcagcaaaaagacttgagaagtagattcatacatatatggacaagtgattttcaacaaagatgcaaaggcaatttcagtggagaaaggattgtctttttagtaactggtgctggagcaattggatatctgtatgtaagaatatgaagtttgatccatacttcacattatatacaagactttactcaaaattgattatatatctaaatgtaaaaggtaaaagctgtaaaactcctagaagaaaacgtggaggagatcttgaccttgggttaggcaaagattctttacatacagatgacaaaagcattatccataaaagaaaatatttatatgttgggtttcatcaaaattaaaaacctcttcagaatgcactgttaagagactgaaaagaccaaccacaaactaggcgaaaatatttacaaattatttattttaataaaggattgtatccagaatatataacaaattctcaaaactcattaataagaaaacaagcctttcaccaaaatgcataaaagatttgaaaactttaccaaagaagaggtgtggatgatgtattacttagggttctctagagcgacagaactaataggatatatatatatagagagagaggagtttattaagtattaacttacacaatcacaaagtcccacaataggccgtctgcaagctagcagggagagccagtccgactctcaaaactgaagaacttggagtccgatgttcgagggcaggaagcatccagcatgggagaaagatgtagacggggaggctaagccagtcttgccttttcatgtttttctgcctgcttatattcgctggcagctgattagatggtgcccacccaattaagggtgggtctgccttccccagcccactgactcaagtgttaatgtcctttggcaacaccctcacagacacacccaggatcaatacttgcatccttcaatccaatcaagttggcactcagtattaaccatcacagatggtaaataagcacgtgaaaagatggttcagtatcattagtcattaatgaaatgcaaaataaatttcaatgagatactgcttcctacctactagaataattaaaattcaaaagatggcgcataccaagtgttggcaaaaatgtgaaggaaccagagcctctcacaaactgctggaggtgggaattaaagtagtacatgctggaaagctggcagtttcttaagtaagcatacacttaccatatgatccagccatttaggtatttaccaagagaaaggaaagctatgtccatacaaaacttgtaggtgagactggtcacggtggctcacacctgtaatcccagcactttgggaggccgaggcaggtggattgctttgagctcaggagtttgagaccagcctaggcaacatggtgaaaccctgtctctacaaaaaacacaaaaattagccaggtgttggtggctcactcctgtaatcccagctacacaggaggctgaggctggagaatcgcttgagcccaagaagcagaggttgcagtgagctgaaatgatgccactacactccagcccgggtgatagagtgagaccctatccaaaaaaaaaaaaaaaaaagacttgtaggtgaaatttcatgttaattttacttgtaatagccccaaactagaaatggcccaaagtccatcaacagatgaatgggtaaacaatttgtgtcataatcacacaatgaaatactctttggcaataaaaaggaataaactagttacactagttataatgcaacaacatggatggatctcagtataattaaggtgcgtgaaaggagtcagacagaaagtagtatattctgtatgagtagattcatatgaaattcgagaaacggcactttctactaatctacagtgacaaaaagcaaatcaatgattgcttttagggatgggatgacaggaaaggatgggcacagttaattacaaaggggcaggagtaaattgtggggcatgatatatatgtttattatcttgactgtggtgactgtttcatgggtgcatacatatttgaaaaagtgtcaaatttgcactttaagtatgtactgtttatgatatgtaaattctatctcaattcagctgtttattagacatataaattgtgtattatataatgaaaaagtcttcagaaattaaaattaatgaactagggtgatatgtattagcacggacaaatcacaaaaacagaagaaagttatataattatttgtacaagcattatataaaatttaataaactaccaaaaaatcccatacattgtttaggtatgtgtacataaacatgtttgggagtgatcagctctaaatttgagagggtcttttcttctggagagagacatgagtgagattataaagtgccacacagaggctttaatgctatcaataatattttaccaccaggtgtggtggctcatgcctataatcccagcactttgggaggccaaggcgagaggatcacttgagcccaggagtttgagaccagcctgggcaacatagtggttccccatcactacaaaaaataaaaataaaaataaaaattagccgggtgtagtggcatgtgcctgtgatctcagctagtcaggtggctgaggcaggaggattgcttgagcctggaaggtcaaagctgcagtgatccgtaatcatgctactacactccagcctgggtgacagagcaagaccctgtctcaaaaaaaaatcttttttacttccttttgaaaactctgaagctcatatgatgaaaatactgagatttagtaaacctggtactatgtacaggacagttcattatattcttaaattttttgtatgtatggaatgcttcactttttaaaaagtatacatttgctcagcaacattatctcagaaggcaatcttagaaagcagatgttacttgggaaagatgagggccgcactccttttctcttgagctagtactttggcacatgaccaaggactagttcattccaaaccctgaaactcacagtgactcaagtccctagccagggcatattgtgtcagaggcctgtttttaagaggaagggtgtgaatgccaacccgtggaaatctgaggtgccagacagggagggcaagtgtggacttggggttcactgggggacttgggtccctgcaccccaggatggcagtggcaactgagggcattgagtctaaagaacggatggtggggccttctgacaagcaattggaagtgggcaggtggagcaagaaccaggcagaattgtggagatcacaaaagtgagtttcatcaactgccttattttgcccctgtctatctctgacactagtcactcagctgtcaaactcacctcaaattctgcaattgacgaggtcaccaagcaggtgatattattacacgttagtacctactgatgattcctgctcttggaccattgtacattctctgaaacaaattaactcgacagcctttataggtgggcggactggagagtcttaagccatgaggctccctggaaaagaattttcttctttttttcagtagtcggggataagtttcatgtcaacacacaaagagctaaattcagattgagttcattcatttaatgttcagacacagagatctatggtagacttctgaaggccaaagctcaacaaaataagggtcccttttcttcactgccttttatgtacactaaatcttaaaagtttaagaaaattaacttggactaaatgttgagctctccatggccttaaagagatggtgagaacaggcctcattttcagttcagatacttgtgtgaattgaggatgcattgtttggacctaattgttttgggttgtgtatcctacatacatataaaaagatttatataaaaataagtgtttaaaacgcatttcaagcaaaataaagcggcttttaaaagaatgtgtaaggtataataaacagcaaataaaatgatataaacagccctgtgtccctgctaaaaggagattccagcaggcaaactatttccatgactagtagagagtaaattccaaaagttgcaatgtggtaatctcacttcccaaaggaaaaatgaagagttgactggaaaatatttcccttgcagcattaaggcagacacatacagaatctttttatgtgtcagtatctaatttttttaaacatcaaattttattcaccttgtcaacttttaaaaataatacattaaaaagtgttgtctaatagaaaactaagtacttcgctccatgctgggtgtctgagtttgaagtgctgtgacaagtaggacagtgtttcagagtgtgctgcaaatcagggccatctgactgtaatcatttaagccaggggttagccgacttttctgtcaagggccagataacaaatattttaggctttgccatacggtctctgttgcagcaactcacttctgcacaacattgtagcaagaaagcagccatagattatgtgtaaccaatgagtgtggtagtatgccaataaagctttatttacacaaacaggctgtatgctgatttggcccacagatcacagcctaggaacacctaacttagagcagtgtttttcttttttctttttttttttactgtaacccgcagtaagaaatatatatgacatcacaatacagcgtgcacgcatgcacacacacaaaaggttttacaaaacccaacttgccttttctaccaggaatgcactctgctatttgcttttctcctcttctatttggttttttaaaggctagtcctgactgtcctaatgattcatcacctgcaggcttaaaaacatttgttgcttgttgaaatggaaattcctcctgctctgcgaattacaactccttaactcaaatattggagcgtagacccaaacatctactgtttttctttcaaaatgatgcccagctgattcttttacactaggtttgcaaagctcaaatcagatgtatcagatgaaattgtacactaacctataactaaaattatgcccaaaattgttctctgtagaacattccgatattttcacaggcgactctcattttgtcttgctttaatttttgcatgatttagggctcttttattctttttcctgttatgtcacttttaatgttcaatatcatgatagaaaaagaaaagaagaaactggagttcaagcatcatcgcatttgaaatgtgtgtggtctttaataggcatatctaaaggataagtagttgtcatgaagttattctaaaggaatattttgaccttattttcttttgctggaattgtattaaacatctgcaattcggccatgtaatttaaatgattctttatgctgtgtgattaaatattccattcacttggtttgtcctgtggactgtaaattagttttccttctggaattttccttcctctgacagtttcttatgaacatgttctaatatcctgcgcgtactggatgccttccttagctttgcctccagatagaatgatgccagaggctaaattctatttggtgtaaaataagtgttattttattccactaatgaatacaattaatccactggggacagtaactataattataatgcattaagtcttttaccaggctcacgatcctatattatttgccctaaagttttgacacttcattctctgactctttcaggaatttttttcacccttgcctgaaatcttgtgcctgctgcttctaattcagtatgaatttcctttgtttgcttatagtacatacttggaattggatgttccttagaggcctcaagttctgacatctctttccttccttttcttagattagagttatacagggatggtaatgacgacttggagaaagaaagaatttcttggaattagcaggaattctggagagagccttgggccagccttgtctgtaagacagattgactggtctcctccgtaccctttcacccagggctattttccattccagaattatcataaagccggttgaaacctgtccctgggtgtgtggttgggggcagtaggcacacagcaattccaattagctgtctaattttaacttggcttctggctagaggacttcatctcacagcacatttcaaacacaagagcgaacggtcaagtgggttaccttggacttatcttggcctgccccggaggttatggtcaattatgtttgagggacattttcaagcgagacagaatcaggaattggaatggaggttgtgaagcaatcatgcgtttttatcccaactgggaaatgcttatcaaaatagttcctagttatcaagtaagcacaaagtgcctggaaatgacgttcccagtgaggggaaatggcccagctgtgctttttttggctttctctcatctgctcaacaggaaaaatattaatcaatgggaaaaatgctccctttctgttaatttaacacatgagttttaggtagtgtgggaaatagtaacacttaatgctttccattctcgattttattacatgaattacaaaaaacactttttagaaaatggttttcatttaaaccatagattcaccacctataaagatgttttatcttcttgatgaaaagaagataaacctgagatagagaaagttccagggttccctacagtcttgcagtcattgtgtggaatagtccagggaagacgtctggtgaccctttgtaagttgccactgggcaacacctttttttcccatcaacagggaagcaattcacaattcagtgtttcctcgtaaaacgaattagcaatgcttctccaatgagataaggaatatctaaaccagagtcccataacggagctttccatattttgatatatctctatgcctactttttgaacttttatggaaggataacacaacaaaatgaaggatccagcctgatgccttttcattaagcaagaccacccatgtaaccatctctctccatgcctcttttgttcaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagaggtgagtgcaggggcccctgggaatttctcggctgctgggctcttgtatctgcgctgtgattggttggtcttgccctcgccttgcttttattttcattttcaaggctcagtaccagagagaatagaggctttgagctgttttgttccagctaaagatgcttccttttgacatgtgaaagccctttcagtaacagcctggagtctggagttcaaggcctttgaaacaagagtccaccagttagaaagaataaaatcaacctgcttttggacgaggggggagcttatgatggcacaaaaacagcatttattgtgactctcagatgtgatgttatcgtacacttgataacaaagagtcaaaatgaaggcaaaaacattaaagggaatattttcttccatcacagggctcatctatttttttttaaaatcacacaggtgttgttctctgttaggcccattttcatttggttgaggagcttggcctcacctgaaaaggtcaaggccaactcacgcaggagagaaaggaccaaactgtcaacctcatacgggcttcttttaaaatactctttattctcaggtagggagctttaatgtgatgttatctgaatggttggctcagcagtaaaactggcaaagataagtattttttcggcacacatacttggttggtataaaaattgctcatcttcactgacacaaacacctatagcaattctagtggatccaaagaaaagcactagccgggcacggtggctcacgcctgtaatcccagcactttgggaggccaaggcgggtggatcacctgaggtcaggagttcgagaccagcctgactaacatggtgaaacctggtccctgctaaaaaaaaaaatacaaaaattagctaggcgtggtggcaggcgcctgtaatcccagctacttgggaggctgaggcaggagaattgcttgaacctgggaggcggaggttgcagtgagccgagatcgtgccactgcacttcagcctgggcaacagagcgagactctttctccaaaaaaaataaataaatgaaaaaacaaagagaagcactaggctgggccaggtacagccaatgccacataaatgacatctctaactcaggctaatggccttgacttcattcattctaattttcagagtcaactgccctttatccaaagcaataatagaatcctatctctagaagaccccagagagctcatgcatgctgatcttcatcctagagcagagatcagcagactttttctataaaggatcatcaagtaaatatttttccgctttgcaggttgtaaggtcttggtcacagctactcaactctgccattgtagctagctctaaagcggccatagataatatagaaacaaatgggtgtggctgtgtgccaataaaaccattacaaaaacaggcagtagaccatactttgccaacccctggcctaggaaaaaaaatactcgccatcttatgactcaaatttattcaaagaaagagaaaggaaactaacatttattgagtgcttgcttgtttcggaaacttgtgctaattctcaaaatatcgcatagaggaggagtgattgacatctccattttcactcttcttaaagagtaatgtatcgtgtttttacaactctggtctactgtccaatcggcttgactgtattatttcttatatttgaggaaaattccttttgtagctgattagatacttatctcttctaaaaggcatggataacagctggctatcatccctgttatgtacttaagatgctctcctccttactctgagaggcccatttctttcctcctgattccttggttccaaatgtttattttccctgggccatatccagttgctcaatattcaccctaaagttaaaaactgcaaatagcactaatactccagtgtacctaggacactaatagatagcgtttacacttaggtcacggtttccaaccggaatccaggagtacttttctccatctatgaactttgagatgtccagatgaaatggctattatgaactgcattcctcatcaatccctgaagattcaaccaagtgtcacatgaataaattcttacctagtgaccagggatgatgtgaccccataacagttattgctgaaagaagatatgcatctgaagtatagcacaggtgtgggaatgcccacatacaatctccctcagttccagtgggacgtatctgctcccattcagctctctctataacaagcccaactcatcaagagcaggaacatgactttgatttctctttctacaaagaatgtgcttctgtcaagtttgaattcacagagcctgtaaaaatttgccaagagccttgtctctgtttctgcagtcccctctcctcccatcactatttgtcaatcctcttggctaattcctgagcctttctatccttccagcagctaggatatagaaaaaggacactgggcttagactagaagttggcagacctgggttccagtcctagcactgccactttttaactatgggtctttgagctattttctacttagaaaattgggttcaggaacagtttggaggttcctcaaaaatccaaaaattaagctatcatataatccagcaatcctactgctaggtacatacccaaaagaaacgaaatcagtatatagaagagatatcctcactcctgtgtttgctgcagcacttttacaatagctaagatttggaagcaacctaagtgtccatcaacagatgaatgaataaagaaaatgtggtacatatatacaatggagtactagtcaaccataaaaaaggatgagatctagttatttgcaacaacatggatggaactgcagatcattaagtgaactaagccaggcacagaaagacaaacattgcatgctgtcacttatttgtggaatctaaaaatcaaaacgattgaactcacggacatagagagtagaaggatggttaccagaggctgggaagtatagtagggagttgtgggagtgggggtgggtagggatggttaatgggaaaaaagaaagaatgaataagacctactatttggtagcacaatagggtgactatagtcaataataacttaatcgtatgtttaaaaaaaaacttaaaaatgtaactggattgtttgtaacccaaaggataaatgcttgaggggattgataacttattctctgtgatgtgcttatttcacattgcatgcctgtatcaaaatatctcatgtactccataaatataaacacctactatatacccacaaaagaattgtttttactaataaaaaaattatttaaaaaaattggtttcagaatagctgtcactgttgtgatgacattgctttaagttcctaagaacaggtcattagcattatagctactccatgagtgttagttggatctctgttttcacgtttcaacatgtcagtctagcccgccttgtgtgtcttttttccaatgctactctctgtctacctgcccctattcatcaacctgtcacttaacattcttctctaggacatgacttcttttttctgtctcctattgtgcctgccttgggctttggctcctgtatacttccaaacaatctttattcttcaattcaggtgtggagcccagaacaaacttttaatcccgcaggcattcttgaagtgagacttagatgagattttctgcatcgttaagcgacttaaagtggatatgtcctcctacaagctgaatcaaaactgtaaatttttctttcatttcagaaacatcaaacaactccaaaaggggagagagcctcaagctttacattgtaggagatgcttttgctttggaaccggttgtttggctctgtgctaattgcttagtaattatagatagcattgaggctgctcattaacattggctaattttgctcatatactccaagtaggcaggtaccctagccaccttgtttttaccattatagccccagcacattgcgagctgcctgacatgagtgaatgagtgaatgaatgaatggatccataaatctgtaagacgggactaattattcctacctaagatggttattgtggggataaaatgcaataatgtagtaaaaacattagcctagtttctgtcacaagatgaacatgcaacaaatactagttctcttccttcccactcactagatgaatgcaaatgtataatgtactatattctcaagctacactagtagataggtctttggtgtgattgtatatgcacctttatagcattattttaaataagcaaagctattcactaagtccaggcataagaaagttggtctgcttatgaagaatctagaattaaaatcccttatagcagtaacttatctgtatcaagaaggtgataaaaagaaacttccctctgaatagtacctattgttcaaagcacctaggaggttctcagactcctcaaggtgatccttctgttcctcactacaataggcagttcaaggatcttttccagaatacaaagccaagaactccagttgtcaattctgaaaagatgttgcttggttcaaagaattagagcatatctgatcagtggttttggaagtgtgtctgcagggtgttcataggcattaagataactgcacgttttcaaggccaaatgtgtttgggaattcctgggctgaccaaagtaaacctatcttgttactgtgaggcctcactgggttttactttggtgatgcacattgtttggcagaagccttgtgagcagcatagctccagacacgtccaccttctggaaaactggccccatgtgtcccagacatggctgtaaagcaagaagttgagaaagtggcatagcgctaacagccctagtggatttggcaacttatccaaaaggccagaagatgggcaataaggatttgggaaataaaaacatggcctaaaatgttgaatttggcagatttccccttgcctgtcactccaattaggaatttgaagttgtagccaaagataagtatctttccttccatcaaaaaacaaatgtgtaggtgttaaaagctgcagtaatctccactgattcttgctgtcagcctttacctcccaggctaggaactttgatccttttggttcccatgtaacaaagttcctaccatcaagatggtagacattattaacagtgtcactcaatttaaaatgttttatttaattgtttgtagaccatggaaccaggagaaacttgggaacaaaatctattttggatgagactgaataaagaggtttctgccagtgggcagggaaactgctaaagccagggaaatgcaattgcaagtttggtgcttgtttcccagtagctcagaacagttctccctgccagacattatgatggagaattaattggcgtttcactttgcgatatcttttaagggttcaaatggcaccttagcatttcttttaacttttctgcatcgaatgcatatattctgggctctttggtgtgtagcatagtttaagggcttcataaatatttgttgagaataatcctaggacctctatgaagtttaaggactttttgtgttcatgggtcataaggaaagcatttttaaagtataacttgaccatcaatcaaaaatgcctagcaaccatctccgtatccatcagtctaaattagcagctgttggtaacaataattagcccaattccccagggtgcaatatttagtcaacaaaagcactcaactctgctattcactacttcttggtgaaagggtcaggagatgcagttagattctctaccctcattcagacacttgaaactcgtttccagagcttagacctcttcacttgcatctctcaatcccagtatcattacatttatgacattgttgattaggctctctccttccctcctgtacaacactgaaaatctgccagaaatacaactatagaaactgtatttctatgaattttgagcattttacaggtatattcttttttagatgggtgaaatttacacaacataaaattaaccattttaaggctgggtgtggtggctcatacctgtaatcccagcactttgggaggccaaggcctcccaaagggtgatcgcttgggcccaggagttcaagaccaacctgggcaacatagtgagactctgcttctgaatgcacgattcagtggcatttaggacattcacattgttgtgtagccaccacctctatcaagttccaaaacacttccatcataccaaaagtaagccttatactcattaagcagttactccccatctcccctcccctcttagcccctagcaaccaccaatctactccctgtctttatgaatttttgccttttttggacatttcatacaaatggatcatacaatatgtggcctttttgatggcttctttcacagagcataatgtttttaggctttatccacatcgtagcgtgtgtcagtgtttcatccctttttatggctgaataatatcctgttgtatagatatatacccacagatgtaatttttagagccaagatatattacatttgtaaatccaaagctttaagagccattaagagactcaaaaggacatataacccttggagtaactggcctgaaatttttctagatgaaacagaagagtacagatctgaaattctcctccttgctgctgccagctagctttgtggccttgtataaatgagcatcaattttcttaattagaaaataagtaactagatttagtactaaattgtttcaaggttgtttctttgctcaaaaattcccagcatcctacgcaatactccgcatataatagctcttaagagtgttgtttatggaacttaacaaaataccaaactcaacaagattactagtccagcatcatttgatatgctcagaaatggtatgcttcatgccacaattctcttgtttttaagagaagcacttgcatttttgaatcaaagtgttcattattaataactgaaccttccaaatgaacctgagagtacatagaaggagattgagacacaccagtgccttgctttttagtttatacatgagaactctaaccagaaaacctaaatgaagaagagaaatagtgcatccactggggggatttgtgagaaagctcatgaatattttccacagcatctgctgggaatatggtgcaagaaaatgaatacaaagagaaagaaaatgagccagacaaaaaactccctttttaatgtttattttagagagaggctagtaattgattaaactaatccaatatctggaaacattcttttttaatattcactttgccttttatgcagtttgaaattttggagactctcctttgaagtggatcagggttgcgtctgaaaggaacaaacagtttcccagacagatgtgtgaagaaatgcctagagctacgcgcttcttgctggggttagacgtgaccgggccagactgttaaatacacagcaacatgaaatatgaatattcttttgctttcgcagggaattttttttcctgatagtaaaaaggaagagggcaagccattttgttgttttctccaattccttcacttttttttaaagcttgcattcatttgttttatgttactgtgttgtgacattttgagatgcctcttaaaactcatgtgtaaaaaagcactttttaagagatatttattttccttttctttttcatttctatgcagtgatgttgaaagtcatcttgacatttctgaaacattgttttgtttgcattacagagtctccatggcaactgcatcctcccaggttctaattcctgaaatcaacctcaatgacacatttgacacctttgccttagatttttcccgagagaagaaactgctagaatgtctggattaccttacaggtattgtcttttatgttctctttaatattgtgcacacttagtgatataaacactttgccaccagatcagttattccccaataaccagaggaatgggcttttgacctaggaatggcactgatatttccataaacaatttctgtgcattgccctttgttttttcatcaaaacaacacagcccattactaaactggggacaggagaaaaaggagaatctcaaccattaaaagcatacttaccactgtttccctcactctcaaggtgtgggtgctaaaaatagtatctctctgtggtatttttcatatcatagtagtaagcaactcacaatacattggcagagaaaaaattggcagctaactgattggttgtctgtactgcttcatctccttgtatttgtgatcttgttttaatttgcacaacatcgagttgaggtaaagcattataatccccattttgcaaatgacagagatcagccgtcttgctggaaatcaggtaactagggaatgacagaattagaatttggctgggacctgtacaaactccaaaaacttctgctctttctagtaaaagactgaattttatcttggcaaatgtcaccatggcaaaggtcacaaatttacattggaattcctagtgctgtgtttcagtgtgcttcctggttggtgttttgttttgttttgtttctcccttggttgagcttaaaaaacaaaaacaacaacaaaacaacaaaaacctcaggccactcctattcctaagcatgcttctaaacttttctttgctgtcaacttctaaagtaggaactgagaatattcactggtagaacctggactgtttagacaaccttattcgtgttagccaaagccaccagtgcctgcgacttcaggaaagcacaatgtacacagtgaagccagatgtgcgctgcacttaagacatacagccttcaagagaccacgtctctaacttagcgtgacatgagcttctcaattccaattctgtgtgtacatgtttgtgagaaagcgattgaacaaggtggagcaggagaaagggaacattgtgtgatgtttgtttttacagtctgtggatagaaggccaggggttctatattcagggagcattgtacccagaagatgagcattttttctttgcgaggacccaatgtgccgtttttagcctttctgcattgtcaagcaaggcaggcaggcattccacaaacttcttatcttatgtaactctctctttcaaacataccactcctattaaggaagaaagaaattgactaaaaaagcatttaccgtatggaactaaacttggtttcaaatatttgtgtacataatgccctcctatttaagcttttaactctgagatttatttaaactgacactatccaataaaactttctatgatgatagatatgttctatatctgtactatccagcgttagctgcctcccacatggggctattgaaaacttgaaatgtggctagtgaatttttacttttatttaacttcaactaaatttaattgaaatttaaaccaccacatgtagctcgtggctattgtattgaacagtgcaggtctagactttctccagctaagctgtttttcacagtggcatcctgttaaaaatctcctttttcttatatcatttgcgaatgagtttagttgcaagcaacaaaaaatccaactagcagtgaataaaaccatcaaggagtgtttgtattacagtcacagaagagaagcctgtgttccagggctgggcagtggttcagtgacgacctcagaccccaggctctttcttttttcctcctctgccgccttcattgtgttgcctttttgccacatgatcacaacatgactactccacctccaagtgttgtgctcaagctctaggcaaaaagaaaggggtggaggggaaacgatggacaaaatgctctgccagtgaagtttgtttatcagaaaaacaaaaagcttgatcagaagacccgcctagcaaacttccacttatgtctggtgggctgtatctgtgttacaaggtcatgtccagggacagaaaagactggaaaattaagtatttgcctaggcacatggccattctgcccagaatcagtcttattgacaagaatgtgcccttgccatttcccaataattatttcatagtatttcaacaacatatacccattttaatctctataggaatgcaaaagtattgattaaaggggaaattgtgaaagtagtttagactgaattgtaacatacaccatatttcatcccgatggctgtttatttcaaactaaaggccatatggggtacctgctattatgtcttctgagctgtcaaccccaaatacaaattcagtccatttctagacataacatcgatcctgaccataacatatgatgcttggctgatactgccaagtccaaatagtttatgacatttgtaagcaggaaatgaagtctttgtggagtattagcccaccattccttgggtggtgtttgtgacagagacaagaaaataacacttctggtactgattccatgagtattgaaattggcagcatgctgctgttctcatttacactaaattgagtattgacttctcaggacaaactcattgggtttacagtcaaaataaggttagcctgtctcattgtaaaaacaagattttttttttcctatgacatgcctctaagtggtatatcaagttaataacccatagaggtgacatttccttcctgattatggctactaccatgtgtctcacagctacttgcctattttgaacatacgttttctttctatttaattgtatattgcaatacagaacaaaatttttctacaatggttgatggagaaataattcaatgaactgtttaaattgtgagagagtaagtatttcttcactggtccatgcaggagtgatcccacaccaacagggaccacacagacaataataagcacattttacgatgcagctggacctcctccgtggaatgcatatcctgattggtgtcactgattcatgcacatccaagtcataccacatgacactaaatctcacatgtgaatacttcaggagacagatgtacaaatacatattccagaaagaatgctttaaaggttatgtagaacccttctgtcttaatgcacaatttaatgccatgcctgtcacgttggaggtgctcaacaatgtttctggaattcagaaccaatagataaagctaagctaattgacttaataccgtagacttgcttctgtgatacttgtcctagaggtatattcaaaaagcaaagtgaagactactaacgcagagtttaaatttacagtttttataaacttttcttcctctttgggtttgcttaggactcatcaattctaatcataatttagagcaggaaataactctgaaatagtacaagcaaaggttgctcctagtttgtagagtgcaggtatgtttctccttttgaagtgagattctagtgggtagaagagtggaagtaaaggccctggatcaattctctaaaccagaggtcagcaaactttgactgcaaaccaccagatagtagacactttaggctttgcagtccatatggccacaactactcaactttgctgttgctccaaagcagccatagacaatacataaatgaatgaatctggctgtgttccaataaaactttatttacaaaaacaggcagtgggccagacttggcccacagtcacagtttgccaacccctccctctaaaatattatttacaatgcaaagcactcattttctcatattttccttgctcacatactcttctcataaaaccagttactgaaatcaattcagtagaagtcattttaaactcattattttggtaggacttagacttctctgctccagaatgtgttaaagaaataaaacagcagccttctacaatgataaattaaccaaatgccaaaaaaaagttttttccttggggaaggaaaatgtaccttttagatatgattgactatgaatcatggtcttctgaatttgaaatatcgcatgagttgagaaatgagaagaaaatagggctggactagtaagttcttttttttatgtaagtcatcgaaacatctaatgaaagaaaaattcaaacaattatgtggctgattttttgtaggataacaaacataagtattttttcaattgggtgcctaaagatataagtatctggcaccacgtattaataggtcaggggttggtgaactttgggttacagcccaaatctgaccctctacctatatttgtaaataaagttttattggaacctggccatgcccacatgtataagttgtgactgttttcatgctacaatggcagagttgactagttgcaacagagactgtatggcccacaaagctggaaacatttaccatcaaggcctttactgaaaaagttagccaacctcccaaagtgaatgcagctatgaaactttatcttgtttactttttatttgacaagttttccttcatgcacaagaaagtattatttgtttaacctcccaaacatattctcatgatctcatgataaacacagaaagtccatactggctgactctagtcacactccttattaaaaacaaaagcaataaccagccaatcagatattctttagattggggtcaccatctctaggatagtagtcctgatggacctattgagaaggacctgcttaactgtcaaacatctcctctgaaatggtatcccagttgtgtgtgcttttccactgataagcattcttgacccccacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtgagtatctcatggcctatttatttctgtctttggtggctttcttcagattgattgcattcctgaatttaaacttcaaaggaagacaaggaaggaaagaacacacaatatttattgacttgtctttcttgaacaaaaaagtgatagcactcacttgtactacattagtaaaaacagctggctaaatattgatgaaaattaatgacctctagcaaaccacatggatgttaagggaaagaagccagaaacaaatatatagagagaaacaaatatatagagagatacatagagagagaaacaaatatatatatatagtattaatccacatataggttcataacttaaagatcaaaataaactattttgcttaaagaaacattcataggtgttaaaactataaaccctgggcaacctggtgaaaccccatctctacaaaaaatacaaaaaaaatacaaaaattagcggggtgtggtgacacacacctgtagtcccaactactcaggaggctgaggcaggaggatggcttgagcccaagaagcagaggttgcagtgggcagagatcacactacagtactccagccggggcaacagtgagaatgctgtctcaaaaaaataaaaataaaaagtcaggatgatggctacctccaggattaaagggcaagtggcaccactggaaagaaatatacaggggttcttggggttaatggcaatttctaggtgaaagttacatgctttagtcattttatcatacatttagttttatgtactttcctgagtgttacttcacatattttaaaagaaaggatttaataaaataaatagccaaagaaagttaaatacctggtcccattcagaggagagagctgggcccatcacttaaaatgttagtaactggccccacccgggaagaatttccaaccttacctgaaacattagaggtgccccctctcactgaggcctatttgatatctggcatcagagataacttggtgatttcaaatagcagtagtagcaggccacagagatgataacagaggaagcagtcctccaacccacagagttatttaaattgaactgggcaaatggcaatggaccagaagacatggcttttcacgggagcaagcttgaaacttctttaacaaagaaaaatacaatatgtcaaaatagaacagaatagaatagcagtcatgtttcaacaaagagatgttttgaataaattcatatcaatttaatgtgcttttattatataaaccttttctctcttaactacaaactgctctttcctagcacaagtaattctgagtcatacgatgcttaacatagaaatttgatttaggattaattaaaagagtgatgcagaaatacaccaagttctaagggactaaagtataaatgacccataccaacaaatggctccccctaccttccttatatccactctccccaacttctccaacttcctctcctcaactccctcaccttctaccctataattggcctgccgtggaagcttttattaaaatcttgccatttaccaagaatgtgtaatttttaaatgaaagtggagaaagtcatgcaatgtcaagaacagctctggcaagctgcctgagtcagtagggaatatagaaaggtcagaaatggtgagtgggacaaaaatgtcttgggggaagttgtggttaaactaagtcttgaaaaaaagcgggtgcattttagcaagttaaggctgtaccggacagctatgtcatcataagcaaatctatcaagatgtaacgtagcagggcatagtgggaggtcttgcctaattaagcctggctggtaagtgaggaaagggagacagtgagaaatgaagatagagaaatagaaccagggctcaaacctatattggcctagctccaaaaagcacatgttcttaatccttaatcctcagtcacctaatcctaattcacaggcaagagctagattgcagagggctacccaggccataccatgtttggattttaccctgtgggcttgagagtcatgcaggacagtaatgtaatcagaggtataactagaaggtgactcaggagcactgtggagagtggagaggaacagggcaggaccagaagcagagacatcagctgggaagtttcgtagtaattcactgaggcagaaatagccaggacctgcaaatggcaccagcatcagagatggaaaggaaaagataattccaggaagacttctctgcgtctggcccattttcctgggaaaaaatcatcagtgtcctcagatatttgaagtgctttttggggcaagtcgcagaaggcctgtatagcaatggtttagtaacattttgctcaccttctaggattttgaattcttctggtatcattcctcatttctgactctatatgccctactgcaaatcataaagaaatactaattctctaaaatatttttctacatgtgcatatcatacacaatgctttaccttgtttttttcaataaatattatgtctgagatatcattccatttcagcacaaataaagaactgcctcattcctttttgaggcagtatcatatcctattttaaagatatgctctaatttatttatcccatcttctatagatgtttatttagcttgtttccaatctttggcccttacaaacaatgccccagtatccccaaggatgttcaagatatccttgaatatctctccttccacacacggggaattatatctgtagtataatctcttgaggtgcaatttctaggaaaagattatttgcatttaattttacttgacattgccaaattgcccttcagagagatgacatgatttttaaatgcatttttccagctgtatgagcttattgtatttcactgatcttggctacatataccataaacttaacgtggaattaaagtctagtaaaattttaaaccttgattgtgcttcaccataaacctgaaacacaagttaatctatgatcactaatatcatactaaatagtcactccttcatataagcagtgattctcaacaagggcagttttgccccctaagggacatttgacaatgtctctagagacttttggttctcaaaacctaggaggagggtgctattggcatctagtgggtagaagtgaggaaagatgggaaatctcccacaatgcacaagaaatcccccaacaacagagaactatctggcccaaaatgtcagtaatgtcgaagttgagaaaccctaatttaaaacaaggtaaatgtataatatctacatgattacatgctaaatactgagaccataacacactgatccacacacactactatactatgtagcatggaaggaaaaacacaacaaaaaggggggaatataattaatgtattttgtcttcacttaaggaattgttttctcaatattttgtgattaatatcactagcatatttgggataaactgaaccagggattgtatcaaacttgaagaagatgaaattcaaaagatgatcagaaattccaaggtaagagaaaagaagcacgtgaaggtctgagaagagcaggtagaaaatggagagatgattcattgtaaaacaccaaggaaggttctctgaaaatacatagaggactgatagaaccaacgtctgttgatgagtgaatagtctaaccggaaaaagaaaacatttggagtcattttataccaaaagagtggttcttggcccatgtgagaaatgctatatttctctcaaatcattttcgtctgattcaggaaaagtgctaacagttttctattgctgtgaaacaaatttccaaaaacttagcagtttaaaacaatacccacttattatttcagtttccatgggttaggattctggcatagttgagctgggtcttcttcttagggtgtcacagtctgaaattaaggtgttggctgggctgcattcatctggagactcaactaaggaagaatctacttcttagctccctccatttgttgacaaatttgtttcattgtggttgtggaattcatggcagcttgcttcgtcaaggccagcaagggagagagtctgctacttcaaatctgtcacctccaaacctgtctttaaaggactcacttgactaggtcagactcacccagaataatctgccatttgattagctccaaatcaaataattagggaccttaattatatctgtaaactcccttcgccttcgcctttgtcatataatgtaatataaaaacaggagtaataaaagtgatagacctttgtcctttgccatattctgttggttagaagcagatgacaggtcctgtttacactaaggagataatattacacagttatgaataccagggagttggaatcctggggaccatcctagggcatgtcttcctcagatggttatgtctctcctgaaatttcttttggttttcttttattctttcatatatgtatgtgtgtgtgtgtgtgtgtgtgtgtgtgtgtgtgtgtgtgtgtgtgtatatatatatatatatatatatatataaaatttcagacagtcttgctctgctgcccaggctggagtgcagtgtcatgatctcggctcactacaacctccacccccagagttcaaatgattctcctgcctcagcctcctgagtagctgggattacaaacatgtgctaccacgcctggctaatttttgtatttttagtagagatgggatttcgccatgttggccaggctggtctcaactcctggcctcaagtgatccacccaccttggcctcccaaagtgttgggattacaggcatgagccactgcacccagccctctcctgaaatttcttaaatcaaatcgtcatggacactttgggagtacatgtagccttggccttgactgatgggctctgtatccgttggcttttgctgaatagccaacaaccacagggcctaagtagaattcatattgcttatgcatctggagtcaactgagtgtcaactaggaagccctgctgatcttggctccctcacatggcagactgataactgtggcaacccgactgctgcacatctgtctcatcctcctacaatccagctcaagtctgctctcaccctgattgcagagatgaaggagtaaaggcaggaccaattacacacattctttttaagcccctgtctgtgtcacattagctaacatgaggtttgtcaaagacgtcccctgggtgagcccagagtgagaatgcaaagacctgcaaaattacaaggaaggagcaaggaattggggccaaaaggccctaactcaataccagagcttcacctcatccccaaaatgaaaggaagatatttattgcttgaaacttagggtttctcacttggctaaactgtgaccaacttgatttctgtgctatttgcatcgaaaataataccaaacatgatgcattaatagaatagatgatgcaaaaaggtcatgcataaaaaaactcaacaagagcaaaaccactcagtataatgaactcagaactttatgttgggtgattccagagatgttttgttcccagaaaccagttgccataagaaaagaaatgcaaatggcttagtgaagattatcagcctttaacgcatagatgccagaaaggcccattctcccaggatggaagaaaaacagtgaaactgctggtgctgaccaaactgggatactctcaccgggttgtttgtatcaggatgtgttcctcccttgatgcccattaaaccagaatagtgaagtcctaatgcctacaggatccatttgcgacaaagaaagaattcattcagataaaaagctaaccgataggcaaagattttcaaattattttcttcttaaatatttttcacatttgtagtgaccaaaggagacctggatttcaatcttgactttggacctcactagctctgcagtcttgagcaaattatttaatgtcctccgaatccgtttcctcatctgtaagaagggatagtgttttaacttcacatggttgagataataatagtaaacaccttagtcttgtgtttgccacagtggtagcacatagatattcaaagttattattcctacaaaaatacggactgtactcaccccataattgcattttaaaagaaagaccagttttgcaattttccaggattatctacatgatagctttttacacaatcagtatgtgaaaggctttccttgaatgatgttaaataatctgtcctattatttggagaagtatcctttgcagatgttgtattgcgtgacaaggtctaatggtaaaactctactgaaaatgagaagatataatgctcaaaacctggctgtagctccttatatcactagaaaatcttttactgtctctaggtcatggttccttcactcatcctaataaattgtagttaattgccttcaactggcgttagtgaaggagacttagataatatctatggagctttttcaatcttacgaaaaggccctcactaatgaaatacatacattcaaatgcaaaagtaatgacattaatttttattttttatttttgttaatagagttatgactatagatgttaatgaattgcttatcaataactagatatttatttaattttacaacgtttgccacgttttctctaaaactacttttgatgcttcattttaagtcttaaattgggtcctttccccagcagcctattcttattcttagcagaaatcaaaagctgcatttttttcaagccttaatggctaagtagttatctgtttttaatttattgtagtcacttagaaaacattcatgaaaattattaaacatatactatttttacagaggagaaggaaaggaatgttcacttctgtccagtctgttggaagagacaaaggatgttagaaaccagtgtgcagcctctcctaagactgtccacatcatgtgacatttttacacataattttttgtggcaagatgacagttgccatacaaggctctgaaatcccagatgtaattaagatcttataatgagccacattatgtagggaaatgcttctaacccattgtgaatgaaaaaaaaaatgtataaaatcaaaaaactcaattaattaggtttcattgtggacaaattattttccaagctccgttgttattttaaactgagtcggaggaggtgaatgttggaacaccctcaaagatgactgaaaatgagtttggagaaaagtgaagtttcaatcaggatggttgtgtgggtgtttcataaagagatgaataaagcctggtcaagagtcctaacacagtggggtgtcaaggcagagaagtcttgcttaagcaaactcagtgccatatgcaagaagttaggtggtgctggcgtaagaccaacaccggtaatggtgcactccaagtcaccccacttactccagcccccagaagaaaattgtcaatgttgctttcctggcatttttaatcaacttctcaattattatcttggcaataataataacataaaggtaaacctaaacagtaatagtgtttgttagtattcatgaaagtagattgtcccagtataaagctaaccaatgaaattttactacttcataaacattttgttcttttaattttcaaggaaaaaatagggacctcttcaaaataatcaggatagtcagagtccctttttgtttggaaaaggtttctgaaacataaaatctttgttgggttaagactttggattttaggccaagttacagttttcagcaatttcagacatctgctttatgatgttactgaaagcgttcccccaccacattaaacccagcttttgggttgtacagtgatgtaaagtttattgaaacatttttacacttgctttctttgaccacaatagtcatttttttgtaacatattcaattaaacaggaacagtataaaggcagtgaaattgatacgattctcatttgaatctactgaatgccttaattgttctcattcgtggctgactgccattgacaaagatctaggaatatgagtacactatcctacataatagaaaagctaattttttgttttattactactgtaataatattaagtacctaaagagagttataggcctcttggggcccagaactcagagttcaaaatgacccttctttgattggatcaaaatctaatatttggctgtggcattatccagaagtatggagtttattatagctatgttcaaggaaaaggtaaggtgaaggaagatcagaagggatatatagtaaggagattcccatgttactaaactatttgtggatgttttcctgcatcatatgcaaatgagaattggtaggaaaacagagggctaagaattagagaaaataaatttggggaggagggatggattgtgcctcttattgctctgctgaatctccaaatataaacacacacacactcaaacccttctatgagtcctaaattacattcttgcttcaagctggctttttcaaatctggcagtccactggcgaaaatgtttgcaggttagagaaaaaaaaaaaaaaaggcaacagaaaattcacaagaccaaatatgtgtgtgtgtgtgtgtgtgtgtgtgtgtatctttagatatctttagatgatatatacatacatacatatatatatatatatatttaattcactgatgtgtacttgaaaatattatgcacccaagatggaaatcatataaggtgaatttttcaactgtgacaataccatgaataatttttaactcaaaagatggagtaagtaagtattcagtaagattcaaagacaggcttcgggagcctgtgactaccttgaaattctatgcatatatttgtggtttggtgtgtatatgcatttgtgaatttcttactacagaaaggttttattagattatcaaagaggtgagaccaaaaaaagattaagggactgcttcttgagaatctggtaaagtataagttgcctcaagatcaaaggaactaaccctttgacttgcaaatcaattgaaagaggagtggggtggtggctttggagtcctctggaagtggagggggcccagccctctcccagggatcagtgaaggaaattcaacagagtcaggaaacttcttgacagcctggtcaccaagggtttggaaaaaggttctattggagtggagattgatgggtggaaaaaggagagaggggagttggacctgataccaaagagatgttttcagccatcaaccagctgcaaaacaagatgggcttccttttcctacatattcttccaagcatcataaatactcggtctgctccccaacccacatcctgcaggatgcagccagagcaacagccccactccactctgaaaccagtcatcctagggatgatgatcatttcttagcttccctgttggaggtcggttggggttggctgatcgctgcttggttcactcctgcactggctgggcgttggctgcatggtaaagctgttccctgtctcatcctgttgggataaacagagtatcctaggcatattttctccagagcagtggcagacacaaagggtcaacagaaaccctcaaggttttgtcatgcctactcttgcaactagcacattgtcatttcagcctcatgctattgaccaaagcaagtcacttgaccaaattcaaagccacatgacagggaaatatattgcacctctttagaaggagcacctgcaaagttatttgggcctggatatacagggcagggagaattttggaggcaaaaatgcaatctgccacatctacgttagtgaagtcagtttttcgtacatgactaccaagacaaagcacttcacttaccaactctattcaaataaatggaaattattcaacctaaaattatgcaaacattgctccccttgtgccaaagaactgcaccatgtctgattggctttgcaggtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagtaagtgctgtgaactcaacagagctgtcatgtcttatctgctcttctttcagctgactctgtccccctttcttttccttttctctgtcttgggtatcattgacagccccccaaaacaagtaaaaagccagtgtggaataatggaatttgcatcagatacctctaggttccaaaactgattctattccttcacagccgtgaggccattactctctctgcattactcaattttaaaaaattgagtcttctcattttttaaataaatattcctggaggcattcttgtgagaagtagatgatgtatatgtaagacctgacacacagtaggggctctgtaaatggtggatagtgttatttttcatagcagagtagccaactaatcactcttcagaaattcttttattctagaaaacagtcggagtctgtggttctcaatcagggacacttcttcctccccctccaccccaccctaccaggacatttagtaatatctggaagaggtttttagttgtcacatctgaggtggatgctaccggcatgtagtgagtagaggccagggatgatgggaaacatccccaatccacaggacagtgcgcatcacagagaatggtctggcctatatgtgtgtctcatgatactgtcatctccctctctctgtccacatgtgttttgttttatcctctcttctttctttacatccttttgatctaggaatattatgttatgtaacatggtgtttatttgcataagacctcccaagagaaagcaaattggagtgtgtcggtatggcgccatgttgtgaggttgccaggcagtcaacaggaacaattaagtgcttttcaaggggaaccctcatttaacctatatccttgtttctcagtacaagtgttgtatcctagaggaatgtgttggatcctagaggaagaacaagggatgtaaagagagcactgaattacgaatgagaagactgtggctttcccacttggtacccatatagctatatggctagtttcttcatatttttaaatagattttttattttggaatagctgtagatttacaggaaatccatagataatacagagagttctgtacacccttaacccagtttgcccaaatattaacatcttatgtaaccttggtacagttatcataactaagaaattaacattgatgaattactcataactaaactccagactttattcagattttaccagctttccactaatgttcctttcctattccgggacccaatccaggatcccacaatgcatttagtgttccttcagttttaaaatgggaatattttaacaacttgagggttgttatgagttgtcaaaaagaccctctcaaagtaattctaaaagtacataagagaatataacatgatgatatatttctttacagtcatacaacaaatggcacaatacctatgcacacttagatcagcattatttgatttgcatttgaacatgtaaatatttgttccttcaaaagatatgtttgagcaccaagtgtgtttgggatgctgtgcaagatgctaaggatattatgagtatcttcaactccctaaggtgtgcttctctctcaaaaaggtcctagactattggggaataaagcacattaatcctaattaacattcaatatgtgaaatctctgactggaataaccatgagaggttctaagttgacaaagccagggtgccccagcacaaccttgagaggctttccaaggtaggttaggagcaggggatgtgaggacacagtgttccatgcagaaggaacagcatgggcaaaagcccagagacaaggagaatatatttatggaacagaaaattgatccatgtggttaaagtgtgtcttaggttgggaggataggtgagccaggaggctggagacaagaacagatcgcgaaagcctcctgggccacaccagggagtttctttgtataccaatgattggtggagagattgaagagtttaaatcaaacaggcaggatgaaaatttccatgaaataaagctctcttgcactatgatgtggtgagtggattacaaggaaggaagactggctgctgggcacagtatcaaaagattattgaaagagttgtccatgtaagtaaacaacggcctgaataagagtcgtgtcccatacaaatattataatgaattgaattatttagtaaagtaagctattaatctctttcttgaactaatttgtcttcactgaagcaaaagccttgaatttgggcagagtaggtagtggtttatttgggaaacatatctgaggcatgggcagaatttgctcaccaagattgcatgattctgctccacacatgcgtgggtgagggtgtgagccaaggcaggcaggatgtttgaggcagtatgtcaccatcacaaggccggtctttccaatggctctgacattctgatatatctcaccggaaggaggccgagcagaacttggccttcattgtaaatgatgggcgccattaaggaatttcttcctgctctgcccattagtatcctatcaatcatttttaatccatattctaccttccacctttaaaaattgaaatattttaagcaaaactgtcttcatactcttcttgtcttagttcatagtttatctctgatagttgctagcatgatcattcctaaggacttctttttacaagtcaaaatttaaactacacatgtaatccaatagatcttacggcctctgagaatgtccaatccctgctcagcccttgagggttttctctgctccccctttaaagcttttcttttcttttttattgttatttttttgagacagtgcctcactctgttgcccaggctggagcgcagcggcatggtcttggctcattgcaacctccgcctcccgggttcaagtgatactcgtggctcagcctcccaagtagctggaattacaggtgtccgccaccacacccagctaatttttgtatttttagtagagatggggttttaccatgttggccaagctggtcttgaactcctgacctcaggcaatcgagctgccttggcctctcaaagtgcaggcattacaggcatgagccaccagcccagcctaagcttttctttgatatgtacagaaatagatttctaaaacaaaagccagctaactatagctcaagggccaaatctggctgcctgattttgtaaataaagttttattagcatatagccacacccattcatttacctattgtcctgtccgtggctgccccctcactatagcagaagagttgaatagtcacaaaagagaccacatggcctggcctgcatagccaaaaatatttactgtcaggccctttgcagaaaaagtatgctggtccgtgacctaaaaagaaaggattttagaggtgctggtgttgtgttgtgtttgtatccaaaaggcaactggaaatcctttggcctacccacatgtgacaacacacactgtcctatactcactgggtcagtttctcgcccagcatcgtgtattgccacagttgaatttactagaccttttcctgtgattgagagctgtatactgggcagaaggaacctgccaactgcaacagtgactgtggagtttggacaccatggcatttgtatcaggttgcaatgcatttcctgcctttaaacgccttgtacccaatgcagtgttgaatgacaggcagtactccaaaccaatattgaattgtcaaagaagaagtaacaactatgacaaaatgtccaggtgtgactctgccaagatttttttaatacttaaatctttaagacacaaatgtgagtaatgaaatagagaaggccttattatatataaataatttcatgagtagaaaacccaggcattgctatcacattttttcctaattttgtggcctgaaaattgtattctcatcctaaattcctaagagtaatgctttaatttttaataatctcagaataatataaacctctagaatattctatatgttaagacccaagatcttgatttgtttggtttctggtctgaagtctattgagcatgaatgcatcttatgctggatagaacactgcagtggttgaaaatggagtcttcattcattcctccttttcaggatgctatccagccagtatgtacctgtgctgcttgtatacacctggaatccgtgaagctagctcaccctatgttttctggctaagccttatccatgctgttgttgaatagttggcatgccaccactggatccctatcttagaactggtagactgaaagcttatgaagacaggaacatgttctttttcactcttactgtgtactgtactatacacagagttgctgctctctattgtcttttgaatattatgaaaactttgcaagcaaatgtctttgaaagttgcttataatgtttaaattactattaaaatataagataccactttgtgataggaggcatgactcagggagggctggcttgttcctgtcttttaaacctgattttgaaaatatgctattggttatgataaaataaacaatcctcttcctcttcctttttctgttttgtgaatttgttttcaggccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtaagcaacttatttctattgtcctgcagttataaaaaggcacatctcattctgtacttagagagtcaacccatactgtaatgcatcttaaagaataaaatgcagaaaagttgtattagtcagctcttgctaggataatactgcataacaaacacccccaaactcagcagattcaaacaacaaccatatattactaatacccacacctgtgggttctctgttcaagattatagagctctgatcattggatgagctataccatgttaacactgctctttcatgccatgaaacatgggttggcaaaccacagcccatgagccaaacctggcctgctacctggttttgtaaataaagttttatgggaatacagccaggtccatttttttacatatagtccatggctgcctttcagccacaacagcagaatcgagtagttaagagagaatcatatggtctacgaagccaaaaatatttacttactttctggtcctttccagaaaaagtttgccattccctacttttaaacatcactcttcatcattacacaaaactaatttctgttgccttgtatgttttatggttctagactggaccaattagtgcaaatagctaagggttgaatggtgggggtgaagcagtgatcataggctgggaataatttcaaaaggcctgttagatccagcccagtgactttagcccactgagttctctaagaataagggcaaaggtcaggacacaattacattggaattagttaacctcacaaagttaaccttgcctaatccacagccacaactgcacccctttgaccgtctgtctcacaaatgcctgcttgctattgatcaaaaagggagctattttatttttatttaacaagccctcatatggtacaagtatgtgccaggcactggtctaagcattttacagatgtcaactcatttattcagccttacagccctacaaaggtaggtgctaatattatccactttactgatgaggtgactgaggtatatgctgaagatcacagggttacaaagctcacaggtggcagagtcagtaagtctgcagtcaagggtcaggctcttaaccagcagtccacaaacattatctgtaaagggccagagattcaatatttctggttttgcatgccaaatgatttttgtcactaatactcgactcttctgttgtagtgggaaagcagccacagacaacacctacacaaatggacatggctgcgttccaataaaacttcatttataaaaacaggcagagggccagagttggcccctgggtagtagtttgctgttccccgctcttaaccaccatggtatgctgctattcacaaaagggtggtatatttttgaaatgctataattactctctagggtttatgacagtgtacgtaatgagtgatagctgaatccttgctttaaaaaataaaatcaacattcaaaattgcatagcctgaagatggtgagtataacagtgtttctttcaatataagcatgataaaacacttatttatatataaaaaaacctttcaattcaaacctatgcaaataatgtgacatggctgagtcctttatattgtaggtagaaattagccaaaaatctaagaagtgaattgtaagcttcccatctctcccaataatggtacatactatattggctgagcgagtaggttttcctttgttgctatcctcataattctctttgcctagaagagttttctgttccaacatcctgccagaggatggaggacaaatccttcaccccactaggctctgggctagattggcatttgcaatttttagctgcagtggggcaaaattaaagcacaaaggaaaacacaatggatgcaggtacaaaaaaagcaaatgtttctagttaattaatgtgctgtattaatctgggatagaatccagggtctaaatgattattactctattaataattaattatgataaatgaaacctgatcattatgatctcattgccattgatgaatagtttgcaaaattccatcagaccacttcagttatataaacacacatcagcattaccttgaaaacaccctccagatgtcaaaactaactcatgagggggaaaagaaattctaaaattaattgctacacaattaatctttacaaacctgacggtgtcaatttcagaaaaatcttcatgtagaaagtcactttacatttccttggggggtattagcaaggaaggggcaccccctacgattaaatgcctgtgacatcttgacttgcaacagctaatgacatatttgcttatgaaatatagtcctgactttaaattgatgtgtacattatgatctgtgcaatggggcacgttaacattgctccgagagacataatttttatactttgaattctccgtgtctcactgcgtaacttaatggaacattacattctgcctgcacatttcaagctcaatggaaatatgtacctagtttcacagattaatgatactataatggtattttcctttgcttaatggactatacacttagtattttcttactctctaatgctaatgtgcacttggtgttttatgaaatggtgttaactaaatgagtaataacgggttcatgcaaagattattagaccagaaggggtgggggcagcatacaactctggattttgctcccaattttaatcttctgtttctacttgctacatgtagtcagccatacctgccacagctatttcatagggttcagttaaggttcaaatgggaaataaacatcaaagtaataaaaaataaaaatgctgtgccacaacaagaaggaaacaatacagatgtggtgattttgtgatgcaggttccaaattgtctgaaaagcggaaatagtattcactggggtatacagaacatttttggggggtgggagatactgacaattgcaaaatgaaaacctttccaaaatgtatgtattagtctgttttcatgctgctggtaaagacataaccaagaccaggcaatttgcaaaagaggtttataatggacttacttacttacagttctatgtggctgggaaagcccacaatcatggcagaaggcaaggaggaacaagtcccgtcttacatggatggcagcaggcaaaaagagagcttgtgcagggaaactcccccgttttaaaaccatcagatctcatgagacttattcactatcacgagaacaacactgaaaggacctgcccccatgattcaatttccttccaccgggtccctcccacaacatgtgggaattcaagatgagatttgggtggggacacagccaaaccatatcagtgtatcaaataaacagatgacatttgagaccctcgatgcatgccacagaagggagccagaagcttacaggaccctggaagggctggggcatgaagtcagggagtctgctgctctagttcatggagtcatgatgagctgtagctgctgcaaagttgcccacagcacaaggcaggtgtactcaggcgctcatctagaagcttccaccaaccgcacgtctactgtctgccatcaggaaagcgtgtttcccctcctctaagcacttctggatcttgtgcaaaggcatcacaatagcagagcctgacccagactcctacaggaaaggggattctgggaaatgcaacttggattctcctcataagcaggagaggatggacgggagggaagagaggatgcaacattgatgacagacaggcctgcacactgggcttggcagattatcaattccatccttcttttggatttagtgatggcatgttgtgttaattttctttttaaacaaacacaccactcttaaagtgattgtattttaagtccagtgtgattttttttaaagaatgtcattttattaaagacccatgaaatttttctctctgcattgggtaaggtaccatatgttaatatccaattagactggtttctgctataacatattaaaagttcaactgtgagtcatttactctttataaagagtgatgggttttgtttatcttaataactgaaatacgatgaatattacagaggcatgactcagaggggtaaaaagagattaagatgcttagaacattgtagaaagcattctttggatttttttgagcagcaagagaacatttagaataaccagaagatccgtctgctcaaacacgttcagaattttttttccagtataatcagaaaggctcttggcagtgatgaactgcacaatttctggttacggatggcattgtagaatgtagttcgtgtttgtgggttttgagtcatcctgagttcaaattctgattctggtacttattgttaatatgtgccatcaggcaataataataaaataaatagcagttactgaatattacatgccaggtcctgtgcctgggacttaacatgtattctctcctttactccttaaaataacactgtatatttctcaatatacatgagaaaattggggctgagtaatgacaaaggatttatccctgcaaatgggaatcatcttctgtgcttgcccttggcaaagtgcattcagaatcagaaaatgacagacatggtgttaaatgaaaaattataagaaggtcaaaaggagaagtctagggttgtgctgtccagtatggtagctatgagccacaggcagctatttaaatcatttaacttaatgaaaattaaataaatttaaagttcagttcctcagtctcaccagccgcagctaaagtgcccagtagccatatgtggcttgtggttaccatatcgaggagagcagaacatttcagtcattgaagaaagttcttttggtcagcactggtctagcgaattcattgtgtagatttttataagagtgaaaaaaagcagcaaaactcaaagttcaaattctccgtagtgtttgagctgaaaacagaaatgtgggtaaatacgacgcttctttccacccactactttccacccactttccatgtttgggagggaaggagatgaggaacacagatgttggggttcttgccaagctttcacttaaagaaaatgaacagggacaacaaatgatcatgtttttataacccctgaggaccacagaacggatttaacgtgcatgtgcaacatggctcattgtttttgttgttgctgttttgtttccgcaggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaagaccctctgtctctgcctgtctctgttgccttttcatcattttgtgtttttgcagttatgatgttgacaaatatttattcaacatctaccatttattcatactactttatgacatataattcattttcttttactgtctctcatccactatttgcctttccctattcaaaatacaattcttttgcaacactcaaaatattctccagggaatttttaaaacacaataaaagaaagcctatatagaagt

SEQ ID NO: 2997 - DNA, 222612 bp, human
ctgaagtgttagtatgtagtggagctggtggtgtgaagctgattcattttgtttcaaagccccaaatggcatgctgccgaacacaggcacaagcacagcagcgtctccttagaaataatgactccaaggcaaacagccctcattgcaaaatgtagaagactgccatctgcttgtctccactgtggtttattcgtttcagggttttaaatgacgtaataaaaaggtaagtcttctttttaaaaactggaggggtaagtgggaattccagattgattatagcatatctggaatatatgtaagatatttgccttaagttagaagaggatttgaatttataaagtgtgaatattattttcaaatgcaagtgcaaatcctgtcctgggaagataaggtaaaatccatatcttaaagaaggtcatgccttacaacttagcaattttatttggtattttagaaacatgatttttaaaaaaatgaattttcataaagacagtaattttccagatgtttgatagtacatatcgatcactttttcatatatgatattccaccttttcttgatgtttgcaatctgttttcagcttttggataagttaaaaacaagcagctgctataaattgtcaagggctcttaaaatgaggtgccagatagatttgggaagcgtctagctgatttctacataactcgtttggaattactctgttatgggagggagtataaagggtcataagactcagatgaagtttgaagctgaggtgtcccctctcccatccctgagggatagtgaccagggtttggagatataggaagaagcaaatgcacacctccgtgcctcgccatgacctatcgtattccagtcgatgaggagtccagagggctgggatccatgactccctgaggattcgcctggcaggaatgaatgccagcaaacaccccccttccacccctcccctcctagctccccaggagaggcgcttctgcagaagtcatttggtgtgtgtgctggttttccttgtgagaggattagagaataggagagtgctttgtgagaaaaatcctgggagaggttgctgggaagaaatcaaacagagggaaggaagacttcagctttcagagtcccctcagtcaagtaagtctgagacccagttgcctggcctagagcagctgaggggttgtttcctttcgtccacactaggagaaactggtaaggctcattttattctctactgctctgggatgctactgtaattgctttactgaagcgcaggggtcagaagggagggaagttggttagtgactctgcggacgtcctgcatcgtctctgtctggtgtatgaggacggcgctgtttctggtacaaagggctggtagccacagaacaattttacttttcccaaacttgattagcatcacttctgagcaactgacttaagcaaaacgcatgcccacgcaaaaactataccccatagaggaatgcacttatctatcagatactcggatctttaaagcatttctatctcaatttgattagtttggggggtacaacttcaggagagtgagagaaaaacccggtccttctggaaatttttcaattgtctgtttcctgtgagaatgtatttttgccattgtatgtatcacctgttttgtaacaagagccgttcagatccaagccactgttaaaaatccaagtagtacctagcgcaagttcaagacactgtgaaaggaggggagagtgttcacactcaagtgaggaaaatggaacttgaagaactttatattctttgtctgtatgcagaggagttctaattggaaagaagaaatgaggaagctgccctagagtcagaaagaataggtacacgtttccttcaacattttcaaagaatcagctcatgcacacagccttcttgggcaaatgttgcttcttactccctaattccattctgttatttctagagctgactttcatatttgtgtgaagatatatatagaatacattatttatattacttatatatttaaaatgtatatgtatacacacacatataaatatatccttttatcatatcctggcaaacttgagcctgaagagtttagaaatatattgattcagtctgaagcaaattatcccttaagcaagctacaaaagtccttctgagaggcgtgtttggagttgggggctgtgtgaagaagagagaagtggcagacagctgttgtttctgtgatggacaagtccagaagcctttcctcatagctgagaaccaaattcctaaaaactctgcgcaccctcccccatccccaagacagggtggtaatctttgttgttgtttttgccctgagaaaatttgagtgctgcctaatttagggggctctctgcattttttcctcctcattaaaataaaactagaagcattgctaaatgcaaagttctgatgatggatgttttgtttctaaacttaacatatgccaatacacttattatcatttcagttgaatctgcccatcatgaaaacactgatcaagtaaaatgattcaacacaaattattcaagtctgcaactgttacttcagtttacttaattctacagtcttaagatgatgtgcttattagaatattcaaaaattgaaaatgcatgccatttatttcattaataacaaccaggttatttaaactataggttataaaatataggtttcaactacaggttataaactatttaaatacagtttctttgcatgcacattgatatgaaaacctgaaaaaatatatgctttttcttttaaaatgaaataattatttgcctgagatatcctttgccaaaaaatgaaagtcaattccctttcaatttcagttttttattcttttctcaactgaaaatgctaattcaaccaaacgatgttatctttgcctttaggaattgtttacggaatgctggcagtcaatttgggagtcctgagtgtgagataacagttaatcaatttatctgtgaactgtgaagttttcaggttttgatcaacattattcactattctccaccccatgctcattctggttataaagactatttaccttcattattatatttgaacctgagagcgtcaagtttattagaattgattttctttccaggttgatcttctgaaatactttggccatttttcactactgccttatgaggttatcattaatctggcatatatttattgagtgcttgggtgtcactcatatggcacacgtttgctgttagagatgaaagctatgttttgtggagtttattgcagaggcgaccaaggctagaagggaaagaccaactcgtgctgttctaacaattgtttgccagctcccgtggttcagttgcgaatgtggtttcagcaacaacgaaaaactcttaattcttctgaattattgatacattaaaatatgttactggctacttggaacctgtgagctgagttaatcaataaccctctcacattgcacaagacccactgtgtgttattctcatcactggccatttaaataattcaaaagaaaggtttctcgtgaattaaccttgccattgcacaaattgggaaaatacagaacaaaacattccagcatccttaatctttagagcttataaattactgttccttctcatttttttcttgatgtattagttttttctgttagatgacttttgttaaatgttttgatatatcataataatacacataatttgcaataatgtcagtaagaaaaaagaatcatgggaaagaaatgaacatgtcttgaatccaccatataccagacactgccctggcccctttacaagcatgttatcatttactcttctcaacaatactgcaaaataggtattattgggcccattttaaagatgatggaatgaaggaccagagaatttaagaataaattcatgccacactactaaggtagcaaacccaaatctgttccctgctccacaaaagcactttttagcacacttctatattgctctcttaccagccatgtctttcttcccagatctcgtatcaattgagaactcactatagcttaccttaatgcttccagagaatctcccttgacagcttctgcctgttccctatcttcctttatgatcagagagccaacacatgtaactatggattggacaggcaccatatgtatttacgtgtaaaaatggcttttgaaacatcaaggtagaaacatcatattaggttaaaatacagaatacagtattttagatttgctcagttaagagaaattacagacttggtttagtttggtttctggccatgcctgccctggtttccaccagctatccagtagggagccccggtctgcatgtacgctgtgacatatttgtttgtatagagatctgcttgtataaagatctaggtttctataccgacacagcctcactttctgcccccagcaggtgagcagaagacaggatggagttgtagaaaaatgcatcccttacccccatctgaagttactggttgagggaaagaaaatcataacacatcattaataaaaagaattctaaatatatcagtgcattagtctggtactctcatagtatagtcattcatttaccgcaacacaattatttagtcagcactatctatccaattgccttgtgtactagtttccgatggctgctgtaataaattaccacaaattattaaaaatttaaacaacacggccaggcgcagtggctcatacttgtaatcccagcacattgggaggctgaggcaggaagatcacttgagcctaggagttcaagaccagcttgggaagcatagagaaacccctcctctgcaaaaaaaataaaaagttaactgggtgtggtagcacatgcctgtggtcccaactacttgggaggctaaggagggaggatcctttgaggccaggagtttgaggctgcaatgagctataatcatgccactgcactccagcctgcccatctcaaaaaaaaattaaacaacacaaatttattttattacattcctggaggtctgaagcacaaaatggatctaaaatcaaggtatcagcaggcctgcattccttctgaaggctctagacaagaatctgttccctgcttttccaacttcaagaggcttctggcactccttggctcatggcgctgcatgtttctgactctgcttcattcgtcacattgccttctctgactcttctgcctccctctttccactataaggacctgtgcaattacactggggccaccaggtgaccccatggaaatcttcccatcttgcatccttagatctaaccatattgaaggatgtcgaaggatgtggttaaacatccttagccacatctgcaaggtcccttttgccatgtaacataacacatacaaaagtttgggagattagaacgtggacaactttggtggggagcattgttctgactaccacatcttctttcaattttttttttttttgagacaggatctcgctctgtcacccagattggagtgcagtggtgcaaacatggctcactgcagcctcaacttcctgtggtcaagtgatcctcccacctcagcctcctgagtagctgggactataggcatgcaccaccacgctcagctaatttttgtattttttgcagacatggggtttcaccatgttgcctaggctggtctggaactcctgggctcaagcggtccacctgccacagcctcccaaagtgctagggttataggtgtgagccaccatgcccagacacaaatttctttatattaacttgatatgtatttattccatgatcttgtaggcagtagggagccatggaaatatttcaagtggagaggtgaaatgaaaatgatcaggtttccatgttagaaagctcactgagagagccctatggagatggaggcccaactaggctgcctgttggaatgcaggagagagaggtcgagaacatgacttctgagagaatctgtagagaaaaggacaagaagtttgagaaatactaaggacagtgcattggcaggacagctgagaggaagaggtttgtgacttggatatctcaggtagatgatggggaggtagagaggatgggggactctgagaagatgtgtgtatgctgcactaggacctggggatagaacaccggccagaaacaccttttctcctaagaagctaaaagcccatctgtgaagacaccagtaataataataggaataactcatattcactgagtactttagcttcttccaagcacactacatttaattttcatatcaaccctctttggtagacactagtaacattatcatctcagttttctgatgaagaaactgaagcaaggagaccttacgtgatttgcccaacatcatgcaatttgtaaggagagagaaggcagttgaagtcaagtagtctggttccagaatccatggttttaattcttacactctactgccttgcttaacaaacaattataattttgtgagatatttagtatgagagctacctgtacatttaatgggggcgggagcaaaccacagggttagcaattactgctatcaagatgaactgtgaatttttctgaggcacattcctgtagaagcctggctatcagtagggtgtgatccatgacaaaataaaacatttatatggagcattagcctggaagcctggacatcagggcaaaattggagaaagttcttatttccctgctgtctaagaatttataaccacactgagaaaaccatattgcaatcataaaaaatagatgaccaaaaattaaatggttccaaggccctctggataaatatgaagtgagagcatagttcttttctaaaagagagtgggaaagaacaaggcaataagaaggtcaagatgatgggatgcagagccattgtgtacattcattgaatgacttaatgtgttatgcacttgcattctcccatttccaacaacactataaaataatggcagggtgaaatttgaatcccaaggtctctcactctgctatgtgtgtgtttaaagaatgttgggacagagctccctttgaataaaatttttaaatgccttaggaatcctaaaatgatgcttacattttgtaagatcttgataccttgacgtagttgttcttcattatcattatcattgactagttgttgggtggagctgccctgggcgtgtgaagatttcagtatcactcaatataggtgggtctttaaaagaaaatcatgccaagaaagatagatgtaaacttatttttttttacattctcttttattttctttaatattctgtatctttgtagaagctataatatggaattatagactatttacttatgggctttaaaaagcactgtggtaatcattaggtaataaatttcttaccaagagatattactgaaaggaatgtggtttttattcttttatagccagatcaccaggaagatatgagaccttgccatttaagtttgctttttaatttgtgtaacagaaagattcacatttaaccttttctactagacatgtatttaacaaacaattatttggtatctactatgtgaaagggacacattttattccatttgttccttgcaattcttgttcggaaagaccctctttacagtggaagaaggagaatctcagagaatggcccagctagacttgaactcctgtcttctgtctcagcccagaagacttgctcccatgtcctttaacctacttagctaagacagatattcaaagccactgaggaaggactccatatttcttcatttggaacagcaaactaggagagtttggttatatccccatgaccaatggtaggtatatcttggggcaattatctctatgctaaaatcaatattgctatttatcaagataatctacagcttgccttaaagatagagaggggatttcaaagtctatttgttgaaaagattactctctggaattgtagaatttgcttcaaagtgagatttgcaaaaaatatgagatttataccatagctgtctacccaatccctgaaagatttccattcaaggtgacatctgttcaggcttacacactgcttacctatgtgttggtgaaacactttctgtgaaccttctaaatgttctcacagcactctgacttcacccaatactcatgacaagaagaggacaaagctagaattattataccagagtatctgaccctgggttcaatgctgagagtgggtcacaattagttttaatagaaaataacatataattactgacaggtgccttggggcatgggaaaatagcatttaaaataatgtttttagtgatacattgcctacaggatgacatcatgcaagcttaatggcaatgcttgaaggtgagaactgactatgatgttgaaagggaaagtttgttcagatttattcatccaccatcagggaatcaaacgtgtcctagatttcttttttttttttttttttttttttttattttgagacggagtctcactctgtcgcccaggccggactgcggactgcagtggtgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattataggcgtgagccaccgcgcccggccgtgtcctagatttctaagactaacgaaacaagaaactaaaatctactattgaaacctaaataaatacagttatcaatgtgctgataagatctgcaaagactaatagcataagcccttaatgaaaaattattttattcaatgacttaccaatacaaaggttagatatccttacatcaaagtaatactgtattattcttccctatagttctgtaccacaaggaaaaattagtgctttatttttgctaattcacaaatttgttaaagtgatcaacaaatttaatttccatatacatgtgtaacttcaaatgtacagaggcgtgaagctactgcaaacacaagcttgctcactaaattttatttgataatatctattgccttgccatataacagcaagagcaaacattctaaaacttctaagtaaaaggaaatcatccgtctttttaaattatgtgaactttaccttatttgtaaagtactgtatagaaccaagaaaagtgtgggaaattggaacataattggaacataataggcatttaagccttatattttcacaacaaaattgccttaaattaaaataaaaatgatatgcaaataggatttgtttatccaaatgtgggcaaaagggctgtaaagataccagtatgtattagaacgacatgaataatttattttataatgtaaaacctaataaagatttaatgatcacccataagcctttaaaattatgtgagtaatagcactatggcaagcaaatacaggcagctattacagctctaccaaaactctgtttataactctttgtatgttactttttggaaagggtgggtcacagaatgatgtaataaatggttgcaaagaagtttctgtcccaagatgcgtattcagtgaattctagagctcaagctgcttttctctaaaaccatgcaatacatgcctttgcttcaggactggactaaccattttctgatttataaatttaatgatttcaatattatggagtaacttcagtgaagaaaaattgttttaggggcttactttcctgcaacgattattgccctattgcttttaattccatttgaatgcatgctatggagtagttgagttaaatccatggcatcttggttattcttcacggatgagttccagttctttgggtgatacaactaaaagctcacaagatgctgtgtatcggcactgaaacaatcagtctttgagctttggggaaattactcaagcagcgaattaatcattgcgattctggtcccccttcacaaatgctaggtctccgaaaagactccccccacacacccctgttcctggtgctcttattaaaggtgtaaaatttcataaaactttagtaaaacattatgaattctctttttgtgcaatacagctggtatttcttccagacatatatttccataattaaacatcctaaaatacaaatcccattattatttgttatgtctagtcagtaattagacctcagctggtagggcaatttcagaacagagtttaccaatttacatactaatccagcagagtctggtgggacatgattagcatagattcagtcaacatcttaattagccctaatcccagcatgcactccgaggtgcctttaccccacccccactcatgtaggtcttgtttagctgactattttccttcaacaaattccagctcttccaaacatattttccagtgctctttttcacagaggagatgattacatctcaaagtggtgtgccagggaggacattttgtgtaaagccagggaaatgtgaggcattgggccaggcgaggggtgcatacacaagtctgaagcaaaatcaaggtaccagaatctgttcttctagaatgttagagtatacccacttccctgtcccacccccaactctaggtagcaagatctgtaaaccattccaaacctgtgagaattttacctattttgtaagaagaatattccttattcctgtccatgatcaggagcccatttcatcatttaccagctttcatgtcaggaaattccttatacctaaatgaaatcccccatattgcatatttaagcccctgcctttctatccatccatagtggaaacagagaacaggtggccacctatgaaaagctcgtcttatagctgaggaccgtaattaaattatctcctttaccttctcttcttcaggttggatttttccagctcctcgactttcctctgagctcccttttcttcacctctttgatctttgtggttttcctctgaactctttccaagttccccacaccccctttaattgtgctcagaactaggccgagtatctttgaaatcatttgaatggccagatttcctcaggataaataccaacacttgagtatacctccatatccaatttacttctagaatcagtgcctgctgttagttagctggctagtttcacttattcctcttccatttttcaaaaaactcatttggtgtgctattgcataatctagaggggatttcttctatttgctttttttttttttttttgcagtttatcaagggcactttgagtttcaatttcaatttgcaaagctataaactaccagtatctcctgctaaggtttgaagtcatttgcaaattcaatttgagcattaccaataaattattgcacaatcctaggggaaagacatcaatagcgactgagaagatcccaggagattatcacttgctaagaccttcatctcaagattcttctctctgctttccctgttctctgccactctttcccactttgacctttgtcttatgacatagcctttccctatttcactcttttttctctctctttttttatttttacttattctttctctctcatcgtgtcttgcgttttcactcaacactttccagccatcccctgcttgagattgttccccatccagaaaatgtgtctggtcatagggaagagacaatggaataagagaaacatcccaaacaattttcctttttggctttgtactgacctagctgaaatcaggtcacgtgtgtcacagaaaaaagcaagtcaaaagtgctgactgatggatataataaacatcagggcaaagaagtgaagatggctacttggccaggcggggtggctcacgcctataatcctggcactttgggaggccgaggtgggtggatcacttgagcccaggagtttgagaccagcccaagcaatatggcaagacctcgtctctacagaaaataagaaaattagctgggtgtggtggcgtgtgcctgcagtcccatctactccggagactgaggtgggaggattgcttgagcccaggagatcaaggctgcagtgagctaggattgcaccactacactccagcctgggcgacaaagcaagaatctgtctcaaaaaaaaaaaaaaaaagtggctatttgagtctagcagtgacaggtcaggaactgtttgcagcctcgaagcctcaagacctttctggccacacaaaaagagctagtcagagtgttgcgaggttcgtgtgtaaaagaaccagccgaattcacctccagactctagcttgacttgtcaggggccaagcatgtgttttgaattccagaaggtgtcccagcttgctttaaaagtcagggtctgtatcaatctctgtctagaggcttaagaatccttaagattataaaaggtttattcatatggttttggagatttttttgaaatagttgtacatctgtgagcaagaagcaagtgtgagggctttgacctagatgtcttcatagccaaaaatatctcttgctattaagagctacaaaaacggttcaaatatctcatattgttgcactacttcaggggctacagatggaagatcaaatgccaaggatgatgttgtgaatctctgtttgactggttggttgatttggtttgttttttatttttgtatggccgcttgaattgtgtgtgtgtatttgatgcaacttaaagttttaaatttcctcaccaataaataacttacattctagatgtttaattaatatgcatatccttaatctccttgtttcccattctaatttctgatggcttttctgaaatcatgtgaggcaaatacactctcccacttttcacctgaccagacccagaagtgtgtgcaagaaaggactttgatggttagtttagtaactaccaggagccatcacggaggctttaccagctcaagttaagaaaaggattattagtggaaatgaaatatggtgcagtcactttggaaatggtttggcagttcctcaaaaagttaaacataaggttaccatatgatccaacgagtgtacttttaggtatatatccaagagaaatgaaaacatatgttcacacaacaacatgtatatgaatgttcatagcagcattatttacaatagccaaaaagtggaaacagcgcaaatgtttatcagtggatgaatggataaataaaacgtagcatattgctgggcgtggtggctcatgcctataatcctagcactttgggaggccgaggcaggtggatcatttgaggtcaggagtttgagtccaccctggccaacatggtgaaaccaccatctctactaaaaatacaaaaaaataaaaatagctggacatggtggtacatgactgtaatcctagcttctcaggaggctgaggcaggagaatcgcttgaacccgggaggtggaggttgtggtgagccgagatcacaccattgcactccagcctgggcaacaagagccaaacactgtctcaaaacaaacaaacaaagaaacaaacagatacacacacaaaacaagcaaacaaacaaaaaccctcttttaactccatagttaaaaccatagttttgcattcctagctgtcatgagtgaagctgagatttaaaaaagtaatataggactatcacaaaccaaagttacatctaacataaatgtccattcatatttcatttggctgtgattgtgtatttgtggcatgtatatgggtgtgtagggaggatgcgtgtatactcatacaatgttagcatcaacaggaccataggaatctcctaattcaagctcaatattaacacattcaatatacataggtttgatatttataatatatactgctgattgtgcaataattcttcacattcccatggccttctttaagaggccatcatagcacacatctaattttatcctaacataattctacgagcttgctagagggcattattattattctactgagaaaatgggcagctaattccaaagaggtccagctttggctcagtcttacacggcatgtgaatggtgaggttgaggattaaaacccagattccacatccttgctcagagtacttcattctggcccacaatctctaaagctacaactgtctaaatacaaacaaacaaacaaaaaacaaacaaaaaaacaaatgcaggatatccatgcatttccgtacaaccggatagtattcagctctaaaaagtattattcagctgctgatacatgctacatcatgctcagagaaagaaggcagtcacagaggatcacatattgtaggattccatttatgtgaaatgtccagaataggcaaattcatagagatagaaagtcaattagtggttgcaaggggctaggggtgaagggtagggggaaagggagtgactgctaatgggcacagcatttcttttattggggggataaagctgttctaaaattagatgttgatgatggttgtaggacactgggaatatactttaaaacattaaattgtccacattagatgggtacattgtgtggtatgtgaattgtatctcaactaaactttaaaaaaaaagaaaagagaaaggggttatgatacagagccgtgttcctaggtcactcacaaaatgcttttaattgttacagtttaaaaagaattaactaactcctattatcattttaatagaactctccctccaacatgcactgtttcagatattatacaagacagtgtagacagtgtatttagacagttgtagctttagagattgtgggccagaatgaagtactctgagcaaggatgtggaatctgggttttaatcctcaacctcaccattcacatgccgtgtaagactgagccaaagctggacctctttggaattagctgcccattttctcagtagaataataataatgccctctagcaagctcgtagaattatgttaggataaaattagatgtgtgctatgatgacctcttaaagaaggccatgggaatgtgaagaattattgcacaatcagcagtatatattataaatatcgaacctatgtatattgaatatgttaatattgagcttgaattaggagattcctatggtcctgccgatcctaacattgtatgagtacacacgcatcctccctacacaccgatatacatgccacaaatacacaatcacagccaaatgaaatatgaatggacatttatgttagatgtaactttggtttgtgatagtcctatattacttttttaaatctcagcttcactcatgacagctaggaatgcaaaactatggttttaactatggagttaaaagagggtttttgtttgtttgcttgttttgtgtgtgtatctgtttgtttctttgtttgtttgttttgagacagtgtttggctcttgttgcccaggctggagtgcaatggtgtgatctcggctcaccacaacctccgcctccccggttcaagagattctcctgcctcagcctcctgagaagctaggattacaggcatgcgccaccatgcccagctaattttgtatttttagtagagatggagtttctccctgttggtcaggctggtctcaaactcctgacctcaggtgatctgcccacctcggcctcccaaagtgctgggattacaggcgtgagccaccacaccgagccaaaagagtttttaaaaagagcgaaaaaggcaaaggaaatgagatccaattatgcctccagatttatgagaattgtaaatactgttttaataacttctagaagagcgtctgaaacagtaaaagtaagtagatttctcattcataactgtttacaaattcttttctgaacaagttgaaaattcggggtaaagagattttctttgagaaagttaactcattgtctaaaattcctttgactccagatgccaagacaaatattgagagtaatgtcatatggttctgtaatagtaatattctaagctctactgagacagcatattcttctacaagtagaaaaaatatatttttattaggtatgaaaaatagatttttgatataactttttttattatgaaatagttggagacacaatgccgggtgcggtggctcatgcctgtaatcccagcactttgggaggccgaagtgggtggatcacgaggtcaggagattgagaccatcctggctaacacggtggaaaccccgtctctgctaaatatacaaaaaatcagctgggtgtggtggtgggtgcctgtagtcccagctactcgggaggctgaggcaggagaatggtgtgaacccagaaggtagagtttgcagtgagccgagatcgcaccactgcactccagcctgggcagcagagcgagactccatctcaaaaaaaaaaaagaaatagttggagacacacaagagtttgcaaaactaatgcagagagttcccccgtaccattcatgcggcttcccccaatgaaaacatctttcataaccacagtaatgtcaaaaccaggacattgactttgacacagtattgtcaaaaatagattttcatatggcaaaatttcccttagaaattggactacaaattatcacatcatttcaagtctcaagtgtcacagttggatcaagcttttattattaaagggtataatttgattctttgtgtaaacaagcattgccctaagtgtttttttaattacatgcattgaaacctgaataatagttcatttcagcttacatttgtatctaaaaatactaataagctccacttcaaaatatatagtactatttttaaaaactctgtgtcgctttcaaacaacacttagatcattaaattagatcctcattgttccctcagaggtgacaggcattattaaaatgtattctgcatattttgtttctgtaattatgtctaatcagtgtgaattgatgctgtggaaaataattaaaaacacatatttgagctataagtgggaaacaaaggagaaactctcatagttggactctaaatgacaagaactgatagaaagttgaaatattagacaagaccagcagcccggaaaaaaaaatgtgttaataggtagaaaatgcaaaatgtctatagaaatatcctgaccttaaaacaaaagaaagggctttgtcattgtgtattctttttcccctgcagaatcgattctgaaagatgtggagatctcataaacgtctccaaagaacagttcacagcacccagggagtgaggctttctgaaagaaatgccttcccatgccgtgtaaatggcatgtgtcaagggggaaaggccccagcgctgtggtgattgagcaggggctgctgtgggcagcttcctttgtgtcctgatcatttacatgacttaaacacaacaatgtgctccatcgtcaataacacaagacgctttgccatagcaacagtttcagaatgtggcacagcctcagtggtgtccctgaaacagaaaagttccctaaagaaacactccttatgaatatgttcagagatttctttatcctactaggacttgtttcaaattccattgggtttaggttttatttgcacagcccatctttcctttgctctgtgagaaccagctttggggagaagttgggagagacacgactgtggggtcagagggtgggaatacatacatggctgtgatagaaatggaattcttaagaacattctcagaaaactgttaatgctatccagaaaatcatgtaaaattcaggaatgcaacatacatcccaaagtcattgttggtttccttgaaggtctgtaataaatggcccttttattgtttgtacattttgcttctttccatcacaacatgtgcatgtactgtgacacactttagacaatcataaggacatgaaccccacactcaatggcattgtccaaaagacacagcacatacgttatcaaagctgtgattaaactccaatacctccctctaatttcaaggtcattttctggcaagacacaattttcccgttaagaaagtacccatcctcccccaccccccttttttaagcaatagcgctttctacaagtttgaatctaagagttgttctagtgaaactttcacctaagacagcatagaagagaagaaaaacataaataattttaatgataagtgataacagttgaattatatttggctatgtaacatacagtggtgttttacctttaggggatagttagagcactttatagtttgtctggctcagtgagaaggaaattgtttaccttgatatgtttgtgtttctgaaagatgtgccttctgtggcatatgtgccatgttgccccctttcctcatctgttccccttcgttgatttctgggaagtagccatcccttaacactggagctgcctatagtgatagatgatactctgaatctgtgcacctgactccatagtaatctataaattattgatgagctggtaataaaaaatcctaaatgttcctgcttctcagggagccacagaccccaggggtcgccaagcaatgaaagatcaaactggactcaccagtgaaaacacaattaattatttacacacatcagcatttgacattggtatcatttgaatcaagagatcctttgttggctacattgctacattgatttgtgctccaaagactgtaagtttggatgcacccttgttcaggcaaagggagatgagtagatactgagtgatgaaaggtgagcactgagtgtcaaattttatgcacatgttaatataaagaaattgatgtcatatattatagtgatattttaaggagttttgaaaacacaaagattgtgtgtgggtgcaaagtgaaaaggaaaggggatagagaagcaattataattatcttatctcagtccagtaaagccaaattaatttaaccagagctggggagaagtctcaagagaaacaccttctgaataagaccccactggagaaacttaagcaacaccagtgaggagtagctccctctcatgtctcttggttgctctgctgtcctctaaaatgatttcctgagggcagcagggctggtgagtttcattgcagaaacttcgagtcctctatcataggcattttatgggttaaattgtgcgagtaaaacacgtcctcctgagttggagtgcctctaatatttagcctactcaaaaggctgagcaggttcagttctttctgtgaacctggggaagagaaataaaaatctttatttttgtatgttctgtaattttcaaggcttttttttttttttttttttttttttttttttttttacagttgaaggactgccattttaatgctgtggattttgtgggccgctgctcaacaatggggaaatttcattaagctgagccaaagctaattttgaagcagttctgagacattccctattaagtagagaaaggatttgattccttatccttcctttcatgcttgagggatctcagaacccttgacaaagcaatgactgcaatactgactgaaagtaaaggaagccctattcaaatggttagcattgcctcccagatgccaaaattcccaattttttaagaaagttcatcattcagaactattaagaatttttccactctttggtagaagaataataggtcatagatttatagagaggtctttcttcaatcagttcagacgcctcaattgctcactgtctcaaaagatggagtgtaaacatgtgtaatatttaatttctatgtacaagcaaagactcataattttctggaccacacagaatctctgtaaaagttttggatctaatctctgcttctgtactaattccaaaaaagtcaatgaagtctgaaggcatttggcaatagaactaaccaatttaaactctgtgctttagcctacaacccaaaagtcaatgtttcataaatatttgaacatagctattggaagtcccgctggttatcttttaagttgtactttgcttttggacgaagaaccatatcagagtatcattctcccataaaaatctgtaaaataatgtttaaatagtcacacattacaaaaaaattaaattccacaagtttattgccctgtggatattgggcaaagtgactgatgcccacacccatggattaatcaggttataaccaaaaatttcccttatattcatccttggttcacatactctactatcaggaaggtcacccaagactaagatagagggcaaatggggcctggtagcaacactgattttgctcaccatctaagtggctggttctgatcatcatcatattattgtgctgtttttccttttaaattgttaccatctccatagatccagctcctgtcctatagagtattcagttactgggtggattattatcttggtttgggttctcttggatgcagaccttgagacaaaatttcaagggcatgtaatttatttgggggagagagacaaggaagagaggaaaaccaataaagaataggttatcaggtaagttaccactgtgggcactgaagcttaatcttattggggaactctgagatccagtggaaaacatactcctcagagatatcctatctgagggacaagggagcgggggtattaatacaccaattctggccagtcactgcatgaggactgcacagtggtagaagtgggagacattaattctccagcacttctgggctgccatatgcaagcaaagctggctccagcaccagagaaaactctctggtaaaaaaattgtagagactggcagttggatgtcaggctactgggcatagaaatggaaaggcctaagggaatatgagcagagaattgacctatctggttgatattgagaatcaatttcattgtctacaaccccaaaggcaataaacagactccacgggtgcctgcaagagccttgtcaatattcttccacgaggaagagaatagttttcccatggcttgtttttttttttaaaaaaaatcaccatctacttctactgtatgtgatttgtcatctgaatatgagagcttaaagagattcacttaccttcccagacccagctctaacccagacagaggataaactggaagagtaatcgtatgggaatctcaatctaacgaaacagaataggccagaaagggttcagatctaggctggaaactgactgttggcatttggcaggtggatagctctcctatttgcaggagggagtgaagtctgcacagacaagtgaagagggatgacagtaggtccagcaattagtgacagatggagagtcacattgtcaagctgttggcattgaaaagagccaacaggaagtggcagtacagacccttggcaaaaggccataggaagggggccaacctgacaggtgtgggcattgaagaggagggaggagaaggttcttttgtagtttgtttatccacaaacggtagtgtctttatcctggacaaagcacaggtggataatgtcaacattgagattggaaggagaagcttggaattcaggggcatagttcaagtcacagaataactaaattaatgaacagggcaccaagtcaatgacacaagcacaagaagctctatgattttagttagaacttcttttgattgcaaatggcaaaaaattgttttactttaagaaaaaatataaagtgtgtgtagtgtgtgcatgtgtgtgtgtagagtgtatcagttatccagcgctgcataacaaaccatcataaaatttagtggcttaaaacaataatctttagctatgattctgtgggtcagcaattagctggattcagctgggcaattcttctgcttggctcacttggggtcactcatgtgtctgcagtcagctggcaggtgatgagagggctggtggatctagaaaacaccagctgagatgcttctacatgatctacatgatcaatcgctgctccacctcatctctcatcctccaggtggccagtctggcccactttatatattaatgaaaggttcccagcggccagcgagcacaagccccaaaccacaaacactttttagcctctgcttgcttcgtgtttgctaatgtcccattgaccaataagagtcatgtggccacacccagattcaaagagtgggtagatttcacttgttgacataatttgtgaccaattcatgtgatctactatcagagggcatttgaagctgcacagaaacaggaatacaatggtagaatgacctgtctgcttcttcctgtttctattctttctctctaccaacttcagtctcatgggtgagctgtcttcataaggcaggaggtccgggtcacttttagctcttgggatcacatcctcactgcatcataacctgagaggaaagtactctcttctgtcaggcccaatttagaaaatcctgcaactaaagcttattggcctggcttgcatactgggggatgatactggtggctcatattcaacccagatgatgggagaggaagggggaagaactgttcctcccatgttttctttgcctttctctggcttaattcttgtgtttcctagattccattttttctctttcttggttttctctttcatttttttctggaacacatactggaaaatgttacatggaaggcaacttttttgaggtcttgcatatccattcttccgctgtccaacttgaaggaaaatttgatttatttccccatagggcttatcctctaagatattatgtaatttccttgttcgttgtgtttcttgtctatcgtttttatatcctgctatgcaagcacatcaaaggcagagttttttgtcagtttatttcactggtgtgtctcaagcatctagaccagtgtatacagcaggcactcaatcaatatttgtggaattactgaatgaatcaggctgagttttctgtagcacatgctcctaatgtcaccctttgtccctccagtccccactgcactgtgggtttttgagggttttgtgcattttcacatctccagtgccttgcccactctggcatgtgtgggagtcccataaatcaggggcccccaagtccccaggccatggactagtaccggtcccagtctgtggcttgttaggaaccaggctacacagtaggagatgagtggccagtgagtgagcattatcgcctgagctctctctcttgtcagatcagcggcggcattagactctcataggagcgcaaaccttattgtgaaccgtgcatgcgagggatctaggttgcccactccttatggtaatctaacgcttgatgatctgaagtggaacagtttcatcctgagaccaccttcctcccacccatcccggattcatggaaaaattgtcttccatgaaaccggtccctggcgccaaaagggttggggcatcactgccataaattgttcttgaatgaataactgaattaccagggaaagcaaaactagctaatgctatttggagggaaagttcttctcaggacagaagtgttttctgtaatatttaaattatattctcgaggtagaggaagtacatgaataaacttatagaataagaccaaatttattttgcttgctgctatatttatatataactataactatattagtatctctatatctagatgccctagttaaagattcagttgacccagctggaattccgtctttgccaggactatctctgctgtgaaaaatcttctcttttcaaatcctgtgtataaagcaagctgcctataaatatttgttgtctgaataaacatagaaatgatgcatacatctttctaatgtttcacagaggggtttagttaactgaagctaaagaacagttctattaaaatcttggtagaattttctgttattcaagtagaatgcttggcagggacaaattatacaatgtaatcttttggcaattttcttttgcattcctgtgaagcacagcctttaaaggtattgctgggaagagttttgttttccaaaagtgatgatagatttcggcaaaaggccataaaacttatcaatgttttttaacctccatcaacaaaataattaaattttgttatgttttcaaatttgaggggatttttatttttcatatttcaactctttgagttttcattagaaaagcaatgttttccttgttttaagaaatacaggtttttatttctacctttttgaccaatgatgtataggaaagtttaaggaggcacagacctcatccccaattattaagagcagatgttttctgagaaatgtgctgtggatgattttagcattaacaacacccagtgtggacaatattgtcttggagagaactttggttaccgcaccagagtttatttctaagtcgagaggcagaaatacaagacaagacatgggaattgctgaactggttttgcccaagttaacttagagtctcaactagttcatgccttaatgaagctacattttactcattaatctacacatttgaagggtaacacataaagctaggaaagcagctaatactttgaaatacaaatttaggaaccaggggatgatctgtctctgcaaagagcataggaagctacggggaagtgtatgaagctgggggaagcaggaagctggggacagtaaagcatctgtgccttcttcagccaatctttattgagcaccagcagcacatctagtgctattctggatgctgaggccacaaaagtcaattaaatgagtccctgcccttgttcagtttatattctaatggagggagatggacaataaaccaatcactgtcagctagtgaggggtgctgcaaatacaaataaagcaggatatacaggaaccaaggccctccacaaaggagaggagcaaggaggttaccctttcgtgtaaggtgtctaggaaggccttttgggagaggttaagaattgagcagacacctgaagaaactaagagtgcaaatcatgctgatatcctggaggcaagaactatgggcagaaagaacagcaagtgcaaaggcctgagatgggagcctgtggcgtctgtgaagaactgacggggcctcagagtggtgagggcagcgggagtcaggggcaactgggagaggactaggtcacagcaaggacagcctcttagagctttgggagcattgcgtggactttgtcttttactcttgtgaaatgggagccaacgaagagtcttgagcagaagagttcaaaagaatgacagctttgaaataggctgggaaggagtgcaggggaatgcaaggtaggagcaagcacccagaagaggctccagcagtaatgcaatcaaaagatgaagcagaaggacaggaagagaggccatcagattctgggtgtgttttcaaggtgaagtcaacaggattttcttataagattggatgctggatttgagagacagaaaaaacaacaacaacaaaaaaccatggataactacaaagattctgatctgagcatctggtggtccttatggttggctcttaaatgccctctcttttaggtatgggcacatctgtttacagggccagagatgggacagacacgagctgaagtattataattcagctagtgatggtattcaaattcaacaaaatgaaatgaagaaaatatcaagacttccagtaataaactaagtgcaaaaaggaagaaaatgtagcttagcagccaaattagctaaatcatttagaaggagtaagttcaatatgaattaacagaacctaatatggtaatttgtagtaataaatttacaatatctcaagctggggtcactattggagtatctcattcagttttcattcaaactgtaaagcaattggagcttaggaaaacaaaaaatgacctggcacagtggctcacacctgtaatccgagcacattgggaggcagaagtgggaggatgacttgagcccaggagagcaagactaacctgggcaacatggtgggaccccgcctttactgaaaaaaaattttaattagctggatgtggtggcatgtgcctatagccccagctactcaggaggctgagatgggaggatcacttgaacccagaaggtggaggctgcagtgagccattatcgtgccaatgcactccagcctggacaacagagcgagaccctgtctcaaaaaacaaacaaacaaatcatgaggggatgtgaaaactgatgatatgagaacaagttgactaattggatgaatagcccagaagcaagtagacgtagaggcataatgactgtcttcaaatatctgtggggctgtcatatgaaagcagaattaaacttggtcaatgtgacccaaagttaagctgggttctataggtagaaactactgcaagaaacaccttagctcaatggaaggacagttttccataacagacactgctagtactctccaacatctgtgaactcatctccatcttggttaccctgatagtctatatattttaaccccttgctatctaagtggggccatgtgcctatgtcagtcaagccaataaagtatgggtgagcttagtatatgctacttccagtcctgacctctaaagccccctctgagctcttccacatattctctgttcccctgctgctagtcagatgcagagggtcctggggaggactctgaggtcctgtaagatggtaggtgaaagaagccaagatctgcgaaaagagccagctgagcagaactgcctggtgcattgtgatatgaacattaaataaacctttattgtgtcaagccatgtagatgtgggggatcttttcttgtgcagctagattcacttaccctgactaacacatctactaacttttagagctgtccagctataaggggattgcaagggagagaatgagttttctgtccctggatgtgttcaagaacccccacttagacatgaaactctcaaggttgtaggggcaaagggaaagctttcccttcgcccttggaaggtttgttgaaaaatcaactcacaaaaagggagattaagagaaaagccatataaaggtattactaccgtgggcagggggacaatcacagactgaatgcccaatatcccaacagggtacagatgcttatacaccctgcttcttaggagagcgggagatggggaagtgtggatgattttagggattagtaaattatttttagggagattcaatgggcttgaagaacatacaatggtctggaacaaagtttgttgggcctgcagagcagacaatggtttgtgacaaaatctgtccaggtttgttaatagacttcagccttccttcctgcaataatgaaaactcaggggagggaccagaggtaattgttttcttctttgttaggtccggactttaggctgaaactttagagaacaacttcagcctgtgctttgggagagatagaggattcagagatgggaggggcaagttgcggggagggagaagtaattgttcttcttggtgggtctgtccaatccttatgtagatggcggggagctctcttcttttatctgttgatttctaaaggcctttaattcgaaatactcattataccagggagccatattttggggaagttccttgtgctccaaggttaaaatcaagctagagataagtgacctgaccaaataattcgaacagtacttttcaaaactttccactgaggttcccttatcaacagagagatgtggctttttatccccaagtgacaggagttatatgtctcctgtgaattttctttgaactcttttgttttcataatcttatcttaaatatgaatgcagtttctgtgttcttatctacaacctatcagtttattttcatatactttttaaagttataaagtacatactattactgaacaagactttttcttttaaatattacagtcagattgacacgttaagtgttcaaaaattaatattttcaaagttaagctatgccaaaatcaataaattcatatgtgagcactgttttaagtgaaatataagatcagaattcaaatgaacacatacattatttttcaacaaactaaagtttgaagatcattccccatgccaaatcaacagtattccacattgcacggttcatattaaaaattataatggtagctagggtcctttgaaaaacgctagagacttctttatcttctaggtttcttttatagaaatgattttcattgcttattttcttacttagatggatacaaattgcaattctgttattgtgcctgcttacaaaaagaagaggttgctataaacatgatatgattcacaaaacgaaaaccatgctgacgttagtgggcacacacattttgcttgctcacatgttgtaatgtgatccaactagaaggagaggtagatttctccttcagcatattctcacatcttcccttcaaccagccccgccagatggaatggaaatgcagagattgtgttaaaagctgcagaagataagatgtctaggctgtacttgaaaaaggggaaaaagatgtaggtgcctccagacatcattttcttaatgggctttctctttagtagatgtttaggcatgtataatacccacttacatgcacctacttagaggggcctcatttgtactgctaggagtagctgctttgcttctatggagaaaatttgcctatagatttttgtaaactttatctgatattttaaagccatttccccatacttattttaatataggttttgagctagctttcctaattattaatttatatttcctttttaaagggaaagcaagaagcatgtgtgaaaaagcatgaacaaagttgtgaacttaaggaaatcttcaatattttaataaaataaaactactcaatgtctatatagtggccaatatgaaggcttgatctcctgcttgtagtggttagaccttcatattcaaacgtaatagtaacatgacaccaggaaagaaggcagaggatcatgtgcaacagtaataaaaaccaggccacatgtggctttcatcactttttcccacagctcagatctcagtcacatgatcacagcctaacaacacgggaagctgggaaataatggtcttcccgtgtgcccaggaagaaaaacaaaatgtaacaggagttactggacatataacattgtctctgccacactttctaatgcaaaataaaatagtcaaataatgaatccttactatggacttacgatctcaatgaggtagatatatcttagattctatttagcaaatgaagaaaaggaagatcacatatgttaaggagtttttctctcctggcatcactcatcttcttcttttattggtctgaaataaatttgctttctcacaatattgtttggcctgtgaatgcgttaaaaaatatttcaaagtatcataatgcagagttttggattgcatgttttagttagttgattatagtggctttaaaaacacagatttccttaaaacacacacacacgcacacagagagagacacacaaattcaaacacagttccacagttgactacttctttggcataatgatgtcatcaagaatcctggtgtgtctctgttttccactctgccatcctcagcaagacttatccaagttcacagtcactggggcattgtaacaacaccatagctacgaaaatacatactaaaatatacagatagaggaaagcttcgtggaaatctttcttactgttggtgttcatgtgtacatatatgaaatctgtgaaaactggatttatggcagtggaatctcatatttttctgccagaggtgatggttttaaaaagtcagaactggaacagttggagcctgtggctggagattattgaggaattttgtgtattcctttttcataaagatggtagtcatacagtgatgtgtataagatgaaagcaaaatttaattttgatacctggaggaaatgcctaaaatgagaaatgaaaaattcttattctgggtaatttgtggtagttctgctcttcttttacctacgtatatgatgattctgacgctcagagatttcaccctaaaccacacttgaatggcgatgactgcattttccatgctttcccacacaaagggctggtattgttctgagttggctcactacatgctagggacacgtggaatcaggtacatctcaacccactactaacccccaaatagataacttacttatttgtggcactgtgagcagaatatgccctttattcttccattttcaaaatatcatgttattttttcagggttttttatttttaatttttagcactctttaatattaacccttctagagtctaattctccatttgaagttagagttgaaaggcacacaatactcttaatagttttccagcagtgatgttgacccttctcaacctcatatgtttcattttgtgggagtagtattggggaaagatcaaatcacaactagaaataaaaagcaattccccttctatagaatgggatgctaaataaataaactaataaaaatgtcaaaatatagatgtggtggtggtaacaatgctggatcgggagctggaagacatagatctgatttcctggctctgcctcccccatcacttaaatataggtgaacactgaactgttttctctatcaaagagtaaaggttcctgttacacctacctcctggatggttgtgtagcttgagaggtgtgggtgagatggagcaatgccatatataccctaattcaccataaaaagatttggtcatttgtatatcttatgccacaagtactgtatcaggatcatagtgagagaagcagccttgagtgtttacctattacatcctccaattaagatattgttaaaatcaagcaaaaaagacagccttcttttcgtttctctgatataattagaaaaattcctgtttcacaccttctttttctgcaaaatggcctgtggaaaaatggttaggtcaaaaaataaattaggtaaatgctgttttctcagcctccctctcaaagaatcacaatatatgttactattttcaaggctcagagaaaatttgccatttattttataaaagattacttaacttattttccaaacctaattgacaaagaatactctttttccccctaaccattattaatgtcccttggctgtgttctaaagggagaaatggcacacttccctcattttgggcaacatgcaaaaatgtgcttctcagacatttttctcctgaactttaaaacttctgtattgagcagaaatggaggcgaaaatttccttcccctatggttttccttaacatcagggggtggaaagagagaagaacagttttggggtctttctcattagcctatttctgtttaaattactctctgttatacctcctttccacttatattaggttgctgtgtgatatagccaaatataccctgggactataccagagtcttatacccggtggcctcttgaagtcaggcaaaaagctggaagtaattttcagttatcctggccactcagcttcttcccagtctgttcttattacaaggaccactgggcagaattgaactctgccagcaagcaattgcacacccatcaacatttaaagcgggaaaggatgaagatgtctgatatggagtaggtgcttgtcttagcctgtgtctgcccacagcagatcttgaagcaaggcttccttagaggaagtttgtatgggaggtggtctcagggagtggcagtgtggttcggggagtggtggcgaggagagtaaaacacagctgtaaagcccagacaagggcattaccaacttggcttctcctatggacaactgaggttcatcccagggagtgttctgaggagcttatcaaatctgtctcagaactcccctgttctgagggaaaagaggctcctgtggcccatccatcttgggtggccccatgaaagtcaactccctgtacatctgggttgccaatccaggagagttgagggatgggtttcctttgccctgtcagaaaagcctcaaggtaggaatcaagaggtccttggtacaaccaggggcaagacactgtcagactgcacccaagggaaactggttaaagccaacatagaaactgtcaccacagcagtggctggaggaagagttggcaactagaagccttgatgtggtacttaagaggtgtccaatagggtgcttagtaaaccctagtggtttatctgcacaaagcccagcccctcactactgttaaatcaagtttagcctaaagctgcctccttacatattttaagctcgacctaaaggtttctctgtatatcatgaactatcacctaaatggagttgtaaagagactgtagtctactcttgcaccaaccactaagttttggccaatcaaaggtgaccaactgttcaaaccatgttcaaataagacaaaactgagctgtgaccaattcagctgtttctgtaagtcatttccgttttctgtatgtcactttcctttttctgtccataaatcttaccatgtggctgcactggagtctctgagcttcaggaggctacctgatttgagaatcatcctttgctccattaaactcttaaatttaattcagctaaagtttttcttttaacactacccacctcaggacttggagaccctgagaagttacataggttgccccaggacacaaagcatgctggtgacagagaaaattgaagagagccctcctgaccccctgttcacttggactttcagccatgttgcactgccccggctcaactaactgtacttaccactatggtagaaaagcttgagaacaaagtgccatgctgtcgcacctacaacatttaggaagaagttcaaaagatgtctgacttcaatcacggcaatgacaaagcagcaaatgcaagaaagaacaggatcaataaaagtcccagtggaattaaaaagaagacaagagaggtttaaaaggaaactgggctttggatacatactctttctgcttgtaatctgtgcttcttacactttctgagtttgaaaaggagtaatgtttttgtgtcacacttggaaattttgccacatgactgtcatcatgggaactttggaccctgttctggagctaagaatagctgagatactaattaggttgcttgaaaagtgctaaagaactgatcaagtccagagaattcacaatggaacttcatggccagaccgaggtctgttctaactaggattcttgtgttgccatcagcacatcaactgccccttgctttttcatatgaaaaactaatacctgtaatgatctcaaaattcaaatatttgagtatcagaatatttattctgatactcaaacatatgaataatgaaaaagaaatgtcgtggtgggaaccaataaagacagggtttggaggggccgaagatcctagggacggataaaatagggagatggctgagaggaaggaggaatgaaggtctcctactgaaatttaagcaccacacttctggacttgttttcttatgaattggttcttttttttaatgagagcaggtaataatattcctttatcaatgcatttaaagggcacaatttaatttagtttctgtagttaaggtgtgtagttaagtgcctggtacataacaaacaacagtgattaataacctactgtttttttattatttttattatactttaagttctagggtacatgtgcacaacgtgcaggtttgttacatatgtatacacgtgccaggttggtgtgctgcacccattaactcattatttacataaggtatatctcctaatgctatccctcctccctcccccaaccccacaacaggccccggtgtgtgatgttccccaccctgtgtccaagtgttctcattgttcaattcccacctatgagtgagaacatatggtgtttggttttctgtccttgtgatagtttgctcagaatgatggtttccagcttcatccttgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttatagtcctttgggtatatacccagtaatgggatggctgggtcaaatggtatttctagttctagatccctgaggaatcgctacactgacttccacaatggttgaactagttgacagtcccaccaaccgttcctatttctccacatgctctccagcacctgttgtttcctgactttttaatgatcgccattgtaactggtgtgagatggtatctcattgtggttttgatttgcatttctctgatggccagtgatgatgagcattttttcacgtgtctgttggctgcataaatgtcttcttttgagaagtgtctgttcatatcctttgcccactttttgatggggctgtttgattttttcttgtaaatttgtttaagttctttgtagattctggatattagccctttgtcagatgggtagattgtaaaaattttctcccattctgtaggttgcctgttcactctgatggtagtttcttttgctgtgcagaagctctttagtttaattagatcccatttgtcatttttggcttttgttgccattgcttttggtgttttagacatgaagtccctgcccatgcctacgttctgaatggtattgcctaggttttcttctagggtttttatggttttaggtcttacatttaagtctttaatccatcttgaattaatttttgtataagatgtaaggaaggtatccagtttcagctttctacatatggctagccagttttcccaacaccatttattaaatggggaatcttttccccatttcttgtttttgtcaggtttgtcaaagatcagatggttgtagatgtgtggtattatttctgagggctctgttctgttccattggtctatatctctgttttggtaccagtatcatgctgttttggttactgtaaacttgtagtatagtttgaagtcaggtagcgtgatgcctccagctttgttcttttggcttaggattgtcttagcaatgtgggctcatttttggttccatatgaactttaaagtagttttttccaattctgtgaagaaagtcattgatagcttgatggggatggcattgaatctataaattaccttgggtagtacggccattttcacaatattgattcttcctatccatgagcatggaatgttcttccatttgtttgtgtcctcttttatttcgttgagcagtggtttgtagttctccttgaagaggtccttcacatcccttgtaagttggattcctaggtattttattctctttgaagcaattgtgaatgggagttcactcatgatttggctctctgtctgttattgctgtgtaggaatgcttgtgatttttgcacattgattttttatcctgagactttgctgaagttgcttatcagcttaaggagattttgggctgagacgatgggattttctaaatatacagtcatgtcatctgcaaagagggacaatttgacttcctcttttcctaattgaataccctttatttctttctcctgcctgattgccctggccagaacttccaacactgtgttgaataggagtggtgagagagggcatccctgtcttgtgccagttttcaaagggaatgcgtccagtttttgcccattcagtatgatattggctgtaagtttgtcataaatagctcttactattttgagatacattccatcaatacctagtttattgagagtttttagcatgaagtgttgttgaattttgtcgaaggccttttctgcatctattgagataatcatgtggtttttgtctttggttctgtttatatgatggattacgtttactgatttgtgtatgttgaaccagccttgcatcccagggatgaagccaacttgatcgcggtggataaacgttttgatgtgctgctggatttggtttgccagtattttattgaggatttttgcatcaatgttcatcagggatattggtctaaaattctctttttttgttgtgtctctgccaggctttggtatcaggatgatgttggccttataaaatgaactagggaggattccttctttttctattgattggaatagtttcagaaggaatggtactagctcctctttgtacctctggtagaatttgactgtgaatctgtctggtccttgacttttttggttggtaggctacttattgcctcaatttcagaacctgtcattggtctattcagggattcaacttcttcctggtttagtcttgggaggatgtatgtgtccaggaatttgtccatttcttctagattttctagtttatttgtgtagaggtgtttatagtattctctgatggttgtttgtatttctgtgggatcggtggtgatatcccctttatcattttttattgtgtctatttgattcttctctcttttcttctttattaatcttgctagcagtctatcaattttgttgatcttttcaaaaaaccagctcctggattcattgattttttgaagagtttttttgtgtctctatcttagttcttcagttctgctctgatcttagttatttcttgccttctgctagcttttgaatgtgtttgctcttgcttctctagttcttttaattgtgatgttggggtgtcaattttagatctttcctgctttctcttgtgggcatttagtgctataaatttccctctacacactgcttaaatgtgtcccagagattctggtatgttgtgtctttgttctcattggtttcaaagaacatctttatttctgccttcatttcgttatgtacccagtagtcattcaggagcaggttgttcagtttccatgcagttgagtggttttgagtgagtttcttaatcctgagttctagtttgattgcactgtggtctgagagacagtttgttataatttctgttcttttacatttgctgaggagtgctttacttccaactatgtggtcaattttggaataagtgtggtgtggtgctgagaagaatgtatattctgttgatttggggtggagagttctgtagatgtctattaggtccgcttggtgcagagctgagttcaattcctggatatccttgttaactttctgtcttgttgatttgtctaatgttgacagtggggtgttaacgtctcccattattattgtgtgggagtctaagtctctttgtaggtctctaaggacttgctttatgaatctgggtgctcctgtattgggtgcatatatatttaggacagttagctctgcttgttgaattgatccctttaccattatgtaatggccttctttgtcccttttgatgtttgttggtttaaagtctgttttatcagagactaggattgcaacccctgctttttttgccccccatttgcttggtaggtcttcttccatccctttattttgagcctatgtgtgtctctgcacatgagatgggtctcctgaatacagcacactgatgggtcttgactctttatccaatttgccagtctgtgtcttttaattggagcatttagctcatttacatttaaagttaatattgttatgtgtgaatttgatcctgtcataatgatattagctggttattttgctcgttagttgatgcagtttcttcctagcactgatggtctttacaatttggcatgtttttgctgtggctggtacctgttgttcctctccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttcttcaagaatgttgaatattggccctcactcccttctggcttgtagagtttctgccgacagatcagctgttagtctgatgggcttccctttgtgggtaacccgacctttctctctggctgcccttaacatttttttccttcatttcgaccatggtgaatctgacaattatgtgtcttggaattgctcttctcaaggagtatctttgtggcattctctgtatttcctgaatttgaatgttggcctgcctcactaggttggggaggttctcctggataatatcctgaagagtgttttccaacttggttccattctccccgtcactttcaggcacaccaatccgacgtagatttggtcttttcacatagtgccataattcttggaggctttgttcatttctttttactcttttttctctaaagttctcttttcgcttcatttcactcatttgatcttcaatcactgataccctttcttccacttgatcaaattggctactgaagcttgtgcgtgcatcacgtagttctcatgccatggttttcagctcagtcaggtcatttaaggacttctctacactgtttattctagttagccattcatctcatctttttgcaaggtttttagcttctttgtgatgggttcaaacatcctcctttagctcggagaagtttgttattactgatcacctgaagccttcttctctcaactcgtcaaagtcattctctgtccagctttgttccattgctggcaaggacctgcgttcctttggaggagaagacgtgtgctggtttttagaattttcagcttttctgctctggtttctccccatctttgtggttttatctacctttggtctttgatgatggtgatgtacagatggggttttggtgtgaatgtcctttctctttgttagttttccttctaacagtcatgactctcagctgcaggtctgctggagtttgctggaggtccactccaggccctgtttgcctgggtatcaccagcagaggctgcagaacagcaaatgttgcagaacagcaaattttgctatctgatccttcctctggaagcttcatctcagaggggcacccagctgtatgaggtgtcagttggcccttactgggatgtgtctcccagttaggctacttgggggtcagggacccacttgaggaggcagtctgtctgttctcagatctcaaactccatgctgggagaagcactactctcttcaaagctgtcagacagggacatttaagtctgcagaagtttctgctgccttttgttcagctatgccctgaccccagaggtggagtctacagaggcaggcaggcctccttgagctgcagtgggctccacccagtttgagcttcctggcagctttgttcaccttctcaagcctcagcaatggcggacgcccctccctccacctcgctgccaccttgcagttcgatctcagattgctgtgctagcagtgagccaggctctgtgggtgtgggaccctccgagccatgcgcaggatataatctcctggtgtgccgtttgctaaggccattggaaaagcacagtattagggtgggagtgtcccgattttccagttgctgtctgtcacggcttcccttttctaggaaagggaattccccaaccccttgtgcttcccaggtgaggcaacgccctgccctgctctgtgggctgcacccactgtctgacaagccccaatgagatgaacctggtacctcagttggaatatgctgggagctgcagactggagctgttcctattcagccatcttggatgacaaggccaatatcctactgttattaaacttttcttctgccagagaactttgtccatcttttcccacttcccgagtgtatttgccgacattactctctgtactttttttaaaaaagaaactcttgattttggaacattttaagatttacagaaagttgcaaaggtagtacagagagttcctgcatgcctttcccccagcctcccctgttatgaacatcttacctaatggtggcacatttgtccagactaagaagttcatctgtacattactattaattccttgtacttccaaatagctgctgtctctttttcaggcattaattaggagcccagataattctaatgttgatatttgattgaaccaggatacttccttgtgaataagaagtgggctctataaattcaacattgtacacacaagttatcataggtctttctttctttcttttttttttttttagatggagtcttgctctgtcacccaggctggagtacagtggtgcaatctcggctcactccaacctctgcctcctgggttcaagcgattgtcctgcctcagcttcctgagtagctgggattacaggcgtgcaccaccatgcctggctaatttttgtatttttagtagagatggagtttcaccatgttggtcaggctggtcttgaactcctgataccatagatcttttgtagggtccatgtggtcctaacaaaattccatcacctctggcaggcccagagaactgctggttaattactaaaaaaaaaaatacataaagcagactcctattgaaaccaatttaaaatatgtgtttgagtattcacaaacttaccctcactgtgtttgaaaccttcaagttttttttggtgaacacagaatatctgtttttgaacaaaacattctaacctgatgtgtaaatgtgatatgctcatagaaagggagctgaagattgcagcactcttttggacatgatatttgatacaagttagattataagactcaagattttgaaaagggccccttggaaacttcccagatgagatggttcaatggggaacataccagatggaatgtataggcctctgtcctaaacagatgttgtacagctgggaaagctgtgacaagaaaatgcaccccaaatgcttctgatggacagatctctgtgcacacatgcacacacacacacacacacacacacagcgttttaagaatcaaaatattcagattgcttaaaaattagaatttcaggtgtcagtcaccagtggtgtatatatatatatatatatatatatatatatatccccattgttggaatggcccagtttgtcagcatcaaatccatagtccatctgtgattgcccttgaaactgatgaattcacttcaattccaacctaatcaattctgaactagtgccttgaagtcatttaaatagtaacttcctttgcacaaaatcttaagaccgtggagagtggaggtcaagagaacactagtaaggtggcctctgacttcttgagcttttgacattcagccaccagaggctgctctgagaccattatcctcttttcactccgggtccaaatcccaacggtgaaacctgtaaggactgattttgtttccattgctttgaattttccttcctcaatgcagttccctggaggtctgctgtttggagaagatgattaattatagttaaagaggaacagctgaaagaagaaaaaaactacagattactgttttgccctcctctctatttttaaactcttaatcttgttctgtttcttttaaataaaagaaaattggtcagggtggaaagagaaagtgctttcttactggcactggctaatttttcttcatttttcccctctgtgttgctggattttcaaagaacatttctgaagggttttaaatctttattccacaatacttacttccacatggtttctattcttccagattttgccagcattttatagttgctttcatgctgttccctctgttttatgtttttaaatctttgcctttctcctttctctctatctaacaaagcaaatccaaaattaaatggaatatctatagttaggtaagaaggattaaaaatggttttgttgcctctaacatattttgtagtctgggacaactaagcactgatttaaattgttaactgaagaatgaaaccagtttcttcatgtgacattgctttcaatcttcacgagtgaagacatgactgtgacagacaatgaccagcctgtcaaaaataagtgtttttatgttattgttacatacaccaccctaattattatacttccatatttatgaaagtaagttactatgtaaagaacttaagttctaaagccatggcaaatactaaattaatagttttgcagcagacaaagtaatcaatgtgtaaatgacctggagaatttcagcatgacaattctttcattctagacttattctttttttttcttagtaaaattccatgtctgattggaaaaggtataatttaaatgtatgcattcttatagaaggcatatagaaaacatgctcattttctacagattacagaaaaatcaattgagttgcaaggaaaatgaatacttattttattaatttctatttgcagtaaaagatggaaatgtaaagatttccttttgctctgaaaaggaattcttgagataccatgaaacattcctaagtggtatcatattcatagagtggaactatcattagaagcatttgaaatgtttggtatttcacctcaagtgtaatcataatggtaaagattcttaatattggtgactaaagtaggatacatgtgggtttatattttcaggtagaatactggcagctacagtatgtcaactggagcatatttcaccaaatgccttgacaaagatggaatgacaatgaaattgctagatctcttctctggggcaggttatgcttttcaacttgcccctactaaggagagtaccagaagccatttgcccatgagtaataccttattaaaccatcatgatttaatgtggcatatttttctctcaatttgcatgcctgacagtcgacttcctgaatatcacattcgagctgagccacagaagaaaaatagacccactgaagtagcattaggtcagcttcgcgggatgcattagcaacctgtctgaacaaagacgggggactcaggcgcagaaaatcataacgtggccccaggccctgggaggtggccccattgccttgcaaatgtatcgcatgactcattattaaacacaccaagaacagacgaattccaggcgagtgaagcatccactgattcaattgcagttaggtgggttgtacgatattcgtcttacttgcttttccttaaagaacacccacaccatctcttacgctcttgaacacggcacgtcaaatgcatgaagcaagtgtattaagataaaaattgctagcattaaatacaggcacttaaattagtataaccctctggccagatatagtgcactaaattgcacaggctttaaaatgccagcactcaatttaaaaaaaaaaaaatgtatccatagcaacctctttgttaagggaatagttaccaggaaggatacacatctttccagagaatcagagataaaaccatattagttaactggatgatattacttggatttaaatttaactagaggcatggttcaggagaaggggctttttaaaaactttacaacttatatgcttatttccagtaaaatgtgttttcatatctttcttattaccaaaagattcttacatatgggacttttattaaaataccatggaataactttgggtttcagatatttagaaataaatatcaaccatcctgttcttcctgcccacagcatgcctatcattttttttcttagcattttcttttagcatacacataggtattattctgcaatttttgctctatatgcatctttgatggtcctttcatggatatttgttaccagaaagggcacagggtcttgtaataacccacaatccttctattgtgaggtcatctgacttaagtcatcctgtttccaagagactttctctctgtctaatggagtggcctttcgtgcagttatgtcatgtgatgtgggctgtaggggagggggaaatgggggatgactaacagtgaggtgaagagcctgcaaataacaatgtctcacatttcttaggcaacgagtattggggaggaaatcttttcatctaccttcttctgttcaatccctgggggcctgcaaactaaactaacaaaagatagattaacaggagaaaaggcacacaattttaatcaatatttacatgtacaaggctgtgtttggaagctctagcctgtaattccagcactttgggaggccaaggcgggaggattgcctgagcccaggagtttgagaccagcctgagcagcatagggagaccctgcctctacaaaaaaaatttaaaaattagccaggcatggtggtgtgcacctgtagtctcagctactctggaggctgaggtaggaggattgcttgggcctgggaggttgattgaggctgcagtgagccataatcacatcactgcactctagcctgggcaacagagagagaccttgtctcaaaaaaagaaaaaaaagtacatacacaagagttcacacaaaaggagcaaaacacaaagaagcagctagactcaggggcttttaacatacccttttaacaaaggaaagagggtttgggcttcaagggataataaattatgggaaaatgactaggaaatatataggggaactaatgaacaataaggactaaggtctatttatacaaactcttcttggtatcaactccccatcttctatgataaaagtcattcttctctctctggtacagggggcaccttcttcaaagggaaatgtatgttctgcttttaggcagatagagggagggcagagaactcttccgacagctgttgattttcatttgactttagctcaaaataattattatgccaaagaggcatatttggggttggcatattctgatccccttcaggaggtaaacacatcaagcttggagcttaaattagtcaatgtcagtcagagccagcttcttgggcatacaacctgtgcagttacatgaggtcccacacttggtctaatggtagactgaatgggcatggctgcattccaataaaactttatctatgggcactgaaattttaatttcacatacttttcatatgtcatgaaatataattcttttgattctttcaactatttgaaaatgttaaaaaaaaaattcttaactcatggaccatacaaaaacaggtggtgggcaggcttgggctggagtacctgagtttgccaacccctgatatacagaagcatttccaaaaccaacagcatcggccctacctgggaacttgtcagaaatgcaaatttctaggccccaccccagactgctgaatcagaaactctggggtggggccctgtaacctgtgttttaacaagccctctaggggattctgatgcccactccaatttgagaaccactgatctagacctgtggttctcaaccttggctactcatcaaaattccctaaggtagcttttaaaaactctgctccaaggcccagcccaggtcaattaaatcagactttctgggggtgggactcaggcacccgtatcttttaaatctcttccaggtgatttcaatgggcagccaaagcaactaatggttccattgtacaaataagggaactgtagctcagagagtttaagtgacttgcccaagatacacaacaagaagaaacaggtacagcacagctcatttacgtttgtttttttagacatatgagggttagaatagtacatttggtaatggaatgtatttgctagaagcttcaggggtcaggttaccttttatttagcaccaattaatttaacacatctgaaaacatgccctaaataaaatgaaaactagctttggaaactcattaggccagacaatgcaagcgtaattgaaagaaataaggtgcagacgctcagcaaggtcccatctgaaagcactttggggctgaagggtgagctccatgattcaaaggaaagacaaatatggagagctaatgtcagacattgttgcctgccctggagctacttagaagtgtgtctgaacaattgcttcctgttcggtatctgggacataggtaaatatgttacagtcctaaatgacattaatgacagaaaaaaagtctccatgcttgtgatggattttatgactcttaaggattcctgtgccttgggcatttttaaggcgaactttcaaatgataaatattttgttctgattttctcagcaaagacttcatcatatcaaggaaggaagaatatgggctacgtacccaaaatagagctggagaaagcaatgcacgatggaaactgagtcatgcaatgattacaagtggagtcatataaacatacaactgactctttgacgtttttgttttatgagttacctgatcataatacaagctactatttttgagtatttactatgtgctgtgttctcctcatagttctatggttaagggcatgttttcaggaactggtcagcctgagtgcacaaactagtatctatggcctcctagctgtgtgactttggcaagttactttgcctctctgtgcctcagttttctcctctggaaaatggggataatattagtaccttttctcatagggtgaaggaagattaaatgtgctcacaacagtgtctggcttctaataagcattcaataaatgttaaataatattatttttaaacaaatcacctcaattctcacaataactttgagggatattaagcagatgggccaacttatcacaactattaagtgacaggattgatatttggactaaggctgtttccagcatcagtgctgccagccacagtgctatactgcattgattgggaataataaattaagtatttatgttcaattttttccatgtatagtataaacttttgggcatgatccaaatatccctggaccttcttgttatctggatgattttacaaagcctccagactgcccctcccacaggacactgaagcaaggttgtggtccctcctatcaactgctcctcctgcagttgtccccatctcagtaaatagtgacttcattctcccagctgtcccaggaaacaacctggaaacctcgtttctgctctttatctgacacatacagtccatcagcaagccacactcattgtactatcaaaatctatccaggaactccccaagtcaccccacttccagtgccacccccgtcccaatccaccatcatctcttaacatctcctgccttgcaggctgctctctgtctagcagtcagactgagctctataatatcaattggatattgttactcctgagctctgaaaccttcccatctcactccaaggaaaacccaagatccttctagtgatctactagaccctacaggatctgcaaacactgcctcaccaacacccacccacaaccactgcccccgccccccgcacacatacaccctcagacacattcctgagacttcagctcctactactgtagtgcttcctccctctgctccaacctacataggcttcctgcgttggttgagttcaccctggcctcacagcttctgcaatcactgtttcctctgcccgggtaactctgcccccatccatcactgtagttgaaagtcttgcttcctcacttccttaggactttgctaaaatatcaccctataaaatatagaaactcctcatcccattgacactccttaccccacatacaatagcccctatcaccatcagacctactttctacttatttgttgatgtgtttgtctatctcccttcactagaaggtatgctcatgacagcagcacttaacctatttgtacctgtctgtatcgtcagcacctagaacaatgcctggcacatagtagacacccaataaatacttactgacatgatcaggcatgttcagggtgttatagctgtagtccataaatacttactgaatacctatgaccgttctggcataaagaaggtataccatctttgttagcatatggttaaggcatgagagtctctccgattctttttcttatatgaagcacttgtctctatgcttgagatctttggattccctgggagtgatgaaaatcaattcatagagatgtacagatatctatctatatgttgctaatgaaatcgatggctagaacattgatgcaccaattagctctgaataaagaaaagtgctctaaggctgcattcctaactgtggaaatgaatcacacaaacgtattccactaggaacatcattcagcaattctgaatggaaaaggaaaacctcattcacagtcctagacaaagagccctaaaatccaaatcctcctctgcatagcacaataccaacatctttttccatgagggctactcccttaacagacaaatgcattgttttttcctacctctggttgattggatgaacacagcccaaatttggagagccatttaaggtgattaaaaatcattacagtgctggccaggcttagtggctcacgcctgtaatcccagcactttgggaggccaagactggtggatcacttgaggccaggagtttgagaccagcctggccaatatggcgagaccctgtttctactaaaaaagaaaaaaaaaatagccaggcatggtggcactcacctataatcccagccactagagtggctgaggctggagaatagcttgaactcaggaagcagaggttgcagtgagctgagatcacgccactgcacaacagcctggatgacagagcaagactgtctaaaaaaaaaaaaaatcattaaagtgcttcagtttgcttccaaatgtaatggcaaattcctgactcatcttgaaggtgcaacatgagagacttttggaggtagattgtggttggggatcttagaaccatctaagtggtaaattccatcacccccattgaggcacaggaggtgaaggagtgtttgtgatgagtcatgggcatactgcattttgagcctcattccaaaggggacctgcatctgaactagggtgccagcaccacatgctgctggaaagagtatgggttctcgagtttgagagatggattccgatgtcccatataccaactgtacacttcctgcatgtccaaaaagggactgatgtataactggtccatgatagatacgagagtttttcaattgcctgccttttaattcagcacaaatacctcctggtgggttatattatatcatattatattgtattgtgcatctctgtaatgtaggtactcgtatttttatctcattagacctctcagtgtgtggtgtatcagctggttttaaattcccttaattgggctaaattaatttgcccagttgaagaaaagtccacctatttgcgaattggttggtttctaaagatgaccataacaaaattatcttttttttccacacagatatagtttaggacaaatatcactagggcactgtggtacaacttaaataatgctatgaaaaagaatagttattttgttcattgtatgatgctatttaaatcactcacattaaaataatattaaatagcattgctatttataagataatgtagacaggcaatataagcccttccttttgtaaattaatgattcaaaggagaaataaaatgaagcctcatttgaatgtagtttctcagatatttagatttctttaataaatatgggaaaagctgaggcactgatacccatgtttgcatttttttcttgccatgactaaatatgtttattttgcatcaggggaataatataagaaagcctatctcagtatgtgttgattttcataagtggttctcaacagaaaaaaaaaacttatgacaagttacctagttataaggaaataagggtaaatattatttccttggccattaaaaatgttaaaaaaaaacacacaccatgatctgtgtgtaacaaaggaaagtgacacataaaccatgattcctaagtagtttttatctttactaccatcttagatccaggtatgtgtgaagtgggagaggattttcaccaatcagaaataacacaaccatcctggcaatctttctgttcatttaagtaccaatctaaaagataaagcattgactttttgtaagcaaggagcgcaaatcctgttcaaagcttcttttgattaaaatttttattcacctccttatgtccacatgcttatcaatgatccagcctgatttgcttgtttctaacatacaaaaaaagagatctgattcataaaagttaatatttttaatctctaagactaatttaaatatcagctttgtgcattaaaatattaaaggtttgagggactaatctttctcgtatataaggaaagtgagataaaagaataagaagtaaaatggttaaatatgaaggacagtaaccagctattcctagtcatacaaaaacccacaaaaaatggatttaaatcaagaatgataccaattaggaataagaacaaaaggtggttttcgattactctaatgaattattaaggtgtcttggatatagaatattcattcctggagatctaaaagaatgtccaaaacaatttggatcagaactgtctatatgtatctctggttacatgtggaaaaactatcataagccttgaacaaattaaagctgaaatggtggaaacaggaaatgccaatcaggtcatatgtgtatgacgtgatcacattacacttgggtttcagaatggaccattaggcatataatttctctgaagctctaccacgactctggtcatctatgggccagatgataataaaacactgctagttcataggaagtgactttaaggacaagaaattgatttaataaccagagagtatctttttgtttattttaaactaattttaattttatcaaagtaatacatgttcaacatacaaatgtatgaaagactcttaatgaaaaacagtaatccctgtcccatcccactccaccctagggacaatcactttcaactggcaaatatctcctctgctatgtatctccatatttcccataatgtgcctttactgctctttcctggtttatgaattttggatattattcttaacattctacatatgatcaaaaaggaattagccctcctcatcccaataccacattcttccaatataatggtgtcaggaattatgttcacccagtaacacagatcccaaaacattggctcaaacaaattagcaatttattttttcatagaacatgaagcttagggctcatttggaggctccaggatgtcatcagaaatccaagatccttctatcttttctgttatccagctttactaggtgttctgtcctcgtcattgttacagaaaggccccagtccctcagacattgcaaccattcctggtggagaaatccaggaagggcaaagagcaaacagtgtgtgttccctttaaatagctttcccaaaagccctacatagcacatagcagcttctattaaaatttcataggcctaccagacatggtggtgtgagcttgtagtcccagctacttgggaggctgaggcaggaggatggctcgtgcccaggagtttgaggctgtagtgcaatatgagtgtgcctgtgactagccactgcactccagcctgggcaacacagcgagacctagtctttaataataataataataataataataataataatagtttcatatgatcacctatacctgcaaagggggctgggaaatgttcttcagctgggcacatttctgccccaagtaaactgaggttctgttgaaaagaagcaaagggaagatgaatactggattggctaccagtagtctctgccataatatctatatcagaaatcactgccaagttaaggactgttctataacaatgcttcctttttttgtgcattcttttgttttgcctggagttaataatagcctcacatattgcttatatttatgtgtaactatttgccctcaaatgttacctatagtatcatttttcccccagagtcctaactccaggactcctccatcctcctgctacaatttagatggggcctttctaagatgctgcacacaactgcatgataattatgtagttattatcctggactttccttacttctttttatgttggttcctctattttctgggtcccattgacttatctttcttagtttaacactctcattttgctaaaacacatctttgagtggtttccaaagaaagagtacatgggatgcaaaaatgttgagccttggtatgaaaacaattgcattatattctgacatttgattgatagtatgacttggtaaagaactgtcagctagaaatcacttaatctcaaaattaaataaaatggagctcttaacttccagcactgcagttgataagtacataataaatcgattagcaaaatttcattattgataaagaagacggccttctactaatggagattttaaaattattaatattattattagtcacaacaactcagtaaacatttattgactgaccacacactctgtgcttgttgttgcaatggatatacaaatgtttgggcatgggccttgtgacggtttatgtgttaacttggctaggctgtagtacccacttattcaaccaaatgttaatcaaggtgttgccatgaaggtatattgaacatatatggtgaatatctacaatcagttgacttcagtaaaggagattatccttgataatgtaggtgggccacaccccattagttaaagcctttacagcaaaatcgaggtttccctgaggaaggagaaattctgcctcaagtctacagagtccgcacctgccagcctgccccatggatgtcagacttgccagaccccatagttacataagcctgttttatgtttctctggagagccctgactgatacaggcaatcacttaaaaaataattaatttaaataattttcctctttaaatttaaataaaaaattatagtaaaaaataaatgacagaaattgaagaattattcttgggaagtatgatattattgtattgaaatgaagtagaaagttcaattgggagtggagattttgaccacaggaggaggatataacaagcccttggtaaattcatgcataaaccatttttggcggctgaagcaggaggatcacttgagcccaggagttcaagaccagcctgggcaacatagcaagacccccatctctacaaattagtaaaaaatattagccaggcatggtgacatgcacctgtggtgccagctactcaggaggctgaggtgggagaatcacttgagtccagacggttgagggtgcagtgagccgagattatgccactgcactccagcctaggcagcagagtgagaccctgtttcaaaaaaattttaaaaaagtaataaagttaaatgaaataaaataaaaatcttaaaaattcatgcataaaccatttaccagattactcaagggcagataatgaagaatctgctatatttaatcttaagacaaactagatgctgttaaaatatttcacctttaaaagcatagaattattaaatagtaaggtttaattaacattaaaaatgacatgatttgctttgattccttaattttctagtgaggaaacaacaagcttagggtacatttctgactacatagattttttcccttctttccagtgttggtcatccaacacatttacacaacaagcaatagcgattgcactgggcacacttcccaatatatgaatttattcaagctgtgcaattgtcccctgagaaatcttgggcttagaggtatcaactggcttatctgaggtctattagccagttagtgaccaagtcagcacagaaaactgactccaagtcttatttggcccatccttgtggtatgccacattgtttcccttaaccaactgaaagaaactaatttaaggagtacctgtacacaggaagtagaaacttttttctctttttgtgactttctataagaattatagatgagatttttttttctaagtggggactcatgttgttgtcaacttaaattacctttactaatcacttcgaacacggtattccatacatttccctctgtcccgataataaaacaactggatttctgaaacctctgagggagaataaacatgctcttttcatagctcccaaagtctgtgcacttgtactgggcactgtccaggtggctgcatagacaacttcagcttgattttcattgacttttgatgtgtcctgacacacattaaaataacctatgtgaaattgctgatattcagccattttttacttacacaaacattcactccatgttctttgatctatgagatcactgagagaggtggcacaaatactgttaggtatcgtccaagggcgccacagcaatgcctgtccatgtctgagtagcgctgcctgtccaggactatccacccagaacctatgttaggtttgctacaaggtctgttaataaccaaacccgcacataactaacaagattatcgactaggctgctttttttgaagaagagctttcaaaacttccaacatcccttcagctaatatttgcaaacatgtttaatcacagatttgggaacagaacatctgttcgtttggtagagcaagctcttttactcacttcacctttcttttctttttcccttccttccttccttccttccttccttccttctttctttctctctttcttttctttctttctttcctttctttatttttttttcttttttttcggggtcttatttgtcgcccaggctggagtgcagtggcacaacctaggctcactgcagcctcgacctcctgggttcaagtgatcctcctgtcttagctccccaagtacctgagactacaggcacacaccaccatgcccagctatttttttttttttttttttgtagagacagcatttcaccatgttgcccaggctggtctcaaactcctgagctcaagcgatcatccgccctcctcggccttcaaaagttctaggattacaggtgtgagccacctcaccgggcctcactgtttctaataggtggatcaaatcctcactcaatgaacattctccaaaggaccatttatttcattcagaattttaaacatttccatttgtttatttgtaaatgaaaaagactttgtgtatccccacctttcattttttttagaggttttctgaaacatggaggcagcatattttatggcactgtgttagttcaggctgctataacaaaatactgtaccttagactgggtcatttataaacaacagacaattatttctcgtagttctggaggcaggtaaatccaagatcaaggtgccagcagatttggtgtctggcgagggctctctgcttcatcagtggctccttgttgctgtgtcctcacatggcagaaggggcaaataggctctctgaaacctcttttataagggtattttgctttaagggcatagaagatggaagggattaatttttcttggggcatttggggaaatcacgaatgagtggtgacatttgagattgttggatagttggtgagtgagtcaaaggagaataaaaatggaaggaacattaaaagggctcagtccttgagagaggaaatcccagctcatatttacctttgaggtgatgaaagcagaaggcagacgcagttgtagcttctactgaaggtgataaacagatgtgccatgggattaagctccagtatttaatggcaggagccctgggtagcttcctgtgtcctgtggctggggcatacctagggctgggatagacgcaatatttctcaaagtaaatcagagtcctttgtcagtgggataaaatgctgattctcaggctcctcagcaaacctactgaatcagattattttggtgcaggggcctggagatttgcatttttaacaatctccccagaggtttccttgcaccctcaagtttaagaaccaccctttcaaagcgtgatttcatcacccaggagacatttggtaatgtctggagacattattggtcatcacgattgtgggggtgctactggcatctagtgtgcagaatccagggatgctgctacacatcttacagtgcacaggacagccctcacgacaaagaattatcctgcccaaaatgtcaatagtgctgagattgagaaatcctgaactccatcatatgaagggctctcaaggaaaagtacaagaagtggactgaagtcagtttgtgtcactaggtggctccttaggctactcaggcagggggctagcgttatgggcttccaggcccagttatcggaccaccaaattttcacagaactgggcagagctcacatgtattgaacccatgcagctgacactcctgaagccaccaatgcattatttgctaagtaattttttttcctctgataccaacacatttaaaatctttattgaattatcgtcacaaaattgcggtcatttcttgggggaaaatatgccattagttctacacaaagtactctttgctcaacttgcactttcttgaaatccagaaggtagatttacattaaaatcatgttggctaagagttgaaaaaagttattgcttatatggagttaagaaagcaaactttggaaattttttttggtctgagtttgtttctaagaagccaactacttctccagctctcctgcaatcctgccaaggtgatgtccagcttgtccctgttaataagttcaacagatcaaccctgtagggaagccaaaccatagagaaaggtggatgcactaaatttttttttttctgaacaaaatgtcagtgtgtattgttctatgacaatagtgttatttgaaattatgcctcgggccttcagtaggtaaagattcttgttcatttgctgcatttcaaaaaaattgtgtgcacgttcccattaagatttatttttcttaaattgaatatacagttaatctatatgcagatgaggtaggtaacaccctcctttctggattgttcgttttagttaaggtgttactcataacaatttggtttcctttccagtcttttgcaaaagtagggcttcagtgcaagatatccttttaaaaatacccttgggtcctgagtgttgaacttttctggctgaaataattttgcaccttccaaatgttttaatgctgttagggagctcttaaaatgcaaggatttaaggcccttagctagttaagcttttagcagaactagagctgttagataagaatagaactcatcctttacttttggagctttggacattgtttccagctgcttccagtcatttgaatcccgaaagcgcccctaatcctcgcggaggcagcctttctggctcccaggacccacccccttgcttctgattggcgaagctcctccgcggcccaagccagccacctacaacgtctctgagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcaggtaagctcaggcggttgcgctggcggcggagggggcgggcgccgcccgggacccctgcgacgtgttactgcggagagcttgctgggttagcaggcgcctggccgtagtcgatgcgtttggcggaaagacggggctgcattttcctaagacaaccaaagaagcacattttacctgagccaccccggtctggtcctcgccacccgcccccacttttgcctctaattgtggttgatgtcaggcagtcgttgtaaagggcttacaagcagtttgtagaatatatgtaaatcaattccagtttgcggccgctggaatgtatcgtgcaggatgtatctcgagcttttagtgcctctaccctatgctttgggctagaataaagacagctgaatgtcctgaaaaagaatttcacggggcctcttatctcattttggtttcgcattctgagcacttactgtgtttctggcggagaaggcggaaccagcttgaaatgagcacagacagtccttccagaaaaatgcaaatttgtttttctgttctagcagtttggaaactgtattgcttctggacgtgagaaggcagccctgaaagtagtgagcggagaaagggctgggggattacttaaatgagtctttgaaaagaattctaaaccaacagcttcttctgtggctctggggcatgatgataaaattccttatcagtccaggaagaggtttatagctttgctgttaagcaagaaaaggaaagaaaaagtggatgtaggaagccaaggagagggtgtgatttacaactcaatcaaagttatggaagaattttatgtcaatatttaaatatcaagaacaatactcatataaggagaaaacaaggctggaaaaacatgccaataggcttggaagggcagggatttcaagaggaatgctattgcttttaccagctctgaataaatctggatgggaaagttagcatctgtatcgcaaccggaaaagctcttcactttttcttctaagtgggttgggtgctcgccaccctgcacactttgggggaagtgagctttccatttaagagcgcaggggaggggtttcgaactttctgtccctttcccacagccttgggagatgaagcagagcccccttcgaatggtcagcgcaaaccctccgccttcttgccccctcgcttgttcgctcagcaagcaggcttggcaagtttcagtgagtgcagaaaaacacttgcggaggagcaagtgccgtctgcttgcaatgaattgcccttgccttggtagggactgtggggaggacgtctttaagttctgcaaactcacagtccaacctcatacttttaatgtctactaaagtgggatgaggaaaaggaaggagaagggtaattggaaaggattgaaaaggaaaaagaggaacgcaaaacatttttgacaaaggtccttagctggaacaaagaagttatttgatcctgtgcagagccacctgtcctctcctcggtggtgtctgagctcaatttccagaatccctgttcccacacaattcctcaggaaccatggcagtctccgtgccttatgcctaaggtttgcttcccccagcttggaatggtttttcccatgcctagtttgttgtggcatttacgtgaagttggaaaacagcccagtattgaaattttaggggtacaagtacacatatagtgaactccttagttatttaatgaatgggcaacttttcatctcacagctacgtatgtctactaatttttttggcctgttcagaactttgaaagagggtgggatggaacaggggaggagatgaaggagagagacaggatcattgttcatccaaagaacgaggacagtttccagaatctagcatgttgttccactgcagtcagaacaagaatgtagggaggaatgagatggcagtgttattggcatgggttaatccctactttatttgagtttctcttggggaaacctgactgttgcatccaggcagggtgagtcgaattcaccagccaatttgtcatctcagcccggcagctccagctggatttacagggttaactatcaaacagacctgtgtgtcatcagctcagcaatgaaattggatctctttgctgatgagtgatctgtccctagggctgcacaaatgttgtacactggtgtggcagcccagaagagacccctgcctgccactgatagccagaaattctgggtagccagaaattgcccgcagaattagaaggctgtttgcctagctataagattcagaggggtttgggcttctgccaggttggcagaaaaggaacattcctgaagccaccacttcaggtgtagaaggatagtattctttgagggttcctaaggccacggctgagttaggccaaagaaaagtgtaaatctgattcaccttgatcaggaagtaattttaaaatatgtgccaacctgtctctgccctctgatcataaacgggaaacttttatgaaccttccttgagaaggaatttgctctgttcccaggcaaaaggaaaagcatggccacctgttctagaagcctggccgaaaacaacaggtttgcctgtggcattcccgcaactgcatatatcctccccacatggcaagccacccattgtccctacacacaagaagaacaaatagttcattcttgagctgggggaaaaatcagattctctaggcaaaattgcctactagacatattttgtgtttttaacatcctgataactttagaaaaaaaactctaagggaagaaggtgcatgatgtatttctgatctactaaaacaaagtaagtcacgtagctgctaaattcttgcaaggccaggatgctgctgtttcaaggaagccgtgaatctgtttggttagcccgttctgcattctttagattggaattaaaatgcccaaggacatctggcttaataatgaaagtcttcgtattaatctttcctctgaggattagaaagtcctttacaaacacgatctatttattctctgccacatccccaggagagaatgaggtggcaatttgatcctcattgaacaaatggtgagacgaaggcagagaaaggttaagtataaagagacacagcaagttaggggcaagtctggggatgaatactcacccacccagaaagactacctgtgcaggtttaggatctcaaatggcattctagggattaaaacagaatctctcttacgacattctttttcttatcattctgtaactggcaagtatattgtgtcccaagtatgttgtatggtttccttcatttgaaagtccagactcttaacagttcaaaaggcagttctgttctcatttctcccaacattgagatcaggcagcttttatgaaatctaatagaaagatacagtaactaactggaattttaaatatgcatctgagaaatgttccctttcaacagatgttttaagtttttgcacatggtttatagagctcagtgtcttcaacatatgttaaaattttaatttcttctctgctatctctctttcagcaaatgttataatcataagacttgctgtcagtttaaagatccttgttggtcattttgaaataatttttttgagtcatgtttttagttcgcttggctgtagaccgcataggctacaagcaaatccgttaattggtagttgcatgttatccacagacattccagcaagttttaaggctaagtgcatatgtggatgtctcctggctttgatcgtttgtgtggtaaatagacatccaaggtagctatggcaacctgggctgtgcgttggtgaaaggaggggatttagttactggacaaagagtaatttgtttgattagaaaaaggtaggggcaaatcaggacatttttaacccacatgatttgaggatcccagttcaatcaaatcatttggatttttctcaataggcaaaaagaagtaatggctaagcgcaccagagtatcttgcagacgtaatttaattatttttaaacaagtggttgctactttccaaaagcaatttatacaatgaaaaggaagtacaatatatcatataaatatcatcaatatccctattgtactaagtatgaacgtttttattttcagaacttgatgggactttgaaagaccaggatctgattagaggtgtgcatttcagttatctacctgcaggggtcaggcttgaagttcccgtggtcggaagatcaggcagcggacttcactgcagggagcccgaggcagagtcagagagaattgctctgcttatttggaacaattagttagcgattctttaatcttgtgaccaaagctactatgaaaatgagttcattcaaggaagagaatatcaaatacgctgtgattaaagaaagggcgataaagccaggtcaaacagcaatctaatctccgtttacatgtaaggcagtttatcgggaagattctggctcattatcaattcctttgatttcacacaaaagtgagctcagcggttttgttctagaaatttgtttgcccagttttatgagctggcatgttataaaaatttctttaaactaaaaaggacacaatattagggagccatctggatccgaaatatttttccccctctggaggaaaatattccattgacacaagatcaggatggttaatggcctccaggaggtcaggtgatagtaggagcacagaaaattgaggcgcagaacaaaatgccaagaggggactttcctgaaaaaacaaaccagaccaaagaaaataacttacctgctttgcgctatgaaagagaggttctgagtaaacatggaagaggtgctgatcatttgtagtacaagtggatgttgaaggtcttatattcagtccagtgtttatgatgaatataatataaaggctgtccttcctttcttatatcattcaatgacatttactgagcactcacagaattaatatattctgccacattatacgtgattattaatgtgccagggcactttctgggttccaaatatgactttggtaaggcccctgccctcaaagaacttttgatctggtgtacaatttattgtaccagtagcataatgtaggtttttccatggtcaaaatggatgctcattaatatctatatttgtatgggtagggatccacttgaaaaactgatggtatccaaaaccttactgaacttaggagacttgagaagtgatttgtaattgtgaaatttagttgatttttagcccacatgtccatttgtagaaatttatgacttcttacataaagcagatttctcataattattaaatagtaatttatttttctcaatagagaaaagtaactcataggtagtccccaatctaggaatactttatgttttaggagtttgttgtttgaaacccagagcattttccagcgaaaaataatcaatctgattaatgtgagatcaagttctgtgttttgaggacatgccactgtgttatacaggatggaaacagaaggagaaagaattggcatacttttggtaataggccagtcatggcaatatttgaaataggaagttcgtactagttttcacctttctttctccatccttctgatgtcttctggtctcactggggcatctcccccaggcctgtcctaatatatagtgaattcataattgttcatcttcccacccttcccttccccacctccaaaccactctcctgtttcctttagtcaatggtctctaccacatggcaggaaagaagtaatatgggtgagccaaagctcatgactcttatccctttaacccttaggatgaatctttaattggggaaatttcaagcagtggagcctggagctacaaaacacatgattttcctttcagggacaatatttgggggcagggccatgcctttggcagacagaacttgctggtgtgtctgcccgtgggtcagacctcttcatttgttctttctcagcaacctgcctgaacttctggacccactagggtctttgtgagtaacagccagggagccacaggcccccagttgagagggaattatggcgtttgtgggtttgggttgtttgtaagtatgctctttgtatgctgagcactgtctacttggattagaataaatggaaagaaaatagctgtagcatcctcttatccacacgagtatttgagttggtgtatatatttctactcgtttgtctgcttatcttggaactgagttactccagagcaagagtcacatattaattacctttgaatccccagacccaagcccagtgtctggcacacaataagaatcattaagtgttctacaggcacatgctgggtgaattttagtaaaaaagagaatggaaaatgctccttaaaatccgaagggatatgaagaagaaagggcattagaaaggtccgggaaacagcaaggactaaatagatcagtagtagagaaaattagcataggttatgattactgaactatatgtatatggttttatatatatatagtccatttatatacacatagtctctctctgtctgtctgtctgtctgtctgtctctctctctctctctctctctctctctctctctctatatatatatatatatatatatatatatatatatattcctttcagttgtgttctgggcaagaacacaacccaaaacatggtaagcagcttggcttatcctctgtttgattgttctgcagaaatgattacgaaatgggtcatgccctccaatagctcaaagcctaatcgccaagatagaatctgctgctttctctcattgaacccagcctgatagtttaggccttaggtccatgtgcagttgtttaattttgcaggtgagtggcatgcccaaggttactccagaactgagatagcgtgtctgagagaagactgaagccttctccatgtagatggtggccacatttttcatagtgaagttcaagatttgtgccggacaaagcattttcattgctggtaggtgtaacagaccagaagttatagttaaaaatgacaaaatagaaatttcagggacatttaatagtttatggaaacaacaggactaatatattaccaaagggtctatgcggtagactgtggtatctgtcctatgtcaagttttggagtgttgctttggttgtgtgtatttagaagtggtcttccccaaacaattcggaggaagggggatgttactgggaaaatggaattcattgaatgccctgctgagttaataataagtagatgaatggccaaataaagcaatatatagatggacggcaccaccaaatattattaatagagatttatttacttacataggatcaagtcttctgtacgaaatacattaggaatccagactaagaatactggttaaagtttagcatttctgggttgacgttttagcacaagaaacactttaccctccatctgggagcaaggtatgagggagacttaggttctacacctagaagctaagtcttctagactccccatctcattctcttttgtgactgtaccacatgccttctactaagatataatttggatgttttcaggtcatgtgctataattcaatatgctaataaattccaaggcaatttgaatggaatgttggtttataatgaggcaactcaggaaagactacatcatctttagtggaaaatactgtccaaaaaatccaaatagttaaatgatcttatatttgggttttgtgcttcttttatgtgtatattctttgctctgattttagttaagtatgaaaatgtcagacagcaaaaactaggaggattatatttatataaaagaaagtttagggaatgagatgagtcatttagcccatgaattaatcagctgtgctttgaggaaatagtgcaggaaggtaaaatggaacaaatagacgagagaagaaagcgtgacttcttttagtcaacatatgatggggaaagcggtagagaaaaattggctatttggtgagtgattcacttgagttccttttcagtggtcaatgtttaaagtgaaatcctaatgagattgttgctgccctttttgtacggctctgactaaaagagggaaaacagtcataataattaattgagaggggtatgactttctgagtagataaaaacatgatagactattagataatgaatatttattgcttgatgcttctcagtctggaagagacactttctgaatatttctccgctttctaacatttcagctgtcagaattgaatggttcacatataaactacattgttttggtttaactaacaaagagtgataagacatgaattgtttgtgacagccccgaacattgataacagaagacattaatgcctgcagacacagcctacatggtaaaaatctggaaacaaaaatgcttattatgttaggccatcgtgctttgacctagttttgcttttctgcttggaaattatgtcaatattagttacatcatcccttcggatgagcaattccacattcttgtttatttcagtgtcatattattagtttttgtatatttagttctgacctctgaggagccaaactaatcctcattgacttgcattttccttttgaaatgagacttctgcatgataaagagagaggattttatgtattaacaaaacaatctaagatgcctctttaaaggcattcatttctccttgatccggagctactgccctcttgaaggttcctagaggccatccagttttctgctgatcagaattagtctttttttctttgtcttatggggatggaatagattactgggcctagaactgccatagttgaataacaaaaagtaaaactgtgaggctgatgggacatttcccagcccatcatccttaaatttgcccttttcatgtttctgctttacttcttcatccagcagaaacgggcttagcatatttttcccatttaacatttttattgaatacttttcaaaatgaattatttccgcagttgatttcgaacacatttttttctgtcatttaatactttatatcactagaggaaagaaccatttaattctttcatacatttatgaattctaatcttcaaagagtgtgagttcttcaagtgatcaacttacatcaaatttacaagtataatttactaccaaaagaccttgaacgctttttggtgcacatgttttggcattccttattaacaaatgtaatgaggcaaaagcccacaagaatatgtattcctggttcctctttaaaaatgtaccatttgctcttattttctaattaaggctttgaaggttaaaaatccctttgttgttagctcctttacaagtctcctgcctgagtgcagaaaacataagaagggagtgtcctcttcagagcataaccaaaccaactaaattttaaccaggtaaattgttgattagcattggatcatgtaaagaaacagtatgaaagtaattgagataggcacaactcctaattgtgtgatcccagggggcttcaaacattgtttgaaacattcacctcagagattatattccatgtctgatccttatgctaatttgaatactaggatcctgaagaaaaactttataggatttcttgagtccctaattggtatgtaaacatcgtcattcccaagctgcccaaagttgtgaattatagtataccatgtgtctcctgttgtgatatcaatttctacagcaatttttctgcttgttgtaggcaaatgtaaatatatttccctcctcttacacaaatagtggcctttcacatacattattcttcaccctggcttttttctgctttagagtataccctagagatctttccataacagtccacagagagcttcctctttaaaaacaaaacaaaactgcatatcattgcactatgacgatgtaccataattgatttgacccttcccctactagtcacgtggagtgtgtccaatattttgccattaaagcaatgtgcactgaaaaacgttgtgttcatcagtttgtatggggcggatgtatctgtattaaaaatccccagaagtgggattgctgggccaaagggcaaatgcagtttctaattttgataaataaataacattgtctaaccagcctgtgtgagagcactgccccagagcctcatcaatagagagcattgtccaacttgtgcacctttgcctatctgatatctgaaaagcggcatctctgtgtagctttgcattctcttctgagtgacgttgagtgtctctgcatgtgttgaaggtctatttgcatttcttgtgcaatgtctgctcatatcctctgtttagaaaaacaaaaagaaggccgggcgcggtggctcacgcctgtaatcccagcactttgggaagccgaggcgggcggatcacgaggtcaggagaacgagaccatcctggctaacacggtgaaaccccgtctctactaaaaatacaaaaaaattagccgggcatggtggcgggcgcctgtagtcccagctactctagaggctgaggcaggagaatggcgtgaacccgcgaggcggagcttgcagtgagccgagatcgcgccactgcactccagcctgggccaaagtgcgagactcagtctcaaaaaaaaaaaaaaaaaaaagaaagaaagaaagaaagaaaatgccaggtctagtacaacgatgtttgatgggtttttttgacaatgataaaactactatttagtaagagaatcactcccggcagtagacttagaagcacactatcagagaccctcgagtaaagaccctaacgtgccacatcttaactctgtgaccttgggttgattccttaaacttcccaagtttcctcacctgtaaaattgaaatgatgtggacaactcacagggtttatagaataatcactaaatgaaggattatatatataaatgatatataaagcacttaacagagtattggttacatactaggcacttaaaaatgttaggttaacttctctttttttaggtacaaacttaaggtttcagagaaggctgggttttatggacatttctacctcttaccctctgaatgaatacacatccacccacacagaggcatgtaaatatacacatatgtacacacggtggaataatatctgaaatggctgtaatgattcaaaagcatctctttagacaaatgtgtgtgtgtgtgtgtgtgtgtatgcacgtgtgcatgtatatgtataaatatccctgtaatgtaagaaaactaatttgttgctaaaaatgtacccttttcggacaaattatcctaatatgctaaaacaacaccaaatagtattaaatggacatgatcacttatcactacctttcatattataatccaaaaaagcatatttttccttcatctatcttattctttacaacaattaaactcttttacaatgttacacaccttatacttacagctatacctagaaataaaattacacttatactcatgtttatgtatttctgtctttaaaacaaaaaaataaacacagcagtaaatacaaaaggtagaaatggaaaaaatgcattttagagggcatggtgctgagggctgagaatataacactggtctttaaaacaactctaccactgtgaatgagaccatttgggtgatcttgtttcccagggctgtgttgttacagaaacataattttaaaaattgtattttgaaataattacagatccataggaagttgcaaaaaaatgtactgggcagtctgcaccctttacccaccccttaccccatccctaacccccagaaaccagtaatcatctgttctccatctctataattgtgctacttcaagaatataaacgtaatcatacagtatgcaattgtttgagattgacattttttcccgctcacttaattttctagaggtttatccaagttgttgcatgtatcagtcgttttttcctttttattgctgagtaatgttccttggtgtggatatatgacagtttaatcatcaacttgtttaaggactttggagctattacaaacaaagttgctatgagcatttgtgtgtaggattttgtatgactgtaagtttgcatttctctgggataaatgcccaggagtgcaattgctgggtcatatggcaagtacacattcagttttgtaagaaactgccaaagcgtattgcagagtggctgaatcattttacatccccaccagaaatgtatcagtgacccagctttctctgcatcctccccagcatttggtgttgtccctgttttcattttagccattctggtaggtgtgtagtggtgtctcatttgtattggttttcaaaaagtgcagaagatacttcataatccagtttgggtgtgttcaatacctcccaggtaaaattctcacacataatatgggcctatcttggtacatgactgaattgtcaaaaatatctatgattgctgccttttttgttgaaccttaactgaaatattgagagcaaaaaagaaactgtgttgtgcaaaatatatccgaacattagactgggcttcaatttatactctgagacactcagagaattgttacttgctcaagacatggcagatgcacgccccaacacctaacttcactttaggaatagacacattaggtatcaggaaaaattgctaagactatttaaattcctctccccttttccaacatattccattgcctttgcatttgcataaattaaataggggcatgatctgtcttcattgtcaatatacatgtagatgtgtgtaaatctacaaacatacatatacacagacatacatacactggctctgtgggcgtcaatcccaaatgttccccaacatccagtctagattctcccgggtcaggatttctcaactttggcactattgacatttggggtttcataattatttgtggggctgtcctgtgcactgtaggatgtttagctgtatccctggccttaagcaactggatgccagtaacactcccatgcccccaaagtgtgacaaccaaaaatgtctcagcacattgcaaaatgtctactgggggcaaaataaacctccctttgagaatcactggggtagacagaagagaaggagaatctcaggcttcaggttacctcactgggtttgctgaaacttgataagaatctccttaccagcggggatcaggttttggtgcccacctgttcatttctgataactaccaatctctaaatctgtttctgcaagttatggctgaagattagtggttaacagagaacgatatcagcctttgtttcttaaagagcttatattcaatgctttaaaatacaaattggatctggcactgttgtggttcacacctgtaactccagcactttgggaggccaaggtgggaggattgcttgagccagggagtttgagaccagcctgggcaatatactgagaccccatctctacaaaacaaataaaaaattagccaggcctggtggtgcaaacctgtagtcccagctacttgggaggctgagtcgggaggatcgcttgagtctgggaggtcagttctgcagtgagctaagatggcaccactgcactcgcctgggaccttgtctcaaaaaacaaaacaaaacaaaataaaataaaacacaaattgaacacacataattgaaaagcaaacttcatgcatacctggttttgttttacttttaatgatgttttatcacttatattagatatcatgattattttaacagatacaaaatttaataggtaataaaatacctcataaaatagggtatatctccatatgcatagagaattttatagagaaattggcacaattcctggatcttcctctgattcaatgtgtttatctttgaattctaataggttttaaaagacatttaaagaattgcaaaacaggcaaaggaaaatatgatagtgttttataatttaaattatgtctacatggcaacaataattattatataaattatagaaaatgttatgtattttttaactttataaatttacccctacttgataaataatatattttgtatttattacatttggtatataaatatatttctactttagaattaaaataaggtgaaaatagttattttttgaaatactgttaagttgcatattcttacctgtattagaattaaaatatgtatcttatatttatatataaattacaaattacctgaaaaaagaataaattataaccgcatgtaaaaataaaatattcctgtatcagttgtgcaatttaaattccggttttagttttcattctttaagttgttacatttggaagatttggatagtagttatcatgaactcactgttatctatggctctgacagtaaaatacgccattgagttgtactgtaatatgaatctcccgggaacgctaagccaattcagaatgaggcattcctgtctcaggaatagagatttataaagtgaccggaggtatcactatttctagaggaaggtgcaccttgaagtattctcattcttttctatgcatttatgatcccagcctactaaactcaagcaacacttcaatacagcaaagcctcttggaagtatatgagtttaataagaaaatttatgaagaaagaatacactgaaatgcagactgacccccaaaataataggatactttttaaaaaatgtattagtttcatagcatggcaaataatactcaaaaatactttgaaaatgcacattttaaaaatgcccaaagggtttagtagattatgttgagagaaggcattggaggaagaaacattatagccataagaaccaggaaaatgatcctcctttgtttataggattacaaagaggaattttaacttctaaagtgaaaatacaaattacttgtgtaggctaaaatcacccttcttagaggaaatggtacaaattttcttcatatagtttatgttcctccagaaagtctctgtgaagtgataacattataactgcatgcattctcctggtgacttcatttaaagtctgtgatgtagtaacatcatgcacacttccctttcctacagagcccttatgttctctatagaccaagaggttaattaatttttagagttatatagcaaagagttgccagaaccccaaataacatatctctaatttccaaaattgcctgacaaactatattttaaagaagccatgttattcttaggataaacctaataatgtcactttaatccccagtcatgctcatctttgcctttcttccaatatgtgcaaggaatatataaggtgaccttttaaggttacagtatcttcttacaaattagagttgatgcactgaggttataacagcagctgagcattctcaaaagctgcagattgagccgacaggcagattagcaagtacataaaatgttagtagagaaaaaaaatagacttcaattttttggcaatcctgttaaacaactctgtgaataagtctttgaaacttgtacagtggaaggtttgaattttcctcaatgcctggcacaaaacttacctatctgttgcatatgtgcattgctgaattaattaatggaaagtaaaattttaaaatgtaaccttggttatttgggataaaatggcacttccatgtaatggaatgtcataactgaaattgtagggattttcagatactctagctggcactaaatctcatcagagcccttcaagttataacataagatagcatattcaatatgagaaaatatttaattgtcagccttaaaaatgtatatagcagaggcaatcccttttttttctgacaacaaagccttctaaaagcttttcaaactatacagctttgagatttataactttgaaccaagaaaacataatttcaagaaatgaagagaacttctgattaattctagtctaaggcagtgaagtcctgctagattttaaagtattatattcttcataattaatgtcaagataggttcctccctgtggctcattattttcttgtaaaaagtacatactgcctgtgtttttaaatttcaggttttctcatgccgctcttgtctaatgatccagcaagttcaggcatataatacttttgaagaatctatatttaaagactaattatttatgcatgtgtgtctatgtattttgaaatatatatatttcaaaagactgtttttagcctttggctcaaatattttttttttaaggaatataatattgaatatctggacaggttaaaaatctccaacatttaactataaatgttaactaatgctttccttttcatttgttaaattgctgcataaatgctttaaaaagtatgttaccgttggcattaagacatcatctcttttacttaccaaagtgcaccaatctttgggattgaaccattgtagctgctttaagccaaaaattctccccagccgggttccttatcatcacccttgccacagaatctatatcgttgggagttaaagatctttggtctcaaaccttatcctggttgaattcctgtcatatcaccagcaacccctttctaatggcccccaggaatgctagcacaacaggggatcttcaggaggctcattccaatgagagacatcatttgcagtgacaaagtttgtccttagatgaaatctgtatctctctctccctatagcttttacccctgtttggccccctctctacaacacagaacacgtgcagttactctgttctctgacagctcttcaaagacaaagctaacatggccttctgggggcattttttccaggttaaatatgcccagatgtgcttgatttggactctatcctttaggatcaagccatgttagtaagtacaaatgtccaacatttaaaagaactgttcataagagagactcaccagattagaggaaagagataccattcagtttctaatacacagtgaccttaatgccactattttaagctctctctgcctggattgtagagactttgcctagtttacctctggaatagaaattctgaacctttgctagtgagtgagcaataacaatgatgacagacatctagctagatactaagaaaaaaagtcatgaatgaccaaagtgtgaattttgtttctttgcttgtctgataccccatggctatttgcaatatcttattgtcatgtgctaaaggatttaggatattaatcaaagagaaaagcggttctaagatggaagaaaagacaaaaatgtgggcagataagtaggaaaagaaggggatgaggattcaggagctttttccaggtacttggaaagttgaaggcaacttaaatcatttttaataatttaagaaatatcatttttcatttttatataaaatactaaaagtctggaaaatatataggcaggcacagtgtgttggcaatatgctgtttacaggttggcaaaacaagccagtgtctaatgaaaaggaaggttgcgaagagcttagatctgaaactgagaggcatgtcttgttccacaccttgagaaacacttggcatataccaggtgctctgtaaatatttgcttagtaaatgatagaatgagcatgtggtggcagaatgatgccttacatggcattacccagactcataggcatccctagggactgtaagaaaagtttgtgggcttttttcagcgttttgaaaaacccagaagatattgtataattactttttcaatgattgttttatcaaatacttctaaacctgaggatttatgaagttaaaagtgaaaaggttttttaaaaaatgttatgccaaatgagagaagccagtcacaaagggccacatattgtatgatctttttatattaaatgtccagaagaggcaaattcatagatccagaaagtagattcgtggttgccgggggataggggaggggagaatgcggagtgagtgctaatgggtatggggtttcttttgggagtgatgaaaatgctctggaattaagtagtggtgatggttgcaaaactctgaatatactaaaacccactgaattatacacttgaaatggatgtttgtaatgtgtgaattgtatctcaataaagctgtttttaagaatgataagcatagcatccaagcatttaaaaatttttttaaaagtggtcattggtggtaaaaaaaaaaaaaaaaaagtcagaaactatttgcttaattgttacagagattttatcccagattaaaatactccaattccgcactttgggaggctgaggcgggtggatcacgaggttaggagatcgagaccatcctggctaacatggtgaaaccccgtctgtactaaaaatacaaaaaattagccgggcatggtggcgggcacttgtagtcccagctactcgggaggctgaggcaggagaatgggcgtgaacccgggaggcggagcttgcagtgagtcgagattgcgccactgtactccagcctgggcgacagagcgagactctgtctcaaaaaaaaaaaaacaaaaacaaaaacaaaaacaaaaactccaattccatttcgccaaagggaacaagcagaatattcccacaaccctagggaacaggggtaggcttggctattagtcattctccttcttccccattcccaataattggaaaaaaaaatgtgtgtgcacacgtacgtgtgtgtgtatgtatatgtctgtgtgcatatgtgacaagggcagtagtcagagcaggatcatgtgactaccaggatctatggacagccccacactattaggggagaaagtgtcaagctatttgtacggttcttatagagcatgaatctaggccaggggtcagcacccttgttcataaaggaccagacagtaaatattttgggttttgtggccatgcagtctctgtccaaacccctcagctcgacatagactatataaagcaattggaggtaactgtgttccaaaaaaactttatttatagacactgaaatttgaatttcacataattttcacaagtcacaaaataatatttaaacaatttttttttcaaccacttaaaaatgtaagaaccattcttagcttgtgggccacacaaaaacaggcagaggcctggatttggtacataggcggcctgtggtctatagtttgcagaaccctgctctagggtaatgactgagaaagggactctactaatcagcaggttgttgggaagcacgttacttaccttaagccagtataaaacttaaagcaataatgctacattatgtctaaaggctaagctagtgagaggctaaattataacactcaacttttttagcaaataattatgaagcatcagctaataagaccttttcttaagagtattcagagtataataatgctaccttgtgtggtttggggatttttattttaagttagggaagctatgaatctcttgaactttgtccattaagaagtctgccaaagctgtgaattttaaagccatgggaatttttcattgcgcttggctgctgaattttaacagcaaagttattcattaagtccacatttaaaaaaaaaagtatcaacaatgcttctttatactttatctgcatttgacacacttccagatagatgatctttaatttgactaatgagtgcatcctttgttattttaatgacaagtaatttacagaaagagaaaagcttttcaacacgcaagtctcttaaatctggaatttaaagtccctgatgttcagaagcaggaagcaacagttggtgtaagacagggccactaggacactggaaatgcatcctgggtaatgagtgggaaatacaaaaggaagaaaacagttggaaatatgttggccattttatatgacactttctgggtttattttcaggttggagcacaagtcagaagctgaagaacttggagattttggggagcatatgtcccaccttccccaacccccaagtatccaaatatcccctttggttctatcagagaagtattaagatttattaattagaagaaaaattaaagttataaatgttcaataggaacataaggagaattcaaaaaaataaaatgttgagctcaccacagttttcagcagaaattttactcttttttttttctttgttgagatggggtctcactatgttgctcaggctggcctcgaactcctgggctcaagcgatcttcccacctcagccacccaaaatgctgagactacaagcatgccactgtgcccagctaaattttactctttaactgatttttcaatgcataaataaatgaataagtgggtaagtacttactgaggacacagttttcaaccaaaccctgtagatactcaggatgaattaagcatgggccctgccttcatggggcctagggtttactcaactttacagaaaacccagaaatatcctaacaaatgtggcaactgaagaactttattcctaatcctaaaactcactttctttattctcagagcaatggatacagcattctaatgtcaaatcattgtttccatgttacacaatactctaactgtcaaggctaaaccctgtcttaaggaagggtgacaatggctttgttcttatgataatagaagagataaaaagattatttacaaagctacagcctctgaaaaattggaagtattttatacaaacaaccacctcaattcttctcacagtgatatttaagtgtttgtgcgtgctggtttctgttatgtgggtctttaccattttcattcctccttgcagctctatgagttaagtattactattattcttttacaaatgaggagcatgaggcctggaaaaatttaaaaacatgcagaggtgataaaatactgggaaagtttcacattcaaccatgtctgatgcttaatccttttccttctctttccaccatagcatatgatcatggcatatcatcactgtttctgtttcccctatagaaaattcaggaaaattaacacatggaagagtattcagactttcacttttcttcttacataatctttgagcagcccattataggaaaataagggcattggagatttgaagaggcagaatgaacacgttctagatgtagaaagaaaagttctaagcaggtaaaagacaaccagagtgaaatacaccagatggatgcttgacttggagaagatgctaagcactaaataagccaggtggtagagggtgtgaaagcggagagccctgagaaattgatcattaagcggaaggtgattaaaatcttcctaagggacagttggtcagagcagaggtcaagagctaggacttgtctggcaagacttattgtggattcttgaagggttaagaagtcagtcagagacccgggattggatactgtatttgaactgattgtcactcaccagaatctgtgatctaggagacagacattgccaggatcccccccgtcaggatggtcatagagaagggaaggtgtgttcatttactattgctgcatagcaaattagcacaaatgtacagattaaaccaacaccccatttattagctcgtggctctgtaggttgcaagtctgggtggcccagctgtgttctctgctcagggtctcacaagactgaaatcgagctgttggccagacgaagctcttatctggaggccctagggaagaatttgctgccaagctcgctctggttgttggcagaatttactctctggcagctgtaagactgaactccttgatagctataagctgtggtccactctttctaagggacatctgcattccttcttaagtggccatctccaacctcaaagcaacagcacattgagtccttcacacacatagaatctctctaaattcctctttcatcagtcaggaaacgttctcagcagttaagggttcatgtgattaggtcaggcccacctgcatcatctccctttctaacatcaactgtgctctgtaacacaacacaatccaaggagtgatgtcacattcacaagttccagggcttcaggtggacatctttgggctgccattttagaaagtctgcctaccacagaaggtgatgaagaatctcagctcctgccttgctccttggtgagctgtgtgacctgtaataacagcagctttgtggaaaattggcccaccctttcctagggttaaagggccaaagcgaagttttgtgactttttcttcctcttctgacactggcttcttcctctaaggaaatctgctgcttttggtgttctcttctttccttcaccatctcctggtgttggtgccaagaagcactggaaggcaggtggtccatcaatttagggcaactgaaggttttgagatcaaggcatactggaggcccagacatcacaagagggcagcacagagcaagagctgataaatgttgagatgcagacttagcaggccctagctctttctgagatgatgtgttcatctgccctcaaaacatcctctcactcaacatgtgcctcctaacccagaccccaaggagtctttagtaagaacatggcagatatcacatgtgctgaccatggggttatcacaaaacattaactctccaaaaatctgctgcttggaaccttggtttctgcaactaagaaatgagttaaaaatgtattcaaggttgataaatttaaaatggaaaaaatcatcttctgaactctagcaatatgaaggccactttttacaagtctgatgctgtagtgcagtgtttacaacctattttcattttcaaccccctgtcacaaggagcctgttgaaacattttttgctaattgctccttgcatgaaattttaataccacaaatatagtataaatctatttatgtatatctgtgctttgtgcataaaaagagtaaggttttttgtttgtttgtttgtttgtttgccactgagaactagttttctcgctcttgggggcaatattgcccctattgacagtgcatgttataatggggaaaaattgctaacattttaatatttagtaaatcttcagcttatatagtctatttgatttggaaggtggctgtaatactttagttgtactaaaaggtacttgaaattaatcttgaaaagtcagaagaatctttacacatgaaaaatcacccaatatattatatttaaaataacaacttgcaaaacaaaacgtaaagtctgatcccatttttgtggctaagaggtacagaaaatgactagaaagatcaacctgtggaatgttgcttctttgcggttagatccttctataggtgttttgctctttgggaatgttataaatattcaccaatatacattatacatatgtataataaatacatattatattcatgtcaagaagaatactatttaaaaagttagccattctctctctctctctttttttttgccttcaacatttaggattaatgggcagtataaattcaatcattcacatgtagcaaaaggagaaatatttcacatggcccattcatgactcctttagatctctagagggcttcaagcctcaaagtttattgttgcattcttcttaattctggttgaatgcatgtacattattttctgcaaagaaataccacccactaaagactgttccttctcttctaacagggttttggtgtccccagggctcccttagtcctatttactttggatatttcaggagttactgtaggtttaactgtggtgagtccttaagccctctttttaaattcataaactgtctctaatcttagcaaaatgtcaggttacacttttgagaggtttgggaacttgacattttgtagcccagttggggtgtaggctgcttctattctgagcaccttgttccaatttatgtcaggaggaattatatacaggtcagggctgggagcaggttataattaatggggtggacaagtggatttttaatgtttcataaaataaaatggaaatcacatgttcttggaactgttgtatgttttaaaatatttacatttattctagtaaacattaattataactgatatatttctcctatgaactcgctaactgtgaggtcacaagccattgttcactgagtagaaagaatgggtgacaagctagttacaagaaaaaagacagtacttgggcgggtatcggtgagtgaactcgtggaagtaatccagtcttaggtctttctcctaattttctcttatgtttaaagcacccccttgccaatatgatccagatgtcagtccttctaagacagaactgggagggtttagcctgtgaaatttctgaatagctcctggtgaagaaggaacacatgaccaatgtttaactatttgtcttttcaaaattaaagtttagaagtagttgaaatactgccagaatctacagcgtccacgttttattcatattagtttatcaaaaatttccaattccttgaagctgtagcagcaatatgttgctgaggaaagaaattttttttaaaaaaaatttgtacttataattgacacctaataattgtacatatttatggggtacaatgtgatgtttcagtacatggatacacagtataattatcagattggggtaattaccacatccatcattttaagcatttattatttctttgtggtgacaacagtcaaaatattctcttctagctgtcttgaatatatattacattgttatttgctgtagtcaccctactgtgtgatagcacatcaaaacttactcttcttgtctaactttgtgtacctattgaccaatctctacccgttcctcccttcccccataccctcagcagcctctgggaaccactgttctactctctactgctatgaaattgacttctttagattccacatatgagtgagatcatgtggtatttatcttttttaatgtttttaaattttattttattttatttataatttgaatttttattttagattcaaggggtaaatgtgcaggtttgttccatgtagtaattgtcttctgtgcctgacttattccacctaacataatgtcctccaggctcatccatgttgccaaaaatgacaggatttcatcctttttatggctgaatagtattccattgtcctaatcatccccataaagaaatatattttctttatccttttgtctgtagatgggcacttaggctgattccatatcttgactattgtgaagagtgctgcaataaacatgaatatgcgggtgtgtcttcgacatagtaatttcacttccagaaagagatctttaagagtcagaaaaacccagattctaaactggtctctgccatgtgccagttgtgtggccctggagaagatgctttaactctgtgtctcagtttcctcatctgcagaagggggaaaatgatacccactatttagggattgggtagggattagacccaatttgtataaagtgcctggcatattgtaggtatttttttaaatgccagttatggatatatgaaggaaagctccaaaaaatgaaattcaaaggaagccttatgtaaattgcatcacatgtcaaccatttgggtgttaggaatattgatgcattctttattttgcctagaattcatcactccctaaataaatattatttccattaagtcaccaaattttatatatattctttgtcttgtatggtgaagaattaatacaagtgcgctactctattagggtataacagttacctaagtaatgtatcatgagacctttttgcccttttctaaggaaaataagtatttattggaaggacaacttcacacacagtcagcaggtaataatccgcagtacttcccaatgctgcttctatgggctggaagagtgtttggtggttctatatggcacagggctacttgtccatacccttgacccaaggatgtcacgtgcacccaatcaacctggaaatcactgtggtgacagaagttggggcccaatcaccctcagggccttgacactgattttgagtataccagtttggaaagtctctgcagaattccccaagacattaagtttataatatcccttgaggggtccttagaaagaaaaagtgcctatgttttggtgtcattatcgttcttcagggcaaggcttggtgaaaagatactgagagaagacagtacagatagaaggacaaagcgaacaaaaataaggacccactgattttatctttgcaagctctaaactgagttacagattgagatctaaaatatatactcaatacatgcatcctcaaaatgttcttcacacatttgtgcccaagacatagtagttgataatattaatacataaatatatatacacacagatatatatgccttacaatacagtcctatttttagtgtgtaacaactgtactattttcaaaatagtcatcggcacaaacaccagtaccacggctaaatctgacattattgatcttttctccctctaagaatatcttttgtaggcccataagtgagagatggcagatctcctgagcttcattcagtcctttatggaaatatttatgaaaaccctactgtgtgctcagtagctatcagagttcttggcatataaaagatttcaaaataaatttgcctagtattgctttgggggatgaggacttggtgatatcttcctctccccaaaagaaaaagtggtgtgtgtgtgtgtgtgtgtgtgtgtgtgtgtgtgtgtgtgtcagagggacagagacagaggtagagagacagagtgtgagagtgtgtgggtattcagagagagaacatgagtcccagtcttatccttatcttccctcatacaatgcaagctatttggaattgtagagctggaagtgatcttagctaacattttcccaatctcctacccaatacaggagcgtcttctacaataaccttcatcaaagggtggaacgctaaaatgtaagactagaggtctctttttgttgggcaataatttgattcaattatggtgtcattatttggtaactcaggtggcacagtataaatttctgtgggaaattggaatggggagcccaagctggactggacatgactgcaccatggaaggaggacatttgggaccagtcttgagctgccattgtgttccactgggaaactaaacactagtgctttctcaattagtttatatatttctcaaagtattccatagtctttagtttgtgctaacaaaattgatcggaagtactatattaaaattatcattcattttttactcttactgaacagcagtgagaaaagcaggaatctttgtcattttgtttagcatgtaaatgcacaaaaacctcagcttacctgaactttgctaaaatgtcaaacctttattaaccacaagttttctacattatacttttcctaaagatttgtgaaatacaaggaagaaggtgatattatgaattactgtaaaaatccatggtcatggatacaattatacattcaagtcaatctcctacgtcatctctatttatgatcaaatgaaaaaaggtctttttaatgatgatctcaaggaaaaataagatttgaaattacctcaaacttttcaattagatccaatatgtgatttgtagttatgcaagtaaagtggactcaagcattgtagaaatgtttcaattaggattttttttaagttaattgagatttgatcatatttttattgtcatctttgttcccacatggaaattaattccatttcagacttatttcttggagggtgtttagcatagttatcaccttaaatgagtagggtagggtgcgtagggtggcttttcatttttggaatttaattattactctctctatatatatacatgtatatatatatgaaaaagaaagagcttgccttggcagaagtgtttaaagaaacatgagtagttaatgccctcactgtgatttgacttccatcttcctttttttaagcacatttttcattttttccccctttaaacctgccatttagagctgaaaagtatttttcaagaaatggagcaatgctttctatcccatttattaaagtaatgcacagaaggaaatgcaccgtggtaaaaacaatttatacgagaaatgataatgttttgctaaagataaccaggaagtgaggaggagaaaaaaacccctcaaatagcagagagaggccagatggtctttttttttttttttttttttttttttttaacgcagtccctaagcaggaaattttgtttgattaagaagacactggtcttgattttcattcagcagttttgaggaactttttttaatggacacacacacatatacacacacacacacacacacacaccacaagccattttcattcagccaaattatcatttgtgctattgtaagcaagattctgctgatgaaaatgtgaagtcttaatgataaagaagaaaacgagttcccaagtctcagttatgaaagaacttggaatttacccactaccctaaagacgctcgatcattaccatatccatcatattgttgtaaggtctggtgttttgttttgttttcttttgatagcctggaatggaagaaagactgtgtaccacagtggctaactagggttttgtgagatacagggtagacccgggggaaaaaatagaggttttggagttcaacaccccagggggctaatgtgcataaagcgactgctccaaaggacctgagtttaatccttggagctgccagtcaggatcaggatgaagaagcacccatgcaaagaattgcttctggatgctgataggcagggaggtgaagggggggaggtgggaagggggaacggagcacccctctttggactgtgatgttttggcagtcggtgcttggaggagggtagctggcagtggctccggcacaataaagctcccttcggtgaagtcaccagcatccttgccatggtctggcaccctttgcccagcacccctggagtgtgcaatttcccagtctgtattctaaggatgaaaatgactaaagttgtgaaactaactatttgcatctgtttcaaagagaaagagtcacttggaatttggaatggaaagaatagatttagacaactggcagaattgttcggaactatgccctgaatcaagagaccctgttgacttatataaggacaagctaaaggagctacgtaaaagagagaaccaacatatctttaccatgaagatgacaaatcaggcattcaaatttgttttttcaaaaatgaaatgtgttctcatatagttgtgtgatactttctctaatcagtattcatatttatagtcaaaataagtataacttcactttaatatagcttagccaccttgaaagctcactgttcttaaagctagatttttttgtaagtgaatttttaagccctagattgcatcttaagtactgagttattttaattttgcctttttttttaatgtttaaaagccagcttcttgtctaatttgattcaatggataaaatgtacaggatgaaactcacacttaaaatgcatttcaatgagaattaaattgtttaaaatgaaacttttttcctttaaattttaaataaacaaataagatgcaaagcaaaataacaacaaaaaactcttaagtcaactcccttggggataagggataaccttagggataaggtcataccttttgatattaactccaaactcatgccttgtattcgtgttttacaaattacatttataatttatctcaaagataacaaggaagcatactttgataatacaagaagaatctctcagactttagcctgccttgagaatatgttttaaaagccattagaagcttcctagcgtttatgggatttgttcttatatagagtacatttttttttacatatattttgggcagaattctcaagtctccaaataaacagtttaaatcttggcttttaggccaaaaagtctttgggctgggaataactcaccctcagaagactacttgctttataacccctcccctggaatgctgcgaccctgtcttcccacaaaccttatttgcttcactgtggaagagtggcacagggcacccaccacccagacttcccaagctcttctcttggtctctgctatagctacaatagcaactttattctcctacaactgagagaagagagacagaccctctcatattgttgtatattgttttatactcagaaaaggaaagagaagcaaaactaaaggcaggtagcccggcgcctaagaaccagacgcgaaaccaaggaaccagacctgaaaccaggcctgggcctgcctgacctaagcctggtagttaaaattccacccctgacctagcaactgatgttatctatagattatagaaagacattgtaaaacttcccggtctgttctgtttcactctaaccaccagtgcatgcagcccctgtcacgtaccccctgcttgctcaatcgatcacaaccctcttacgtggaccccccttagagttgtgagcccttaaaagggacaggaattgctcactcggggagctcggctcttgagacaggagtcttgctgatgcctctggccaaataaacccctttcttctttatctcggtgtctgaggagttttgtctgcggcttgtcttgctacatttcttggttccctgaccaggaagcgaggtgattaacagacggttgaggcagctccttaggtggctttagcctgccctgtggaacatccctgcgggggactccaaccagccggagcgacgcggatcctgagagcgctcccgggtaggcatttgcccaggtgggacgcctcgccagagccgtgtgtggcaggcccccgtggaggatcaacgcagtggctgaacactgggaaggaactggcacttggagtccagacatctaaaacttggtaagactagtctttggaacttgcccactccatttgtgtggaagcgtggtctgatcacccacggcatgcctttatcggcactttggttttggttttgacttggtttgaattgcttgacggaactggtcttgggaacttgcccgctccatttgagtggaagcgtggcctgatcacccacagcgtgcctttatcagcactttggtgttggttttggttttgacttggtttgaattgcttcacaggactggtcttgggaacttgcctactccatttgagtaggaacttgcctactccatttgagtggaagcatggcctgatcacccacggtgtggcagtaccggcactttggtttttgtttttgacttgacttggattgcttgatacttggattgcctggattgcttagttttggttttgacctggcttagatttctggatactctaattttggttttgattctggtttggtgtaaactgcaaaagtgtgtgtgtgccctttttacctgttctttgttttgtggtgtgcgtgtggtgtgagcatggtgttttgtctcaaagaagcatgggtcaggcacaaataagcccaccctactaggaactatgttgaaaaatttcaagaaaggatttaaggaagactatggagtactatgacaccaggagaacttaaaactttgtgtgaaatagactggccagcattagaggtggcttggccatcagaaggaagcctagacaagtcccttgtttcaaaggtatggcacaaggtagcctgtaagccaaggcacccagaccagtttccgtacagagacagttacagctggttttagatccccttccccccacagtagttaagagaacagcagcataagcggctggcagaggcaaggaaagaccagcagacagaaagagagaggcagaaagagaggaagaaacagaggcaaaaggaaagtcagagagagacagagagacagaaagtcaaagagagaaagaaaaagagaaagagagaaatatacaagtagttaaaaaaaaaaacaacagtataccctattcctttaaaagccaaggtaaattaaaaacctgtaattaataattaaaggtattctcagtaaccctgtaacactctaatactactttgttgtcagtgtaaacaagggcatatcccaagagcactgaggccttcctatcaaaaatccttaacccagtaacccgcgaatggcccagatgcattcaatctgtagcggcagctgctttgctaacgggaaaaaaaaaattatgcaaaaaatgttgtataatttaaaagtactcagtactattgaagaaacagtttatgttcaaggtgtataagaaaagtaaaatatacctttggtaaaaggattataaggaggcataagaatgtggatttttacctacattaaaaggttaaaaaaattattgttttgaaagtttaagcgagttttgagacgttaattgtaaagaaaattctgtgtgtaaacatattagctaaagttaaaaaggtatcatccagtttttctgtgaactggacattaaaataaaaatgcaacaggtttttcttaaagcaccaacctgctctttaacaaaaattatgaaaggttaaaaagagtatataaaatcttgcttatggtcaaacattaaaaattagataaatatgtctacaaggttttattaaaattaagtttaacatcaataacactaatataaaggtaaaatttggcttatctagtataaaaatcatacagaaagcattgttaaatgtaaaatggtatttggctttctttggtctaaaaactaataaaaataggtgctaaaggaaacattcattttactagaagatcataaaagttaaaaacttaaaacaaactttggcaattaagacagcataccaagatgcaaatgcctggttggaatggatcaaatattccatgtgcacgttaaacaaaagcaattgttatgcttgtgcacatggcaggccagaggccctgattgtcccccttccactaaggtggtcctccagtcgacaaggcatggactgtgtggtagttcttttccaggattctacagcctggagtaataagtcatgccaagctctctctgctatatcccaaagtccggcaccctgcgggtcagcccccgagggctgtccagcctccgtctcccaacactaagttcacttcgtgtctctcacgacagggaggaaacttagcattccttggagacctgaagggatgcgatgagcttaagaattttcaagagcttatcaatcagtcagcccttgttcatcctcacgcggatgtgtggtggtattgtggtggacctttactgggcactctgccgaataactggagtggcacttatactttagtccaattggctatccctttcaccctggcatttcatcaaccagcaggagaaaaaataagacattgtaaagcgagagaagccccttgtaggtctttcaactctcatgtccatttagacgcaattggagtcccatgaggaataccagatcaatgtaaagcttgaaatcaaatagttacaggatttgagtcaatattttggtagatgacagttaataaaaatgtagattagtaaactacatctattacaaccaacagcagcaagcttttcatgagttaaaagaaaaactcacgtcagccccagccctggggctacctgacctaacaaaaccctttacaccctatgtgtcagaaaaagaaaaacatggcagttagagttttaacccagactgtaaggccctggccaaggccagtggcctatctctcaaaacaactagacggggtttccaaaggctggcctgcatgtctaagggccctagcagcaacagccctgttagcacaagaagcagataagctaactcttaggcaaaacctaaacataaagtccccccatgctgtggtgactttaataaataccaaaggacatcattagctaatgaatgctagactaactagataccaaagcttgctctgtgaaaatccccacataacaattgaagtttgcaacactctaaaccccgccaccttactcctggtatcagagagcccagttaaacataactgtgtagaggtattagactcagtttattctagtgggcccaacctccaagaccatccttaaacatcagtagaccgagagctgtacgtggatgggagcagcttcgccaacccttgcaaagtgactctgaagaagacgacaagccctgcttcagtcacacccagaagctaactggtccatgcacggccgaaacatgaggaaactcatcgcaggactcattttccttaaaatttggacttgtacagtaaggacttcaactgaccttcctcagactgagggctgttcccagtatatacatcaagtcactgaagtgggacaaaaggttgctacagtcctattattttacagttattataagtgtactggaactctaaaaaaacttgtttgtataatgttactctatacaaggtatgtagcccgggaaatgaccaacctgatgtgtgttatgacccatctgagcctcccatgaccatagtttttaaaataagattaaggactgaagactggtggaggctcataaacgatacaagtaaagtgttagccaaaacaaaacaaaacaaaaaaagaagtgcccaaacaagtcaccttgaaattcgatgcctgtgctgtcattaataataataggttaaaaataggatgtggttctcttaattaagaaagaggctatatggcagaaaataagtacatttatcataaattaagactgtgtaaaaataaatgtggatactggtcttgtgtcatttaggctacttggataaaaaaaaaaaatcctgtccaccttcagcaagggaaaagtggcccttcctgtaccagtggtcagtgtaaccccttagaactagtaataaccaacccccttaatcctcactagaaaaaagaggaacgtgtaaccctaaaaattgatggagctggactggatcttcaagtaaatgtcgtggtttgaggaaaagtttataaacgctctcctgagccagtatttcaaaccttctatgatgaactgaatgtgtcagtaccagaaattccaggaaaaacaggaaatttgtttttgcaattagccgagcatatagcccagtctctcagtgtcacttcgtgttatgtatcagcacaagtgtaaatatgtgaatcattatcaatctattgcacaggaagacataagtagcaaaaataagagtgagaactcccactaataaaaagtgagagtctcaaaggggggaaatgagagaagagagacagaccctctcatattgttttatattgttttatactcagaaaaggaaagagaagcaaaactaaaggcaggtagcccggcgcctagcaaccagacgtgaaaccaaggaaccagacctgaaaccgggcctgggcctgcctgacccaagcctggtagttaaaattccacccctgacctagcaactgatgttatctatagattataggaagacattgtaaaacttcccagtctgttctgtttcactctaaccaccggtgcatgaagcccctgtcatgtaccccctgcttgctcaattgatcatgaccctctcacgtggacccccccaccttagagttatgagcctttaaaagggacaggaattgctcattcagggagctcggctcttgagacaggagtcttgccgatgcccccagccgaataaaccccttccgtctttaacttggtgtctgaggagttttgtctgcggctcgtcctgctacccaattttctctgcgattattttccttctaaccctttcttaaagtgatgggctctaaaaaatcatgattcagctgctattgcaattttacctagccagtgaatttatttattttgagatgctttttgatattattgtcattgtcaaatgacattatgacatttcaaaagacattggctgtcagccagtgggatctagtcttaactcatctttggtgctcaccggtcataaagctgtagtcacatgtgtttatttcccccagcactcttccctcatttccttcctttccttcctgaaatttcctcttccagtggtgcaaaagctggtgagtaagtactgacaaaaccaatgcctcttccaatgtctctattcatttccttcctgtccatccctataagcttaactgtacatccatggttattttcaactttgagttaacatcgtagaatcaaacacttaagatattcaggtaattctgaataccatatgctatggtttgaatgtgtctcccaaaattcgtttgttggaaacttaatccccaatgcagcagtactgggatgtggggcttaatggtaaagcccttacgaatggattaatgccgctattaaaagggtttgtggaagtgggttcttcctctcctgctcttttgccatgtgaggacatagcattcctcccttccagaggacacaggcttcaaggtgccattttggaaacagagataccaggcccctaacctgctctctgttcttcttttttttttttttagatggagtctcagtctgtcgcccaggctggagtgcagtggtgtgatctctgctcaccgcaacctctgccgcccgggttcaagcaattctcctgcctcagcctcccgagtagctgggattacaggcgtctgccaccgtgcccagctaatttttgtatttttagtagagacggggtttcaccatcttggccaggctggtcttgaactcctaatgtcgtgatccacccgcctcagcctcccaaagttctgggtttacaggcgtgagccaccgtacctggcctaaatcgctgttctttataaattacttagtctcaagaattctgttatagcagcacaaaatggactaaaacatcatggttcctgcttttttggctcactaagtgttcgtggcttttctctttcaaaattttattgctaaaataaataaagatgtcactactttacaataattcatcacattccatttttttgtaagaaatagtaaaagttggatttctatgcccttgaaaaagaactctatccttgaggcaatctgaaactaagcatttaacaacttgaaaaattagatcacaaccctctgaccaaacaccagaaagttttatactgaaattcagatactctttgcttgtttattggcagggaaaaagccaaaatatcaagaaagccagcacaaatatgagtagtaatatccccttagctaacatagatttgcaccacccatctaccttctatcatgtcatcctttttatttctttcattttatgtatgagtctttgaaatgtttgtgtttttaaaaaccttttatttttttatttccttcattaaaatgtaagctctccaagggcaggcctttatgctcatatttaccaccaatttgctgctgcctagagcagctcctggcacacagaatgacctcaaaaaataccagtggaatgaaagagtaatgaaagaaatgactcatctggttttactccaaaagaagtagttctaattttttttaatgcttaaagaaagccaaatggatatacatataggatttccagtgtcataaaagtaacaaaattagcttactcttccaaactcttattttattaatattttttaataataaaaaattatagaatgcttcatgaatttgtcatccttgcattggggccatgctaatcttctttgtatcattccagttttagtctatgtgctgctgaaacaagcaccaaactcttaaaattagcttaggttcagagtgaagagctgaagttgcagaccagacccaagctgttttgggactatgaaggacattaagggctctgtttatttgagcaaaatctatgggtgaggcttacctgctttctgccaattttccttgtacaacagctgatgtcagagggtggttggataaggagcttggagccgttggtaaggaagttcttatcactttcttgcaggctccttttacctctagtcttctatgactcaagggtcattcagtgccaaatgaaattctgcctctgtggtaactgctagaaagtccagtgatgatctgatttctagtaacaactattggccatatccccaggaggagataagaattgtgtctattaggaaataattttccatggatctatcacctttttgtacctcttgtgagctggagcactgaatgattttattccagactattccccaggatgtttgtatagcaaacagtcttgggagatagaggtagtatctcgcgccaggggagaaggcaggtttgtttgttgttcattatattaaagacaatgtcttcctccagggcaaaagttgggcaggctaacttgcagtccattataaaagattcagatttcctaagcttggagttgcttaggtatgatgcaaatctcctgagtgtgcaaacatggacctaggatgctccgtaggacttcgagaacaaggggaaccaacagaacatgaaacacataccatttgagtaaaaacagcctttatctttgattcaggtgtcttctgccagcattcatgaaacgaaactggcaaatagcaaaaatctgaaacatttcactgttcttgatagtttcacatgctccatccatgccagggtcccttatttcctgcaaaataaaaaaattctgacaaagagtgcatatgggacagggtgaccttcactgggaagcggaagtgaagccccaagttcatggtgggagatcagtggtaatgaacagaggtatgtcatagtgtaggaaacagatgaaattgccaatgtgaagataagtcattagtgttaagaataaaaatgctagttcatttcacattcacatactgtttgttcacataagatgctccataaatgttattgaataaatggatttatatccttcttgcttgcaaaaatggtatgaagaggtttccagtaaaaaacacagataatgaatttattcaaagaagagtgggaagaggcgattcaggacaagaagggaagaaggaccccaatcccccatcccctaccaccctgtccttccataagagtgagaattttgtcaggcattttaaaaagttcacctcactaatcctcaaaggacccttaagattgctctcagataaggaaactgcatagaagataggaagagcatctgtgagtataagatatgtacagtatctggctccgatctgcctttgcaaggaaatggcagagccaggatttgaactcaggttatctggcttcaaggtactacatgttttttgtttgtttgtttgtttgttttttgtttttgttttgttttatatgactgagtttttttactctatcacccaggctggagtgcagtggcgcaatctcggttcactgcaacctccgcctcccaggttcaagtgattctcttgcctcagcctcccgagtagctgggattacaggcacccgccaccatgaccagctaatttttctatttttagtagagatgaggtttcactacattggccaggctggtctcgaactcctgacctcaggtgatccgcctgcctcggcctcccacagtgctgggattacaggcgtgagccactgcgcctgacctctacatgtttttttttttttttttttttttttacaggacaccacattgacagtgtcagcccaaaactagaccaagaacacttgggcacactgagctcagggcttagcccaaagttttctgaaagcatgccagagggaaagctggatgaaatgctttggtaaagaagaaagcacatcagctcatcactcatctgacaatagaaaggactgatcaggaagtggggaaaaggagaatagtggcaaaacatagaaaagagaaaaaaaaagactgaaatttttaatggagcgcaaaatcagacatatttttttacttttttgaacttctttagagactacaataataattcttatgtgataagtccaataagctatgatgatgttttattaaatgtaccatcatactagcagcttttgcagaatttgcatcagaagaaaagtataagatattaccaccatgacttggcaaaagcggtatactatattaatgttagccacttagttgctgtcattgtttctcagcacagtacccattgcctagtttccctgggagttcttgaaagctctattgaaaagttatatttaaagtgtaagttagagtgtgctgtgaatggagagaaaattgtttttctttttgtaaaaaattcactttccttgggactatatactaagttagctcagttatttgacagaaccagtatcttattttacaaagagaaaaacatagatctagaaatttccagaagcagatcactggttgaaagggcggggcgggggggggcatgtgattgaatgtgatttgaaggcagttttaattttatgacactttacagtgtgtgtgtgtgtgtgtgtgtgtatgtgttttaatgataacctaattttattgtcccagacttaaagatctgtgccacctggagaaactacagttcatccattagcatgtaaatctgttaagagtatttttgcttgaatttctccgagaaggctcccggctttgttctgtacagacacacagtcccgacgctgttcttaatatcctgttttcatttgtcagcgctgttgtccttttcattgccatgttcccatcattcctcttctttcatgtggtgctttacaataacattcagaacaaaagagtcactcctctttctgttgcctttaaaaaaaaaaaaaaaagacttcttcccctgactgcagagcttcagtgatcaggggaaatgtttaaagcatgttattcgtaatagttaaccaggagttgtgaataagggttcgttttccttactttttaagatcaggaggtagcttcagggtattgtgagcaaaaggtttttgtgtgtggctgactttgaagttgagggaaaaagcgattttctttgagaaaaggaggcatcatatttgagagaatttccaatctgctcacacaatgggaatcagttactctataacatcgtcattacctccatgagtcacgagactagtatttgttcttgtctttgaacttaagctttccagtgttcagagaacagttgtgaaatgttgcattggccatcatcaataactattttgctcctggttggtaataattgggaaggggagggtgtgtactttctctgccttctaggagagtattatataaataaagtgagaaaaagtttccccaagcggcaagcttttctccagggcacaatctattatacttgctgcaaaaatcccacttgactggtctttcagagaatagatcacttgcgtcattttgctcatttccaggtgaccttttgcagatatgagcaggcagttgtttttaaataaacattatctacaggtttctgtttctgcactaaggaaggaatgtttctgtaatgcagaagggatgctatgactgaggggtttgtgaagagtgaattctagccagtctcaaataattctgaaaaggtgcttttgtatatgtatatgtgtacttatgtatacatgcacattgtatataactacaaaaactaattccattatggacatatataggactttatacagacatagttatatgaatatatatagaaatacctatcaaactataaatacatttgagaaagcattcagggacagcagtgttaaaagcttttcatctgtgactggtttcacagaaattagtgacttccatttctgctaccatcacgctgttggtctgttcaccaggagggttgatttagacttctgccaggagactaggtgtggccatctctcaccctcttcctctctgtccagtctgctatcattgccttcagaaccaaattcttgcatgatacccagtacagcatagacctggaaaacatcggtcattttcaatataatgtaaaataggttctgtgtgcctttaaaactaaatgctttatttcttaaactgtaaaagacatgaaatgtctgagacattcagatagtgggaaatttcatctgcaagttgtcagattatgccctttagaagattgtaattttttttgttgtttatcattttctcttgaggggtggagtaaatatttctttcctgatgtttcaacttcagatgttcaggctaattttccactacagtgccaaaatagggaaaagttaggcctgtagaattttgacaatttaaatgttgttttaacaaaagccatgtcttgatgaaaagttctttagaattctacttgatgatctatgtgtgtctcttccgaggacaatgagaacttcttaaggaagtcatctatatgtgaaattgagtaatccttttattcattgttaaaagacaaatgaagttataatttggagagacataagccaaaaaatctatgtttgcatttttatgtcctaacatgtgaagcatgctttgatttactgtgaagtgttgcaatggcaataaagtagatgttgagacgtgcagactgggcagcccgaggaagcagttcttgcctctgcttcccctttatcatgaatgttccttaaacacctttggtggagtccaaatgtctggattatgaattgaattgtgcaagattctttttttaaacactttcctgatgatttactttacttgcagtttcttgtcttgcatggtgataagcaatatccttcaaagaactgcagcgcaggactttttttttttttttttcttttaggaagactacttccccttcctcctttagtcaatcaaattttaaaagattacttctttccattctcagttcaccctttctttgccattctggagactgaaattttggacacccatcacagatttgctattatatatataccgtgtatgtaatattaaatatatatatatatatacacacacgatgtttttatatatgtgtgtacataatgtatgcatacgtgtgtatgtgaaacctgtgtgtatatacatatattttaaattgtttatcaggatgatagattgctatttaggtcactatttttggaagaaataaatgactgttctttgtgtctgtactggagattgttcttcctgatataactttgaagaaaacttcttccagacattatacattaattcagaagataaaggcacaaaataatgtgtatattatttttttaaatgaacaagccagcatgcagagcataatgtgatcatgtgctcagtacgacactgaaaggccccaaaggcaaatgagtctagtgcctgttcccagccccaggagctgggcaggacggctcctattggtggcattgaaagctagcattcagccttctgccacaggacagtgtctcattcggccaagctgctgctggtccctgtaaggaatgagagtacagatcccgttgccaagtcctcatttttttggaccaggcagtgggtgttgagctgacctgagctacctttccatttgggttcagttgaacattgagtaggccagaggatagggaagttgtggcgggggccgtggaaaaggcagttgattcttcaactcgggcaaccctggcggagtggatgaggtggagctggccttcctggaattgttggaccgattttcctgttgtgtttcactgttgacgcactcacagacacacaggaccgctccagcactgcctgccacccaccgtctggtctcggtggcctgtctatcatttcgtgggtccccatcctctgcctacggcgatgtttcttcaaaaagaactagtgtgcagtccattggtgggtattcaaggtgatctctttgtcagaatctagagaggtgctcaaagaactattaaggaccaatgtactagttcctgtttttaacctgtttatcagtctttcaattgaacaaattggatttctgaaactgctgaggggttttctgcactattaggacagaacaggatagggtggttgttcctccaggaatctgggttgttcttttgcattgccatttgtctttgtgcttgtctgcttgtataaatgaacctcgagaaggagtgtttaagtattctgttaagtaaatttggaagactaggtttcaattaaaataaccagacagtgtgacccagcttccatttccccttaattttgatcattaaagccttcatatccccacagacatctgccatgcttcgaagtgattcttctcaggaatgttcattcattattaatcaggttgcatggtcaggcgagtatgtgattattttaaagaatgtcctagagatccagttactaagaatgagcatgttataggcagatgtgaaagtacagaaaagatttggttaacagtttaatttgatttgcatgaattccaccaggtgggtgtttggcgaaattaaaagtcttccctggttctcacttcagatatgaggtaaaaaaataataataataataataatttcagcacttcttaaagaagaaatgtcaagttattcaaaatatctattgtattaattattttaaaacttgaggctagcatctcagtgctcatctgcttgtcacttttttttttcaaacagtccctctggtcccctacaattttcttggcagaaattcttagttgtctgttactggttgagcaaatgaatttgagtgtgctgacatttggaggctaaatgcagtgataattcagagtaacattctttacctataaaatgttactggatcaccttttttcacctgttcttacttgatgtattatttatactgttgtttttaagaaccactttgcgtttgtactgaaacagcctacattatgctatcaatttccagtctttcagaatgcagttaaatccaactggatccccttctcccctttttccatcagttcatggccctgttttactgtgcctttgctaacccacctgcttctcaaattggccagagtgctaatcagtaaagtaacatttgggtagtgtctttattcggtggtctttatcactcaaagtcaaatactaaatggcataattgaatatgcagatgctgagtgcttgtattatgttattcaaaataccctatgatgaattcatcttggatgtagcagccagtttttattgagtttgtgttagacaagtttttgagttgagaaattatgcttatttaagatgagagcaagtcccttctgagttgggtccccgttgcaatctgcctcccaaactcaggttgatttccagtgtttcacacttcagtagttttgagtcctctgaaagtctgtatttctgctggtccaagatagaaacatcactctgcagtctttaaaaaatatttcacctatagttctataataaagataatctcatagcaaaaatccaaacagcaatagtcaactaaatctaattacccaggtgaataggggttaagaggagcggacaatcaagtaaattgacttgatttcgtttctgaaatttaggactctcaaataattcatttgtacattttcaatgctatttgttgtttgaaatacttataggagcttcctgttctgaaaccattttcgtgtggcttgctgtaacatcgtgcaattttaacagtgtgtttgtcatctcagttatgttttggtaaatttaacaataaagttagtctctatagtccagaggatatttggaaaagaactagaggaagtgccttgggaatcatctgggcagtggctgacagccacgtggtattaacgattaatcacaggccacccagtgttggcatacaagtttattccttggtctaatgactcactaatttccctggtagtgaaggctttagagttgtacaaagtgaggggctggaagtaaaattattgatagaattgatagaattgcatgttctttttcatatactccaaattagaaaaataattgtatttcatggagtatgcagacataacctagaatacttgtaggaaagcattgagaggtgggtttaccttatcattaaaaaggtcaatgcctccattaagggaaatttgggataaaaattatggatgatgtgctgatgatgggcgatctccttattctaatggatgctgtaacaagttagcacaaacctgatggtgttaaacaatgcaaattcattatcttacatttctagagtcaaaagtctgacacaggtctcactgggctaagagtaaggtatctttagggctgtattccttttgggggcccttggggagaattcatttccttgccttttccagcttctagcctgcattccttggcttgtggccccttcctccatcttcaaggccaggcatggctggtcgagtctttgtcatatctcatcattctgactctgactcttcttcctgccacttccacgtttaaagagccttgtgattcctttgggtccacctagatgatccatgctgctctccccatctcaaggtcagctacttagcaatcttaattatatcagcaacagtcagtcccctttgctctataacctaaaatattcacaagctctgaggaggaggctgtggatatctttggggaccataattgtgcctcccccaaagagggaggagtagaaactgtggtgtctgctgtctggtgaccaggaggacagaagccctgtgaggagacaccaggagccctgtagagaagacaaagacaggctaatgagggaagaggataaatcccacatcatgtgcattccaagtctgaggcacttgcagtacatgaagcaaagaactgtcagtgctaaaccgggttccagaaaggggttctcgaccatcttgggatacaagcctagcagtcattctcagagaggcagtacatgaaacaaacaaaaaactggatggccctgtcaaaggaaccatagaccatcagaaaacacttaggctttgattagcaagaggtagaagtcagcagtggttagacagaggaaaactaggaaagtacagtttcagtgacatacagtgatgtggtttgtttgtccccaccaaaactcatgttgaaatgtaatccccaatgtggtggcattgggaggaggggcctagtgggagatgtctgggtcatggggatggatccttcacaaatcgcttgatgcccttcttgaggtagtcagttcttgctctcatggagactagattggttctcacaggagtggattagttcccatgagaatggagttgttataaagcaaagttccttctcttgagcagatgccagtaccatgcttcttgtacttcccagcctgtggagccacgagctaaataaacctcttttgtttataaatcgcccagcctcaggtattctgttatagcaacacaaaatggactaagatacatattatgagagaggaaaggaaaggaagaagagggaggtgtgaaaacatttacatcattattttccagcaaaacatctacttattaattttccattttaaagaagtactttcctcataagtcttgaatctataagaaagttttttcaaaagatgtatccaatgcctcccacgatgtggggcttcactgtaatctgtcactgaagactctcctgcctaggggagtgattagagtgagtgctagagggactgtagggaacatctgtggacactcacccatggatactcagacagctaataagtagcagaactgcaggatgtcttagattatcccgtcacctgtccagctctctcccctttcattcattattctgtgctgtgttctagatgtttaaaccatggacaggcagaggtgtgagctgtgatttgttgccattcccagtttgttgcaagggactctcaagattatctagatcctcttctcaatgaggaccaatctgcccattcacaaaaatgttaagctataggatttcctgacaacaatatgcatgtgtgatttccttttattgaagtagaaatgaagaagtttttttttttttttgaggcatggaaattacattatgacagttaagaaaaggcaaaagctgctgttttatgatattggggtttttgttgttgttgtttgtttgttttgagacagagtcttgctctgttgcccaggctggagtgcagtggcatgatttcagctcactgcaacctctgcctcctgggttcaagtgattctcctgcctcagcctcccgagtagatggaatcacaggcgcacgccaccacacccagctaattttttgtatttttagtagagacggggtttcaccacgttagccaggctggtctcgaactcctgacctcaagcgattcacccaccttggcctcccaaagtgctgggattacaggtgtgagccaccatgcccggcctgatactgttattaatgatataaataacaatgtaagctatatatatatgtgtgtgtgtgtgtgtgtgtgtgtgtgtgtgtattagatacatatatatatagagagagagagagaaagagagagagaaagggagagagaaagagagagagagagagagagagagtgaaaagaaagataacattttgcataaaattcccacccatgtaccactatctgcttggtgaatccctgttcatcttttaaaacccacttcatactttacctccttcaggaagcttctccctgtctcctctccccctatatagagttgattattccctgtctgtctttggcatgcatctttttttatgttgcattacaccttgttcatttttttttctcgatatgggctcactctgttgcccaggctgtagtgcattggcatgatcacggttcattgcagcctcagcctcccaagtatctgggaccacaggcatgtgccaccactcctggctaatttttttatttttattttttggtagagatagggtctcactatgttgcccaggctggtctcaaactcctgggatcaagtgattatcccacttcagcctcccaaagtgctgggattacaggcatgagccaccacacctggccttgttcatattttctctctcggaatgaaccataagatcatggagacaggggccagctgttaccagtacttgtctcaggaccaagtacatagatgaacttaagtatttggtgaaagaatgaatggcaaaaaaaaaaaaaaaaggaatgaatggcattttaatttctccaaaaagatattttaaagaaagctagaaaataaaccatactaagtttcttttagaagaaggaatggaatgagtacaaataagatactgtagagtcatttaacaaaaatgctatctatgccattgtaaaatctgggtaaaagtggaaaaagtgggatgcactatagatatcaaaccaaaaccccttcctttttggtagcatacaggcaaaagatttagaaaattggctgaaattcacctaccacatctgagtattgtgtcttcacctaatacaattaaccatttacagtacagacacttgcataaagcactatgccaggtgctatggcagtaaaagaaaatatctagttttgagcagctactattaattcgttcttacatgagttgcccctaagcactcgagtcacataatttccattgatgtcagattcaaagcccattgcatatcatttcccattagcactggaaacttgtaagtgcttgttcaagtcttgctccgccatccttgctgctgttgcccacacagcattttattcatacctctctgagaatgattttcatttatgttctggttatctgtatatgcctctatcttccaatacatggctcaacaaaataagatgtgcaggccaatgctggcctgtgacctgtttttctaaatatggttatgttggaacacagccatactcattcctttatgtattgtgtctgattgcttttgcactacagtggtagattgagtagttgcaacagggcccctttggcccacaaagccaaaaatgtctactattttaccctttatagaaaaagtttgttgacctctgttcaaatatattgagagatccttaaagtcaagggctgtgtttgattctttttggttttagctgaaaagtcagtacatttaatggaatcaatgaatgtttgagtcattttgtgtgctgagtgctgttctaggtgttggtggtacgttcttcaaagagcaaagcaaaatctctgctttcacagagcttatattctagtgttgaggacagtggggacagaaggagcaataaacaaactaaaagaatatgtcagtgataaatattataaagaaaaataaaccgagatgggggaagaattaccacgatgggtaggtggtatagtggtagaaggggaattggttttatgtgggttcagagagaaagtgacactggagcagagagtcatgtggattctgaagaccttgcaggggcgagcaggggattgatgtgcttggcatgtttgaggagtcagaacgaggccatgtgctcagagcagagaaaggagtgggtagcgtgggaggaagtgagctcactgtctgagtctgtgttttctggggctggtttattctggtgaatttctctctgggtgaaatgggaagcccttacagggcagagcaaaaggagatgcatgttctgtcatgttttaacaacaggctctcttgcttctgagtggaggatagactatagggggaagggcaggagtgaacagaagccaagagaccatttagaaaggtcttatgatagtccacataagagatgatgctggcttggcccatgataatagagatgaggtgatgtgaaccccagattctggcttcttcatctaactcagtgcctggcacacagtaaacatctgttgaaggaatgaataaaatgtcagtatttccactgaggtctccccagtggaatcctttctagaaattctcatcacacctctctgggatggaatcctggcacctgcattaaaaatatagtcatcatagctctccagacataatttgatgctcatccttctattcagattcattggtaggcattcttgttttatctgagaacagagcagaccaaaagggctacatttttcctttaatttatatgcttctgatgagaaggtaaaagaactttgatttaaagataattctacattttttctatgattaaccaaaataattattaataggtaaaaacctttccatttcttctgagccatctgtaggaagaggtgacagaccaagtggggatgatatgtttcttacaacagcaaccctagggtttccattgcaggttgtagaaagatgtacaagctttaatatttcaagtcacagttgctcttttattctttcctatataataaatgctagtgaatggttgaagattttttaagataccaggcttttatgaagccagtagctgtttaatttttaacaggctcgggacatactttatacttttaatgatcagttaccattcagttggtagcaagatgagcattaatttcaccaaagcaccatattggtatttctgagggatgctatttcagaaggggtcagggtattctagaaaccgtgaattttgtaaataagcggaggtgtgaatacaaacgattgattgtcagaatcactaaacatagctttggatgtgaagccttcccataaatccggctgagaacgctctccccaccacccccgtgggtgatttgaacctcccgaccactgggtgaactgcactgttctcccacagcctgcaatgggctgcatgtaatattcccatcactggtctgcagacctctgctaatggtcttgaaagggagaaggttcaaagcggcttggttcccaggcctgctaatgagcatgaggcctcttcacccttaatgaactggggtttgtgtggaattctttctactactctttttgatgggaaggcagatgagagttcacaaaagcactcaggtctttatggcaaggggagcaggcagctgggccaccctcgggtggcctggaggagagcaacatagctagcagaggtcgtacccaggccaacatagctctgagtgtgaggctggacctcctgccagcctggcctgttgctggcaacagtgacaagcccgtggtgggagttttttggccaaaagggtccctcagcagttttgtaagcctccttaaattgctttctcaactgtaatcattatcattgtcataacataacttatcacatgaatatgatgaccactgaaatccttgttctaattaactaaatcattgctctaaatattagtcattggtactcaaacttactgcagccactgaaaaagcccccagatatttttctccacttcgttctgcctacccacgtcccactgctggattaaacaatagaattattcagaaacataatgaacacatgccaaaaatattgcctctatcacaatcatctttgtgaaagtcaatgttttttctcaggaatatattttggaaaatgacatcccacacttaaacacgatcatctctgctgaaatccccacatttgatttcatgtacatttcatgcccatttctatagttactgccttcctattgttctgaaacctggtttggtattgcagagtaaaagtccttaaatctcgtatacattaatacgtaagtttataaattcaaatttataaaagactctagtttattgatgaatatttctacattttaattttctgtgcgaggttaaacctgactctgacacaataagattattctgattaaatacaaattatggaaattacagtttcaattacattctagttttgaatgaagccttttaaaaaacaaaattgaaaaaaaaaattgcacattttcagttactgaactttgagaaaatgttaactggtatatgatggctcaggatgctttttcctccttttttccccagtgaatagaaagagaattatttggaatgtacacacacttaccctttcatgacctgtgtttggaattattctgagatgcattcaaagctgacacccccctatggttgacctccctgtgcctaatcaaatcttacattcttgtttccagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaaggttagtccgatccgccttaagccaacccctttctgccagaaaatgtcatggaaataaaaagtgtattcactgctagctacatggcaggtgaaggttttctcctcacctttgttatctgattagttttagcatgtttttggcaacctataaatgttacacaataagggtatcttgtaaaagttgactgctgcttgtaattttagcgttgtcaaggtgagggcaaattctaaaaatctggatcattttcaatccatgcagtttttctggatcattttcaatccttacagttcttccaaagagagtgctgcctctctctgagagagagggagagagagagagagagagagagagagagggagagagagggagagagagggagagagagagagaatgacagataaaatctggctttgggcatttggggaacacttacttttctcactcatctgggaaaactaattcactctcattgtacctgtatctagttactgcacaaacaaaagaatagagggaagaatgtctgtagcaaatgtgggattttagaggacacgtgaccttttattccttgtataaacgatatccagcttattggtgaaattcagtgctctgacaatctcaggtttcacgaaagaattccttttcgtgtaggctctttattcagtaaggttacagtcaagactatttgaacttcattttttacatgaaattattaacctaactccagcttgggggataatgattaatatgactatatgtgaaataaaaggatcactttctaggcagggcgtggtggctcatgcctgtaatcccagcactttgggaggccgaggagagtgaatcacttgaggtcagcagttcaaaaccatcctggccaacatggtggaaccccatctctactaaaaataaaaaaattagccgggtgtggtggtgggtgcctgtaatcccagctactcgggaggctgaggcaggagaatcacttgaccctggggggtggatgttgcagtgacccaagatcgcgccactgcgctccagcctgggtgaaagagcgagactctctctcaaaaaaaaaaaaaaaaaaaatcactctctaagtatggatagaaagcactagggaagaaataataagccaagtctccacatgtttgttcaatttcaggcaacagtgggtctaattattgaaaactcagctgagagagtttgagtgagatactatgttcatcagctaattttagatcacaagacaccaattaaaagaaaggaagtataaattaaaagctctaagtaaatatatattgaagtccttcctctcaggaaaaacacataccatgttgttgagcaaacaaaatgaatcacatgatcaaaagagtgttatcacttagaaaacagtgtcacctttaacaaatggtttctatcacctctccttagcgctaatgggtggttgtgtttactgggaccacatagtttattctgtgacagtgggattaacggaccacatctgggatttggctttgctatttcttgacatgttgagggaagccgacatgctgaagtcaattcctgcttctcaatgtcacttgggcaacaaaagcatcacctgggcagcatgtttcacttcaagtatccaaagaattactggtgcaaatccatctttaaaccatgtagaggaagtcaagcacaaggactcaggtgacacagacaacagaagacagccgctgacaggctttccagaacagtgcatggcagcacaggagaaaagtaccaccaaagttaatcatagcaaaggcaatgcatgtatgagctgtgcctctagagcaaattctgaagaaattgcgaaggctattaatttttacaaaccaaggtaatctttttttttttttttttttttaccccttttttggttggtggtggagctgaagggagaatatttaggataactgaacagagatgtttgatttttgttttccaaaatgtaaacatgccagatctttgtttctttattaaaaatgttcctttgattggatttgcactaccttttaatgattgtttgttaaaacaccacaatcataatgatgttcaatatttaacaactcccaggcttgatatttatttaaatcttgtggtcaggttctgctcaagtactcatggcctgtcacagcagagttattaaatatttacataacatctccaaatttatgaagaattcctgtcatgctctagccctctttgtgataaaaacaaaactcttcagttacgagccctgcacactttaattgagccagtggcctatcggttgttctactgtcacatggagggcctgacaattaatgatgtggtttctttttatttcctagttacagaaatataagcatataaacagcatccaatgcaccgaaacacatttacagccgttcaataagatgtacttatgagcatttgaacaaataacttatcgacatagcatgtttgttttaaaacatgccacttacgttagaattttaaaaataataattatgacatttggatgtctgatatttcagttatcgcatacttatgaacatatgtacatccttgttttatttaaaacctaagcacaatataaatgttgatttttttgaaggaagtaatagcataccaagaggaccaaaaccaaggaagtatatttctgttaattactactttggtctgaaatgtgctctgaacatgcatttttctgtagctctaggatctcatatagatgtggatttgtgatgatgtgagaacacagataaagcatggaggaatttgaggatgctttcattgataagacaatagatttgctttattaatttgcatatgtaaggaccctggtgtctttggaaacatttttgtccttctgttagtaaaagtttattacctgaagaagggaattctgcaattattatgaagaataatttcttgcaataatactaaactttgggggacatattttactcattagatctcagtataagagatgtttgtttatacaaaaaatcagaatatcattttgtacattacaatctttttctaagtgtaaaagaaaaagagataaaaattctaacatgttgaactcgtacaaataaaatcatccacatcatgtaaaatagcatcatgtcagtaatctaacgctttcggagactatgcattgagaggcactcatgaaatattgaagcaaagagaaaattaaggtagcatttcctgaactctactaagataaaaagagaaaagttttcctgccaagtgcaaaggtctctaagtggagcgtatccataatgtggatatttctttacatcgttttaattgaattttaagaagcctctcagtccttcaaacttggaggaaaaatttgatttgtgaaccacataacatataagagaatttaatataattaatgcattccagagttttcaaggaattaaaatgcagtagtcctctttttctgttccaacatacaaggttggagctcttgtttcttttctctaattatacctataaaaatatacaaattgaaaaaaactgacctttccttgcctttcagtttcagcatagccccttcaaattagctgaagctgaagttccaaactattgttttgctattcttattctaaaggctggctgaggaagtttgtttgtataatgcatgtttcaacggatcatcccattgtaattttttaatagtttgatttaaaagttcaaattaaagctcagcatttctatgtagcactttttatctggaagtgaagacatgagatttcattcttgggtttaatttatagattgtaaggttctatgtttgaaaaatctttcccagtttgcaactaggaaagttgtaagtgtatactgagctagacttctttttattataatttctataacttgtttcttctttgaaaaccagtagcaggcatagtgcaggttctagtgctatggtgtgtgatgcacacacatacttgcatatacatatacatacatgcatttatttatttatttaatattataatcttcctgaatctaagttggagacaaattcaagtgaccagtattttcattagggatatttcattctgcaggcaagagatgacaacaaacatagcaataataactatattcccatcactcaaaatattttacctgttccttgaatgtttggtagatggatacaagtcaactttggacttggtatattttttgtgggaagagtcttatcttgaaggggtttttttttgaagttacaaatatgtgtattttttaaaatgtgtctttctgtttattggtttctagtttaaatcccttaagatcagggctcaagacaattgcatatggtctcacttatggatgcagtatgctttaagaaatattagaataagtttattgtatcttcaaaatttccatgagctcattaatgttttcagtctgtgtaatcaattaatgactaggagaggtgcacttaggccttccactcagagagtgaaattttcttttttttttttttttttttactttaagttctgggacacatgtgcagatttattacataagtatacatgtgccatgatggtttgctgcacctatcaacccatcatctaggttttacaccccacatgcattaggtatttgtcctaatgctctcccccgctcgccccacaaccctgacaggccccagtgtgtgatgttcccctccctgtgtccatgtgttctcattgttcaacttccacttatgagagagatcatgcggtgtttggttttctgtttctgtgttactttgctgagaatgatgggttccagcttcgtccgtgtccttgcaaaggacatgaattcattctttttcaggcctgcatagtattacatggtgtatatgtgccacattttctttatccagtctatcattggtgggcatttgggttggttccaagtctttgctattgtaaatagtactgcaataaacatatgtgtgcatgtgtctttatagcagaatgctctataatcctttgggtatctacccggtaatgggattgctggatcaaatggtatttctggttctagatttttgaggaattgccacactgtcttccacaatggttgaactaatttacaaccaccaacagtgtaaaaacattcctatttctccacagcctcgccagcatctgttgtttcctgactttttaataatcgccattctaactggcttgagatggtatctcattgtggttttgatttgcattttcctaatgaccagtgatgatgagctttttttcttcatatgtttgttggctgcataaatgtcttcttttgagaagtgtctgttcatatcctttgcccactttttgatggggttgtttgattttttcttgtaaatttgtttaagttctttgtagattctggatattagccctttgtcagatgggtagattgtaaaatttttctcccattctgtaggttgtctgttcactctgatggtagtttcttttgctgtgcagaagctctttagtttaattagatcccatttgtcaattttggcttttgttgccattgcttttggtgttttagtcatgagatccttgcccatgcctatgtcctgaatggtattgcctaggttttcttctagggtttttatggtttggggttttacatttaagtctttaatccatcgtgagttaatttttgtataagatgtaatgaaggggttcagtttctgttttctgcatatggctagccagttttcccaacaccatttattaaatagggaatcctttctccattgcttgtttttgtcaggtttgtcaaagatcagatggttgtagatgtgtggtgttatttccaaggtctctgttctgttccattggtctatatatctgttttggtaccagtaccctgctgtttttggttactgtagcctcgtatagtttgaagtcaggtagtgtgatgcctccagctttgttcgatttgcttaggattgtcttggctatatgggctcttttttggttccacgttaaatttaaagtagcttttctaattctgtgaagaaagtcaatggtagcttgatggggatagcattgaatctataaattactttgggcagtatggccattttcacgatactgattcttctatccatgagcatggattttttttccatttgtttgtgtcctctcttatttccttgagcagttgtttgtagttctccttgaagaggtccttcacgtcccttgtaagttgtattcctaggtattttattctctttgtagcaattgtgaatgggagttcactcatgatttggctctctgcttgtcgattattggtatataggaatgctcatgatttttgtacattgattttgtatcctgagactttgctgaagttgcttatcagcttaaggagctttggggccgagatgatggggttttctaaatatacagtcatgtcatatgcaaatagaaactatttgacttcctctctcctattcgaatacccatcatttctttctcttgcctgattgccctggccagaatttccaatactgtgttgaataggagtggtgagagagggcatccttgtcttgtgccagttttcaaagggaatgcttctagcttttttttgccgagagtgaaattttcaagtcctcttcatagttctgtcattttgcttgctttaggccttttgaacctatgttattaagaacgatatggctgggcatgggggctcacacctgtaatcccagcactttgggaggccaaaaaggagcattgcttgagcttggtcgtttgagaccagcttggacaacatagcaagaccctgtctctactaaaaataaaaataaaaattcaactgggtatggtggcatgtacctgtggttccagttactctggaggctgaggtgagaggatcattgagcctgggagatcagggctgcagtgagcagtgattacaccactatgctccaacctgggtgacagagcaagaccctgtctcaaaagaaaaaaaaaaaaacccacaatgaaagttaatataggttttttgagaggtcataaaaaattaatatgtgtttaattaattaaggtaatatgaacagtaacagtccctgccttcatggagcttatagtctagtagggcattccaacagctactaaatactttctctgttgatggtggcaggaagcacattgtgcccaaagcaaaggtactgaccccagtcctgagagatggagaaaggcttcccagaaaagggatcactgcacctaccatttccaagccttgtattagaaaacaatattgaatttactagatgtctgtaaaatccctgttatcagttattcctttttaactttttaccacgtatgatgttctttgtgtaaccctatatagtttttcaaacttgttcacagtaattcccagttgattttaatctaaaatacagacagactatatgatgtttcaccatgtggtatgtgaataactcagacacatgtcttctaaaatgttgtaattttatggagtttcaccagttccaactgactccaatatgcaattctgtttgtactaattttatggcagcatttgtttagtctgcaatatagatatgtatttttttccttttatctttagttggacacttaataattgcacatatttatgagatatagtctgatatttccaaacgtgtatacaatgtgttgaaatgtatattttttaatagtttccatgtgattaaaataagatttccaaatatttgtaaaatgtattaaaactatattttaattttgttagtttggtacaaggatatttatgatagatggaataaaagaaagcatctccaggcatatgttcttaatgggaaactcaaggcagcttccttttcctcctcctcacctgtctattttctggatgagtcctctctcaactccttcacctgcagagagcaatgtattattgcctagtgatttattattgttggaatcattcttggtaagctcagagagttcgaaaaatgcacaaacaagtacacatggtacctcttcatcatgtggctgtgtaaacgtaattcttgggcaccttgttaacgttcttgtgctatattttactcgtctataaaacagggctaatgtatagtacttactttcacagaaaattgggagagcaaaataaagtgtttcatgtgccttagcattgtgcctggcctacagaaagcctgcaacacatgtcagaacgactgttagaaactaggaggcagaatgtgtaatggttaagtgtatggacattggatgtagactgactgccaaatattttttaaccactgtcttgtattatgtgtatgtgagataagagtatatattgttgctttaatgtgttttgtagttttgtttctaaagcacctgccaaagggcagagacgtgacaattaataaacacttgttgatggacatgtgcagaattgatgcattagacgagtgttttgggattcggaggaggaagagatgaatctgcttttgagtagacaataaaccttgcttcagggtggtgggatttaagctgctttgacagatctgtggattatgcatcaaagaagagtgaggtgctctgcaggagtgagaccagcagagacctgtcggtaggaataggcaagacagctttggaattttagacaatcctaactagagcacagggtgccaaatggggagccaggaaagaggatgttggaagagtcacctggagggaaggtcttgaaagtctttaaatgcaaggttaagggtttaggccatttttaccattttctatagagtaatagtgaagtgttttttttttttttttaagagagagaggttaatgtatattttctgaaataaatttcatgtgagaatataagaatggatagggttactgtgttcatggaagaaataaaagggggaagagacattcacattactttagattttgtggtctctcttttaattggcagaaagaagtagtatcacaggtcaaaaaccaccaccctgtcaacagaaacatgtaaaattgtgagattcaaggtcctgccccttaaaactaggaagaaataggagatgtcgttgctgattggctcttaggtacagacacaaatgtgattcttttcctgcttttctagtgcagtaagacacagtggggacaatgcatggttatttcttctggctttttgattcacaataaggagaatgctgttcaaacctccgaatgcccactataaaccaaaataatgttttagagccagaagcaaccttggagctcatgtcattccatcctcattctgcagatgaggaaagtagggctgagagtagtaaaagaagttttccgcaatgacctagtgggttagtgactctgaactaggactagagcacagttcccagctgtccagttttgtgtctttcctgctacttcctacagcggttaacagtgccagccagcacaggcaggattgccttttgagtggttctgaaatttctgaggtctcttctgaggttttcaggagtaaacacaatgattttacggtaatttttaaacgcctgcttggcctggcaataaaccagcatcatgggtgtaggatgatgccttaccatgctgtctgggaattattgcagagatgtggctttgcaatgatgcctccagggccaccaaaataagttgcctagaagatgcccccatgctgacattttctatagctgagccagtgtagatttggccatcttgaagggccagacttcatgcctggagctgtgttcatgtacatggacccagacaacctcggggacactgcaaaagaaagcagagttaggacagtgatgtcaatgaggaaacaaaggaattgtggttgcaacttaatgggctcactaattcccttcttaggattattgttttcctgaatgtcttaatatatagattattcttagactggtaaattttttgacattgccataaagtgggcatgagtagtctgagaaactgaatgtggctaaagatttaatttattttcagtatgtggcataaacattctggaaaaatctgatacaaatgcaattgtaaaaatccatttaaaacttaatcactttatattctggacttttgggtatgacacaacgttgttgcgtacccatgaggtatggactttaagctgacaaaggaaaacacattttgcatgtcgcatcaaaaaggaaaatgcttgtaaagtgccgagcatggtgactggcacatagtaagtgttggatgtacacgaggtattattttatctgggcatttactgttacaataaaaccttcattggtgtaatccaatggtggatttcttgacagtatcataaattactcagtggttatagggttgatatgtgtttctggctgacatgggaaactttgaacaactctcaagggaattataattgggtggaaactttgatttgtcctttctaaaccaagctaagtagtgaaatggacttttaagaagcagtgagtggtgaattgaaagaaatggctttaaaaacaaggcccaatttgaagtctggggatgcgggtggcaggggtggaggggagcggctctttcatgtttctggttaatctgattggatcagcaccacaggtgccatcagagcacctacagctgtttccaagaaaagaaaagctggcattggtttatactatggctgtcacatttatacacatctagacagatgaggaaaagatgggtgacatgatacacagtaagcctagactagtcagacgagctcagggggctagctttctttttttttttttgtagggttgcctttggtatgtgagtaaatgatgaagcaagttggccctgggctgtgtgttagcagctgtctctcttagaataggaagaggaaggaacttcggtatcgactggggctggaggaggaggaaagcgctgaagtgaaggagctgtacaagaaggcagcttccaactcctccactgtaggggccctggggtgttttgttctctgtgctctcttctgtgccagttgtgcagggtgcctagaatagcggtatcatcgtctgcctcctcccttatatctcttttgctatttattgagggggaaaatccggaaaatatggtttttatttttatttacattgggatagactaggttcttattactgaaacaatatggaaatcatgagcagcttctattccttttgtgcctttataaatattcttttccctatctgctttatcagatcctgcttttaaaaaaaaaagaaagaaaaaaccttatttgtttactcagggaatattttatgtagctactatgagataaacactgagtaaattctgggaatgcagaaatgaaaaacaaagataagtcgttgcttccatggtctagagctcattataacatgtaataagaatatatagacaggatatgaaaagagctccatggagctcaatcaatgagataatttttaatgtgaataataataaaaaaccactgacttcggtgttgatatctggaaattgcctaattccaaaagctgaagtaaaaatacatttcaataaaaagcaacatttacagagaacagtgacattcagtcatttggaattgcaaattccactgttcagtcatttggaattgcaagtaagggcaaaatatgaagactccaatccatgaaaaaagccggctggatgctttcttatgaaaggtctactgttcgcgggctggactgctagcccttctcacgtgctttcctcagaggtctccatttccttcctgaacagggctaataggtcagataaatatccaggctcacaagcagtttatgtcatttccactctgaaaggatccatccctaggaagatattatgggagcaaacttgcggaagtgctattgtgttaaccaagccagctggtgggtttgctttatctgttatggaatttttaccaacttaggtgttaggatgaatatcctgacctggtagagtgtttatttcccccttctttgacccttgacacagctgtttagagctcagtcactcttggttgacatggtcagattcaaagccaagaagagtgaaatgggcaggcttttagactcacacactgagtatggcctgtgtgagtgagtctgaaagatctaggagacatggggaagccgtatgcacttcacttaaggagcttggagggagatgctatttttgcctctggattgctgatttaagctctagagggtcccagcaaacaagggcctcacttatttatagtgtccagcttgttaactggttccagtagctctttcattctaaataccctgacttgatcattacagattctatgcatgtaacaaaatatcacatgtaccccataaatatgtacaaatattatgtatcaataaaacgttcatctgataacatattaggcaaggccatagggctgcttccatacctctagaaaactgcctcgtaggtcagggctgagtggtagtacaggaaggtggagtaatctgtcaagatgctgctttaagttgttttgagatgtggttcaagggtgtttgttgatcaaacaccaagagctagctattaccaagaataataactagcatttgtaaatctccagattgacagtttgcaaagcactttcaagtattatttgatccttggaacaaccacgtatctcctgcaaaaatatgggaatgataatacctgctcattagggatcttgggaggattaaatgagataatataggtccaagtgtctagcctagcatttagtgggtgggagcagctgggtaaataggaaccatctttaacaatgcagaacatgaggccatggaaaattcaaaagcataactgtagtcagatgactacgttttggagctcagacccagggaccccattttgcccttgactaatcgtcacctatgattaaagcagaaacaactatggtccaaacataccacccttaaaaaattagcgagaaagaaagagagagagtttgagtatggagagagcaagtatttttgccttcacttttgacacacaggctccctggactgagcaaagaagttccctttgaagtggtgactatgattgaggatgagctagtttccactctaatataaataaagaagtaaaaatacaaagttgaaatatggaaatccatatggaatcattttatttacttacagcaatattgaattatccaatactcaatagtttctctgtacctaagtgttaacataaatgaatgaatctctgatgatccctaaaatcatttcatcacttgaaatgtgattatttacttaccctggctaaaaatgtaaatttatagtcttggtctatgagttcaacatttcaaatttcttaagagaccaaaacgagttaatattcatatttagttattcatgccaaagcgtggatacatataaaaatgatcaccatgtgttagtcaataataaaactttttgatctgttatccattcctctttctaggatcgctaatcagtcagaattgtagatttaaattggtttctaaaacaaagatatctcaaacatggttgtgcacaaagccactcagggttcatacgtatatatatgtgtgtgtgtatacatatatatatatattttttttatttctttttttttttttagatagagtctcgctgcatagcccaggctggagtccagtggcgtgatctcggctcactgcaacctccacctcctgcattcaagcaattctcctgcctcaggctcccgagtagctgggattacaggcatgcgccaccacgcccggctaatttttgtatttttagtagagacggggtttcgccaggttggccaggctgatctcgaactcctgacatcaggtgatctgcccgcctaggcctccaaaagtactgggattacatcatgagccaccatttataagattcagcagatctgagacaggtttagagtctgatttcaacttgtgtcctggcgttgccattttagaattgtgcgaacttaagggaaaaaaaacaaaactaacttttcaagcctcaattcctcatcagtaaaacagaggtaataattcagtaataactccataatgcttgtcccctaggaagccctggacaaaggatagtggttcctctttccatcactattgttattccttgaatgcctctatctttaccccgttattctaaattttaagccttttctgtagttatatggacaatgcagttggccctccatatttgtgggttctgcatctgaggattcaaccaatcgtaaatcaaaaatatttgaaaaaaaaacaattaaaaaagataaaaacacaaataaaaaagtataacgactatttattgtattattaattattaataattattgtattattataagtaacctagagatgatttaaagtattgcaggatatgggtaggttatatgcaaatattataccattttatatcagagagttgagcatccatggatttttggtatctgtaggagggtcttgaaaccaatcccctgtagatattgaggaatgactgtatatgttcttatacaaagtcaaacaatacagtttatgtaagtgaatcctcagtccttccagctcttcctctaccaactcttgattattcttaaaggatcaactcaaatctcatggaggactactctaatttaacttttaataaaattatctgatctccgacattccctattttttttttttttaccactccttcataattgcatgctgtttgtgtattatttcatattctttgggccggattcacaaaggataggataaagtaataccatgtacagtggcttacgtttgtaatcccagaactttgggaggctgaggcaggagaatcgcttgagcccaggagttcaacaccagcctgggcaacatagtgaaaccttgtctctacaaaaaaataaaaataaaaaaaaattccaggcatgatggcacacgcctatggtcccagttactctggaagctgaagcaggaggattgcttgagcccagagttggaggctacagtgagccgtgatcacaccactacactccagcctgaatgacagagaaagaccctgtctctaaaacgttaaaaatgtaaaaataaacctactttgggcataagtcttccctccccaatagtgtttcaatttctcaagcccagtggctgtattttgtgttcttttatatctgattactcatttttcaacaataagagcattctgaaaagctacaaggtattttatcagtagtaaatagttgttgaaaccagttgaaaaaggctgtaatgatttaattagattacagtctgtattgtgtaggtagaagttgcccatcagattaaaaaaaaaggaaaatcctagcccaccagccattctttcaaattttaaatacatagtcaagcaaaataatgcctttcaggtctctgcacacctttctgaatctacaagtttcttctcaatgatttctttcaagaaagtcttataaagagaccatttgaatttttaaaactttaattcaggcagcagtgatcaaatatttgtgattcacaaaggataggataaaataataccatgtacatatacaatcggccctccgtatctgtggatttcacatctgtgtattctaccacccgaggactgaaaatattcaaaaacaataaatggttacatttgtttgtactgaacatgtatagacttttaaaaaatctctaaacaatacaatgtaacaactatttactaagcttttacattgtattaggtattataattaatctagagataaagtatatgggaggatatacataggttatatgcaaatactatgccattttatataagggacctgagcatctgtggattttggtattcataggggtcctggaacgaatcccctacaggtacctcgggacgactgtatatattttgtgtgtgtgtattttcttccctattgcctcagaatagagtttaattccactttgagacaggatggtaaggtatcatgaggaccatagggtaaacttagcaatatacaattgcttagttttcgaaacttgggagaggaaggggctgccactggcgcacaatgggtcaaggccacggatgctgctaaacatcctgaatgcacagaacagccccccagacagatagtcatccagccccaaatgtcattggtgccaaagcggagataccctgagtcgaagcaaagcatctttgttaatgacataagagaaatgctcagttttactcttacagacatttacttgtttgtgtgacccctaaaccaaatctactttgagatgtagagagctgagacattgcagaactcccctcccgccatctgcagatgccctgagtggcagcctggcagcctggcagcctggaagcagccccagagttctttgcacagcgggcttctctcacccatgcccccagcccaactctgagcagtctgggcccgcacatgccagccttcaggctgtttcaacagtatttaaacctccaaaggcttatgaaatattctttaatcccttcccaaaacatgatttaggtgtatttgatattatctgctatcccctagatttcctagtgtttgcagcttattttcaggactaccttccaggtgtagccgtctgtgtcagagacaggagagcctgaggctttcctccaagtggggagtctgcagagaacaggctggcagctgagactttcgcccaaatggcttatatttgatgtataatagttttaattgtgatattattaaaagtgaattatttccatagatcaaaagttaactcattaaatctgttagtctattttaagttggtcttccaaaggaaccatttatatttatatagcattgcgtctttatccttgcaaaactgtggattctaaactcctcaagtcagagacttggaatagcataaatcagatgtgagtcttcattgctgaggctgaatttattcagtcataatttccaagcatttgttcctgctggaaggtactacttatttcacaagaagttcatgtcatgaaagcgctgagctcgaagggccatcacgcatatctagtccagtggttctcaacctggctgcacagggattaccttgggcagaagcccagcccaatgggacaagatcttctggggtgcagctcaggcattggggtttccccaaaactaccccaagtgattctaatgtgcaaacttggtggaaaaagtttattcttttccaattcctcagttacaatgagtaaactgagggtcagattaattcataaaggcagaagtcagcaaacaccgtaaaggactagctactaaatctttctggcattgcaggccatatggtttctgtgggaactgctcaaaagcagccataggcaattcagaaacaaatggatgtggcaggctgccaatgaagctctataaaaataggtgactggccggatttggcccatgggccatagtttgccaacctctggtttagatctcacagttggttagtagaaacccatatgctaggccacagatagactaaccttcaacaagtgatcttccttctactagatgcagttttcctgtttgaagcagtgtctataacatacccaacttctgtagaggttaaataataattatctttatgtaagttaaggcaaatatcttagcataggtactcatagtctagagcgcagaaattttcattatctgtgtctttatgagaggtctgcattttgatggtatttaccaaatttaaagtaataatcacagtatatgtgttttactaaagtaataacccagacaataatattcctatccaagaaattttttcagctagaaagtcagaaaatgagacagcgtgatcagaccaccaaagcaagcaagaaaaaaaaatcagctaagaaaaatggagatctgattttcttttcacccagtaaaggaatcagttgaaaatctcttaattcttccttactgtgctgatgactcatggggagatactttatctcagatttcttttgaatacatctgagtaaatttgaatatgaattatatctaatagctagagatgcttcctacgagtccttgggaaacagcatggactaaggctgaagaagtggaaagaaagccatcacaattaatgtggagagttatgtgtttggtacttatgaaactttgggtatttttcactgtttgtatagcctttcttccaaagtacactcataaaaatagggttcctgaaatgttaaaaagccactggatctggtcattttccttggagattaatttatctctatttggcaattacttcgtatctatgtttttcagagaaagtcactctacctcttcccttttttatctaaataacacattcaataaaagtgcttcatgtcctgaaaaaacaaaactgtcttatttacgattataaaatggtgttcaatcaatgatttccctgaggggataaacactagagatggaaaaacaaaatcaatttgtttttcacaaattgacatccctctgtatgatgccatcattgaactgaagttattgaaaggggccttatagagagggcaccatagagggaaatcatagagaataacatcatagagaggggtatcatagagataataactgcatggagaggagcctcatggagagggagctttgagaggggacatggaacacacagtggtagattaaaataatccagtaatcaatttggccacataaataatagtgatcataatttatgagggcttcccatactaattaaaatatgcataataacaacagttcattttcataattgtacacttaagtcatgctattttttctctttttgcctagttctatggtatgtgtgatcatggccttacaacttttagaaggtactggcaaatgtggttgcagtgaactgtttttctctgaagctttctgcagtaatcctcctggcattattaaggtttccttaatcatacttggttagaggtgatttgcggtcctaccaaccttaatttgaattttctctctgcctcagataagcttgactctggggaggtttctgaacatctttaaatttgagttcccaaattataaagtgggttcagcaatgactgcttttcatggcttatttgagaatatatgagattgtgctttaaaggattgagtagaatgcctggtttgttcattagttttttcttttcttttcttttcttttttcttttctttttttcttttcttttctctttccttccttctttctttctcttcctttctttaccctcccttctttccttccttttttttttttttttttttttgagacagagtctcactcttgtttcccaggctggagtgcaatgatgtgatctcggctcaccgcaacctctgcttcctgggttcaagtgatctcctgtctcagccttcccgagtagctaggattacaggcacgtgccaccatgcctggctaattttgtatttttagtagagacagggtttctccatgttggtcaggctggtctcaaactcccgacctcaggtgatccgcccgccttggcctcccaaagcgctgggattacaggcataagccactgtgcccggcctccttctttcttttttgagacaacatcttgctctgtctcccaggctagagtgcagtagtgcaatcatggctcactgcagcctcgacctccccggctcagcctccagagtagctggaactacaggcatgtgccaccatgcccagctgatttttgtatttttttgtagagatggggtttttgccgtcttgcctgggctgatctcaaacttctgggctcaagcgatcttcccacttcaacctcccaaagtgctgggattataggcgtgaaccactgcacctggcccccaaaactttcaatgatgacaaattattccctgtagtaccattactattattctaccctttggcataacatagcctaggctgcatgttctgtcttcttcaaggaagtgtctatgattaggagaaatgcaagagggaggaacatactggaggatgattttatctctcgcacatatgtgaggacagcaacacctaagtttgctcactccaccctagtaaaacttcactactggcttaatccttgattcttgagtctcagtggggagtcattttctagtactgttgagagttatatagccctaagggattttatgaaataaagtgttcccaaggagtgttctagaagatgagtgatatgagttaataccaagggtttcttctgacagggagtgttaggtgataagacaactgctgaagattgaactgatctttatccagggaagttctgcacttgagattgtctttataggacaggcaacaggcataaaaaaaaagtgctataaaaataggtttgtttgtttcacagtatcattgagaaaacagctataaagaagatatataaaaatatataaatctatcatgtggtcattaaatgccagcgacttattgaacgatgatttataaatggctgaaattcaaagaattttcatggaaccaaaccaaagcatttcagaacatctttcgttctttcaaaattgaatcaactgttcttcattttacagcttctaaatattgtttgtgtgtgtttttgctgttgttgcacaggaaataatttttaccttaaaatattaaaaacttttttttctaaataataaactccatgcagtaaaaggcaacaatcagagagtgtaatgctagaacatttcaggcatgcccaaaatgcccatggcaggatgaaggaggcaacctcatggggcccagccatttgtcttgtaaagtcttaaactaccataggaaatccctgtaggatgttctattgtgtaagagttccatttaaaatacattggcaatatcctaaaaaaaaaagcagtgaaaatctaaactatgtcttgtagcttattcaaatctattattcatctactgcagcagccaacactgctgcatagagctaaaggagaaaaaaaacgaagataaaataagcaagagaatcatgactactatgaactgataaataaaagtgttaaaaaagcaataaaacaaaccaccagcttgttattgggctttcaaataggtatgtttccgcctcctcctcctcctcctgctccttctccttctccttcattcagaagcaatcatcataccacaagcaaacaaaccattttgaaggtgtttaccaggaatgtttccctcccttttaattttctgacctgagtattggtacaattttttctttcatcctttttgcaggcaaaggggttactggatgtgctaaaggaaagtatgattgtagagtgggaaaagggtgaagaacaatgttttatcttcttatgtcaattaggcaggacaaaagacacaggctcccaaaaataccttcagagtttgtcatcctggatcatgataaccttcaatatgttgaaagtctcgttcatctgggttcaagatcccacacttaacgaaagaaaggccgaaatttcccgtaatgttctttactttgggttttacaaaaacacttctatccaggtattttttcttgttgaaattctgaagtaactcaaggtgtacacatgtaatttaaaacttagctttgaagccgggtgtggtggctcatgcctgtaatctcagcactttgggaggccaaggtgggcgaatcacctgaggtcaggagttcgagaccagcctggtcaacgtggggaaacctcgtctctactaaaaatacaaaaattacccagcatggtggtatgtgcctgtgcctgtagtcccagctactaggtaggctgagacaggagaatcacttgaacctggtaggtggaggttgcagtgagccgagatcacaccactgcacttcagcctaggtgagacagcgagactcagtctcaggaaaaacaaaacaaaacaaacaaacaaacaaaaaacacttagctttgaaaggaaatagcctatgtttccacaaattagagttcataattatgttgcatttctactatataggacagcaacattttcacctgatctgagctcatctattagcctttccttacaaatttgaatcaaaactttcgccaggctataaatctccctataattggtagagagctagataagaattatcccataataagagtttgggagaaccttgtggtattaaagggatgctgacatggaatactgtatatatttctactgttaaattagatgcagtcctaatactgtttgtgaaactaaattaggtcaatgactcagagctggttttatttagagtgagctatatattaaaatgtagcaatatttcccttcttctgaaaagccttctggtaaggatttcaattcattgtagaaaaacatttcccaaattaaggtattttaattaagtcctggtaagaaattccaagcatgcttttttttcccctcctcaaaagaggccttccacattgtgcatttagtgtttactaagatttcaaatctctttggttctaaccagtatcacttagataacacatttcacttttttttttctcccttaagtgtaacctgggaaatcccaactttccctttgatgcactaagtctttggcatctcaatctgttaaaccagtgcaacaatcataacaggcattttctggagatgttacaagggatgaaaaaaaaaatgaatgaaatgagttgactttttaaagaacgatgccataagaagcaagacataaatttgctccagaagtcaaatggtgtgtggggagaacaggctttgaaatcaaatggaactggtttggagttccagcgctggcatcactagtcgtgtaaccctgggaaacagcctgagtacattttgtttgtttgtttgtatttttgagacagaatctcactctgttgcccaggctggagtgcagtggcacgatctcagctcactgcaacctccacctcctgggttcaagcgattctcctgcctcagcctccctagtagctgggattacaggtgcatgccaacacacctggctaatttttttttttaaaaaaacagagtctcgctctgtcacccaggctggagtgcaatggcataatctcagctcactgcagcctttgcttcccgggttccagtgattctcctgcttcagcctcccaagtggctgggattacagatgcacaccaccacgcccagctaatttttatatttttagtagagaccgcgtttcaccatgttggccaggctggtctcaaactcctgatttcaggtgatccacccgcctcagccccccaaagtgcttggattacaggtgtgagccaccacacccagctctgagttcatctctccatcactagaaatcagggtaatcatacattccttatcacattattaagaggactagagatagaatatgcagaatactgggcatgtagtatgtgttcaataaatggtagctgctattgttactgctactactacagctgctgctactactaaactgctgctattctcattgttactattatgactcctactattatttctactgccaaacaaggaggactgtggaaaaagaagccactttatccagctctaaacaaatgagttgttacctcactgtagcccacctttctagcaggaataggagaatgaccaagtgttttggaatcagataaacccaagagtaacttaaggagaatgataggaccatcgttgataggagagcctgagtacattcccagtgctgtacttgtgtggctgtgaaaattattgttccaaagttgaatattgtcaagggtgttgagatttatctcatggtcaatatttgatctttcaaagctgacctatacctaacacacttcaaattggttcagtgtatgtagcccttgttacgtggatattattgtgagcacttatataccagggaatgtgtcatgaggaagaattattatgtgtttggtatgtagtcattgaattaagacttccacataatgaactggaatggaattgcattagaaattctttttttcatccaaaataaaagtaaactcaaatataattatgatgttgccttctaatgtgacctgattgccatatctttgtaatgttccgttactcctgccaacctaatgtcagtgtgtactccaattcaattcagcaaacatttattgatcctagtcagggatgggaagacactaagattagcacaaagatacctttgtcattagtaagttactacccagtaaatctggctagtatattaaatctatggtcattttttacattttgcttttcattctaaacatgtaaaatgataataaaaaaagaaagtatttagaacagtaaaggttcaagtccaccccttttttcttcacctttttgtttagacactatttctgacgttaattaccacattaattgggtcttaagttccccttccagtcctcattatgacttccacatttcttacaactggcagaccttgctaagtcgtgaactataagttttttttaaaggttcagagcatttagtccagcaacacaaattaccctatggagacactatatacactagtagcaatgagcaaatgtttcttttatttttataattgttttggaaaatcatatgattgccaaagacagcctacacatggtcaagttggattcatcccagccttaaaaagtctgcgaaacacattaatacttgtgatgtatagagttgagggatgttttgttttgttttaacatgcttcttatatgtacattggtaatgtttaatttaggttaaaattctatgaatgatttaattgatattatccaggtttgttaaccattttaaatggccgttgattttgccaaattccattctatgccattagaacgctgtccacactaagttccgttaatgggggtaaaactcccatcatttgactcttaagtatggtaaaatagctgtctagaaataaatgaaccagagtcctggaaaatccagtggagatgcctagcaatgggggtccccaaagacttcagcgtaaggtgcttatcccttgaagcccccaccctcccacccttcctctatttgtttcttaattgcacattgttgttcagaaaattcacacttgggatttttatattttgtgatttgaactcatttttgcaatttcctttttacatttctagagagctgcttgaaatggatgctaaactacaattccagccttatgtgttaggaaatactttttctctactacaaagtgcaaagaactggaaactactttagtagagttttcatttaaaaaacctctatcgtacttcagtactggaggaaagaaaatgcttgtcaatcaacagccttgtgtttttcagtcttgatatatgtaattgatatatgatatatcaattatatgtaatatcaaaagagatggtgtgcacaaagcctgcctcggagtacattgaataatattttattcagatattcattttaaagttagtgatttcagatatggagaagttgtagtcaccagctgtgatttactggggggtggtgggagggcagggggacctattactggcacctgaactggtgatttctgtttacctgtaatccaaaaataagtaagtgtctgctaatttcacctgctaacatgtgacagcatctttccaggcaaagagtagaggtagccctgagagtgaggcctttcttttcggctcatgtatgggagagaattgtgttttttagcagagaaggagatagcttagacctattgcatttggtaccttccgtagaatgtcagtatgacaagtaactggactcttccagacagatctcaagagaacctgagtgcccattcaagagaactggaaaaactttcaactcccaggcagcacccgcatagctctgaaatttgagagcactctgcactctcaattcattcccaggatttgaaaccaaagtgccaaattgttttctcaaactctgtaggaaccgttatccacctactcacccatctacctgcccatttctttagcaaatatttgttgagactactatgcagcaaatactgtgttcggtgctttgaatccaatggggagggagagcaacctgggtcttgtcctaaggatgctttccttttaagggaattcatgagtcttttctgccctaaattgtctaactgtaagaagaggcagggagaacctcagtatgtgttactagagaacattggcactagtcgatttaattttcaccaaattgactatttggatgagatcctcattatgcacagtgcacatccaacttagatggaaccatctaaattggaataatagacctttgtgatctgtgactccacggatgaaatattgggtctcagacaatcaaagacagactgactctcactttgaagcaatgcatcaggctttataattaaactagtttagtcgcaaacttcttactatgaacctcaggacgttctgcaggtaacaactagaattatttgtgtggaatactaacagcccaggaaacagattaaagtcacaggcagaattctttagccttgttaagtacttggtgttaggaagaatatggaaatttcccagatcttgaaacattgtaaaggccctgggatatactatctaaaggcctgcaggcagtatccagaagtcttccacgatccttttttctttttcttttttgagatggagtctcactgtgtcacccagtctggagtgcagtagcacaatcttggctcactgcaacctctgcctccaaggttcaagcgattcttgtgcctcagcctcctgagtagctgggatcacaggcatgtgcaaccacagccagctaacttttatatttttagtagagatggggtttcaccatgttggccaggctggtcttgaactcctgacctcaagccatctgcccgcctaggctaggattacaggtgtgaaacaccgcaccgagcccaggtgtcttccacaaaaattagccaggcatggtggcacctacctgtggtcccagctactcaggaggctgaggtggaaggatcacttgagccagggaggtggaggctgcagtgaactgtaaccacaccactgtactccagcctggctgacagagtgagactctgtctcaaagaacagaaagaaaagaaaagagaagagagggtttgatttttttttggctattgaggaaactgtagctgtaaatagtgttaattctcagaaaaccagttaaatggtaaaattcaggagatcattataatcaactttaatcatgaagagatagttacatatgtggctcagtttctttttttgtttgtttggttttgttcttgttgttttgaattcagaagcagctttattttaagaatctcaatttatagtgaagtctcaatctctttagtcatcattatgtaaaatagaataacattgcaaagaaaaatcaaataaaagattaaaaatcctagggctagcacatgattgaagcaatattgaaggtcacagatagtataaattctctgattattaacagaggtgagctttgttatagggagatggatcattattaagtcatctgtctgatctagagccagccgcacgatctaatgatttcattcttggattatttttaatatgtagaattagagatgtttgggaagtgtttgctattatcttgatagtacagtttcctcctaaattacttttgtaaagtaaaataatgttacattggaagaaagtgtgtatttcttagtaatgcttcacaattcctcatcctacatttcaataaatcatcttatacctgtcagcacatgtagtctaagatttattgcatggtccattgtgaagcagatagctccttggccagagagcaatttctgaaactaatttaatcaaaatgtttttataatacagtgaactatggcttgatgtcttaaatatgcattgatgtcttcagaaccatatgattaaactctatccaattttgaaatggaattaagatttggcttcatatgacttctgttatagtcaggaaatctttggttgcattaatattatttatgtactgttattgagcaaacattcatcagtgcctctatttgcacagccaacccgctagatgttaagatgttgtgggggaacaacaacaaaatactagtttagtagaaagacgtaactgagagcttggaaggagcagtagacatggcacaatttattggccaaaaaggaatccagttttgctgaagttgaatgttcattttgcagggtggtggtaattatagctgccttctactgggaaagttttaaacctatagttttgatgagtttgcacgccaactcaggagtttgaacttcatcctttaagagttgaaaaattttggagttttgagagtgatgtaagcttactggaaagattacgttgacggccatgtgtggacccaactggacaaaaattagaggaatgaaaaccagtgattcatggaagattgttagaatggaaaccttgggaagaaaagggaaaactgaagtcaaggagtcttttaaaaaaacaactccccaaaatctttagagagtgattagatagaagacatgaagagcatagtaatatcttttgtaaagatcgaggccgggcatggtggctcatgcctgtaatcctagcactttgggaggccaaggtgggtggattgcttgagcccaggagttcaagaccagcctgggcaacatggcgaaacctcgtctctaccaaaaatgcaaaaatcagactggcgtggtggcacatgcctatagtcccagctacttggggaggctgaggcaggaggatttcttgaacctgggaggtcaaggctgcagtgagctgagatcacaccgcagtactccagcctgggtgacaaagtgagacactgtctcaataaaaataaataaataaataaataaagggaaggtggggagaaatttcaaaggaacagatgatgcatttaagacagttgagtttaaaataacaggggaccagcaaagctgaaagttggtattgaactgatagtgagagactaaagcttaggtcagagttgagatctgagatcaaaatctgaatcgtgtcaggacagaggatggagttaaagctgtgaaaaagaatgccattgctgatggaatatgtacatatgaagccactgttttattataattgtttggatagaacatgttctggtgggaaactcacttgcagtcaaaattgcacagtgctaaagtctgcctttaattatagtaaatgcattcgatttgagaatttgttcattacctgtatcagtgacactttattcaaataaaaacagcacactggagaaagataacagttgtggaaggccaaaagtcctctttgtgatttactatcaccatttaattattaagctgtctgatgtcatgtgacactgcctccccagagtgtcctatcacagtgatagacgaaggtcacagacatttggaaatcaaattataaaagtcacactaaaaagtcctgagagcaaagtttaacatgtttgttttcagctttatatattttctgtcaagctgaattttgaattttgaagaggtacactgagtccaaccaatggttgggggggcattattttttcatcataaacagatgagtctggatcctctgctggctggttgccctctccccctttcaataccacttaatttttttttttaagaacgacgtttataagtaatcaagaatacactgggagcaacttcagcatgactgtttttttgcgtgtgagagagggcacgttgtgaacatctgagttctatcttcatttttattagaaaaagcaatttagaactgccagtcagatgggttaaaaagcacagctgatcgaggtgcagcatccatgcctgaaccttctgtgtggcatgacattggctcataacccccttacaccttctctagctctctcttcagttctgcttcctgttccgcagtagagactgaaggaactcgggaaaggcccaagaatgggacctgattacaaagccttagtaagtaataagataacaaaatgtccacaagaaagggaaagtggggagagaagcagagcaattgcttacttcctacttagcttttcctctctttctgttttcccaggggaaggtgcccaacaatttgtatttttaaccggctccccaggtgactgctgtggttgggccaagctacattttgagaactcctggtctaccttctagattctacagaaaagatgagactttgcaatttgtaattgttataactggcaagtctccttccacttctgagtattggacagttttctctcactggattaaaagcaaatggcttggtttttaaaagtttttgaaagtaacatttattatttgacttccgctttagcaacacgttgtatatgtaaactcaaatatagttcagggaactgagagctagttcacttccaaaatacagtgacccataaattgtctttagtcatgtataaacaaatgaatgctattgggaaaatgccttagtaaatattttttgtaaaacacagcaaattaaatcactttctagaaaatctattttttttttccccaggcaagtggccatcaatcaaagaagcagaatactaggtgtggttttctttgtttttgttttgttttgtttgaggcagtgtctccctctgttgcccaggctggagtgcagtggcacgatcatggctcactgcagcctcgacctcctgaactcaggcgatcctcctgcctcatcctccggagttgctgggactataggtgcatgccaccacgcccagctaatttttaatttttttttttttttgagacagggtctccctatgttgcccaggctggtctcaaactcctggattcaagtgatcctccagccttggcctcccaaagtgctgggacaggtgtgtgtcaccatgcccagcctcagaatactttatcactttggtttccaaatattgggaatattttgcaatttaccttttagactacacaaggcttcagggcaatgctcttgcctgagttgacgtttgaaagtgaatagagctgtaaatctattcttttgtcgtcagaatttttttaatgtttttcctaaatatttaagttaaatgtgttaaaatattgttgaatgataaacatctgtagtacacttctgttgtgtttctggtgaaagtaactactgttaaggtcaacagaccaaatttgtatacaaatgctttggcaaattagaaattgaggtgaccattcagtagctctttttaggcattgggaatactcgaatgcaagaaagcattcccttatattttcaagtataaaaagtcctctaaattccttaacagcaacaatcagtgtttccccgctaagcactgttttaataaagttgctgggattttctatgataaaatcacataaatttatacttctacatacatctatatataattttattcctgtacttgttatatacatataagctgcattacaaatatatttttattctgaataaatcctaaagtataaaagtagtaaattgaataaattattgattttccttcactgtatcacagaacctgtttctccattttgagcaatggttctcgaacttggatgcacattggaatctcctgggtagctttcacaaatcctgctccctggacctcactcaggcgaagttatttatactctccggttgggaagggaggatagatccaggtgattgccatgtgtaggccagaatgggaactactcccctagtagacactcctcatcttctttccttccatgatttccacatttctttcaactcagtcgaaatcatcttgaatagacaaaggcagtgtcggtcctactaaaggttgaggaaatggctgagtaaagatgatgaagtcagggacaaaggatgcaatgaattttaagaatttgagattcaaacttcaaaacttaggcaagggtctgtttttgaaggttcagagctgaaaaacaatggcatgctttcatattcttctttgattctgtaggatgtcccaaatggggaattctcttacataatattgattttgtaaattcctgacagatcgtacccactttggatggaatggaattttaatctatttttttgagccaaagagtgtgacctcccttggccttaaatatttttttgtaccacacatgtggggatatgagtattgtgaaagctacgaacctttcctttgaatgccacaattcaagaacaaagctgatcatgtattgaattttaataatcattttcagcagctggtccagaaaagggcattttcctctaaaacctaaaaaattcagaagataaattcctatagaaaaaaaggaaatcatacttatctattcaaaattattagatcaaagactttcaactattttagcttcaaatatgtttaatatattgagtttaactgacatgaagtacctgcaggatgcgtggtgctggcttagaaaaagatttggttttcctacagtatctgaaaaacaaaaatgtattttcatccatccaaggctaagcatccactatgagactaatttgacattcaggtctggtaaaaatgtttgatggtatcagttaaaaccctgttgaagtaggaagaccagaacatgttcattagtgagtatctggcaatgttatcatctacttaagatggaagaaaggggataagatcaaaattattcaatccctgagtgatggaggaagtaaagcttgaaggggcctatacagacaacatgtatgacatccatcagtatcaggggattttatagacattaattatctagtgctctacaccctccctgcctgccttttaaggtgtattttatgattgaggaaaaaaaaaaagaccaggataatagaattgaggaagatagcaatcaatgagtaattccttatccagtcggcacttaaaactcaatgctttatatatttatttgcagagtggtaggaactaactaatcctcatgctgtgccttccttactcacttttgaccatgtttttgctatagcaaccttgatacaattgaagattgtcatttcttactcttcctcagtttgaagctcctgctttcctggacaaaagacacaaataaaacaggaatttattcaatcattgcattttatccataatttaagacatcttatctataatttttttctgagttaaaatttattttggtggttaacaaaaagagtctttagaattttgagtacctgaaggattggaatttgaggcatcctcctacactcccatagtaggtgttgaaaatgttaagttaattgaattatattgaaattttaaaatggcttggagcaacagaaaaaaaatgttatgtataaattaattaaaaactacatggactgtttttttttttttaccatccacatggataccagggatttcttttctttctctttctttctttctttctttctttctttctttctttctttcttttctttctttctttttctttctttctttctttctttctttctttctttctttctttctttctttcctttctttctttctttcttggattattaaaaagagaaggttgttttttaaataaggaaaacaattttctgcaaatggccagatagcagatattttggtctttgtaggtacaagtcctcaactttctcattgtactgtgaaagcaacagtaaacaatactttatggctacagaaatgtgagttttgtatacttttcatgtgtcataaaatgttattcttttcattttaaaaaaaattatttaaaaatgcaaaaatgagggcgggcacggtggctcacacctgtaatcccagcactttgggaggctgaggcgggtggatcacctgaggttgggaattcgagaccagcctgagcaacatggagaaaccccttctctgctaaaaaatacgaaaattagctgggcatggtggtggcacatgcctgtaatcccagctactcgggaggctgaggcaggagaatcgcttgaacccaggaagcggaggttgcagtgagctgagatcgccccattgcactccagcctgggcaataagagtgaaactctgtctcaaaaaaaaaaaaaccattcttagctaacaagccacacaaaaacaggcggcacgcaaggtttgaccagtggaccaaccatagtttgccaacctctggtttaggacattgaatatctcctgatttgaaagttttcacttgaacaaaaataattaactactattagtctgttctacaatatcctcctcaccatgtaattcttaactggcaagtagattgcctcttttgttttatttatttatttattttaaaagacagggcctctttctgtcccccaggctggagtccagtggtgcaatcataactcactgaagtgttgaactcccaggctcaagcaatcctccctcctcagcctcctgagtaactgggattacagatgtgtaccagctgtagtctacaaatttgacctgtacccaatccttggcttaatattaatttttaatttttaaaaaagtttttgtagagatgggggtctcactatgttgcccaggctggtcttgaactcctggtttaaagcaatcctcccgccttggcatcccaaagtgttgggattacaggcatgaaccacagtgccctgcctgtggcctcttttgatattgctatggcagcccagagtactgtgttgagaaggattcagaagttgaacaagggcaaatgagcagagagggctgccagagagttgcccaattggaccatccacagctcttctagctgtgttatagtcttacaaaatgcttcctttatgtcctgctgataaaagttatagacttattcttagaagcatttttctgcaggcataaattttgcaactgagatcattgtttttaagttagagaatttgaaaggattctagtaatatagcttcatgtgatatccattctcaaaaccaacaaatgtatttattggtcatttgctcacctctcttattataggcagaaatggggctggggaggaggagtgaataaaaaaggccattcacatctctaatacctggaaataactagtcgtcattggatctgctaaaattataactaaatgaatagaactatactaagatacctatttatctccattaaaataaaagctcttctagaccatacacagtatttaaaagttgttctctgtatgttattgactaccaggttagaaaaataaacactgaactcctaatgatggaatttataaatatatggaacagattctgtggtgttaatatagaaatttcaaataaaacctgacaaggtaaacactgtatcacatatcaaaatgacttaaattgtagtccatggaatactagacttaaatttatatgcagattgtattttattaggtttttgaagttccctcggcggcctgtcttgccagggcatttggaaatggtagctattataaccaatgaaaaaaatgcattaaaaaattaaaacaacctaaattacatgtatttgcggtctgtcgagtcaaacctgaagatagtctcagcctcctgcagtgcaattaaaacatctttaaaatttagttacatataaagaatttatgcttttatacaagtggcatgtgttaatatgggtgtgttttcatattaactattgtgattaaagtttcttagaagaaaatatatgggtcgtggcacttgacgtgtccatatcctgatcacgctggagtggtggtgttgggtgccagggctccgaatacagttgctgaatgtcactctgaatattatggaatgaaacaagccagatctgtgtttgccttgaaaggtatccagacctaatattgtactttaaagacattctgaagtattgacttcggaataagagcaagcattctttaagtcctgggcaaacccaaaaggaattactgaaatctcctgtttcaagcatacattttaatagtagtgctcaatgacaagtcattaattccctgcaacctgactcttaggttcaggtctccaaaggctaaaattaggggcatttgtctgcttcccttgctatttgattgggtatcactgtatgtagaagtacaaagctcatctgttaagttggatttactattctctgctggtgtccctatccatgcctaaaggctcatattgagattggtgtaaaatcagctgtcccaacatgaattgttcaattatcagctcaaataagccttactaaaaactacctaacatgaaggaggttgactgtggctctgtgaagatgcatccaaaatgtgtgcattaaaaataaaaattataagaaaaattaatcaccctttttgcataaagtatgtaaggaagcctcattctttaagcaacacatgttttataactttgccttccacaaatttgacctatacccaatccttggcttaatattaagaaactaaatctgcccacaggtatccttgccttttataaggaccattttgaattatttgtatttcttttctttggtggtagtggtgggagggtagtattgaatgccaccaagtcgtaaacctcacagaataagagcactatgaaaaaatcacttggggaaaaggtaatgaattaaggctgggagcaacttgactttgggtttagatggaacttgaagttgatgtgttagtgataattgctatagcatctctctatttttataaatcccggtttggaaaaatttgtttgataatgttatatttgccttcacaggaatcctgtgctctggacagtgttatataacattcctcaaaaattcttctaaactctcaaggccctcttcttggggtcagactcaacggtaccaatgagaaaagcctgaaagcatggaagacttctgttgtttagcaaagctgagagaagacattgtcttaactatctacactagttgttaaattaactaatcagttgatttactacattggatttcagaagggttgtccggtgaatattcagttttccatgctaattggaaatatcattgcatatttaagggtgtacggtgggaagggactaagcaatgatgggtatacagcaagtactcaatacatcctgtggctttattatactctctttttgctggtagaattttctgctacacacatgcattccaggcaaagggaagagactgcgcccatgctcagacccagaaacaagcctggatccataaaacagcttgttcacaatggcaggagcacagcacaggagtggggaaagtagaggaaaagaggtatgagtaatactgaccacgaaaggaaagggagttgcccattcaaactaacagatgagaagggcttcatggacgagatgacaacaaatagtagcattagcattcattgagatttaggacattgcacaacattttagaaatatgtacacttagtctaaaacagggacccgcagtccagatgggaattctgacaataatcacatcatgagaaagctgagcaaataggattcagtgtttttggaaaatgtaatcttagggggaaatatattcttgtagctatgtactactaaattgaaaatctacagaacaaatcatttatgaaatgtgtgggcatgcttttaatttggtggtggtttaaatattttattaactgtatgggcatgcttttaatttggttgtggtataagtgttacaaattaagctttttttaaaaatcagtctaaactcgaaacttgaaaaacaagttttttattttatttaacaagcaccgatacaacacatcgtgagccaggtactcttcctagggcttccatgtatctcctcctctaatcatcttgacagccccatgaggaaactgaggcacagaggttaagaacttgttgaaggtctcagagctaggacttcaaaccaggcagactggcaccaggttctgtgtacttaaccattatgctccttaaattagaatatctacgagtcaaaatgctgtttaattttcttcagattattgtgggttctgtcaagctaagctttctgcccataagtgaaagtgctcttagcatcttgtacagaaagaattcttcctagaggttcattgagtggcatctatttcagacttacacaaaaagtttgggacaaatgttagtgtttaacagaagcagatgtttatcagtggcccagacaatattatcattttgagttttaccttctaggctgggggcgtggcaaacaacagttgtgggtcaaatctcactcaccacttgttttggtaaataaagtttcattgaacacagtcctatccactcgtttacatgttatctatggctgctttcatgctaaaacagcagcagaattgagtcattgtgtccaagaacatatggccaataaagcctgaaatatttactacacgatcttttatagcaagtttgccaccccctgttctagaccagtgaggtagccaccagccagatgtagctcccaagtgtttgaaatggggctggtttgagttgagatgtgtcataagtgtaaaacatatcagattccaaagacttagtaaaaagaaagaacaaaatataaaatatctcatcagttttcaaatattgattgcaggtggaaatgacaattttattaaaattaacttttcttggttctattttttttaatgtgactactagaaaaatttgaaatgtgactcacatttgtggctcacattaggtttctattgatactgctgatctacagcctggaatttggaggatatgtgacctctaggaaaagcagaaagaggaaagatggggaaagagagaaaacctcttgtatttgcaaatgtctttctaaagcaataaaatattttctgatttggctcttcctcacagaaaggcatacgcaaaaatgggttaggtggtctatggagatgatcgtagatgagttctcccagaagcagactctgactcagaatttgaattgggaggtgatccaggaagcacctggagggagaggggatgcaaacagggaagagattgaagaggaaagagggttaatgagcaggttgttgctgtggacccatgtgctgcctcccaattgcgccctgtgggagattttgtagacagaggctcagagtggttccacccaggaggtgaaaaagctgggctgcatatccaccaattgccagtaattgccacttgagggctgctcctaggaacatcagcttcttcttactctccccagcacctgccttgcctgaagccaggtaaggccctggggtgaaaaggcacaggtgcttgcaggaaaaagccatgagcaagctggagaatggtgcctcccagaggcacagggttgggcccttctagtgtctggaactgtgtccaaactaaatgttccatcttctaattcataatttcaacagacattcatgtagttctctggtgaatgtgttcattttctcatttgatcttaacaatagtatagataggtagatttatcattatccatacattatggatgggaaaactgagcccaagacacatccagtcatttgccgaagagagtccagctgggatggtagtcccggtctcctccctcttcatatgtggtcactgactccttggatttctacaaaacttgccttgagtaaggagatgtcaatatattgatgttttcaaggtgagaacaggaaactaaaaccaatttttcttgtgctctgtagaatttttttagatatccatagggcagtatagaaactgatatctacttaatcccatgacttttatatggaaaagtatgatctctgttttgcacaagtcacaatcaaaatcaagagattatggagactgctgaccactaccacacaggatgttagtgatagagttaatttccagaaaatcttcagagaagtccctgtagtggaagcttatgggtgcatggctcattaaggactggattttgttatcttcccattacccaggttcccttcaaaggtgttgtcagcccctttggtaccacttggaaacaagtctctctcccagcttaatttccctttattatgcttctaactgactcggtaattctttgcagacttcagtaacacttgtactatttaaatttgaataaccccaaaggatctggataggtcaatgtgtttaaaccacaggctttagtctatgtattagttgattaaaaacagatttgatgcatgatgtatacttaataaagggagggggaagcaagcagatgtttgtaaaatctcaatgtgttggattgcatttctttggccctcttttgctgactaactttagaaaagtcatacttatgacaattgaactgtaaacagttagatgatgtatttccctagaaatttcctgctgtgaagggtcagccaaaaagaaaagtatcccctagtattaacataccaaaaaagttgacaaatatacgttataatggttatgtctatatcaaggacattgaagaatgggatgcttcaaaatcatcctctagtctctgaccataaagtgattagcagttgcgattcatttaatccaaacaataaaaaaaaaaaactttggcttttgttgttgttgttgttgttgttaaaagcaagtttttctttgatgcaagcataagatcaagttgtacataaatcactgtgtctagttcattctctgactcttcagcctcttgtatcccattctttaagtgaaaaagttattcttcccctttaaaattgtcatatttgaaatgttttgagtgattccaagacagaattgaaggtttcttgttggttttccagtccagatgaaatgtgcacaaagccttcctctgaagtttgaacacatgagaattacagataaaatattttaaaatgtattttagtgaatacataaccaagcataaacatatgtggaaagcctccaaggaccggaaatgaaagaaagtgtagagtggtgagagaagactgacactgggctactcccaagaagtggagatgacatggggcaatggtgacttcagtggacacatagggaagtgaacatcacatgtggcaagagccttgtacacctggaggccaagacccccatgcatagactggactcaaagggaacctgacatcttctctggaattgaagccagacacagaactctcatggaaggaagcagaggcactgagtcaaactaggatctgtgcctctgttgcacacgagtgccttgtgggagcgtcttctttgggaaaagaacctcacgccctaacctcagaatatgcttcttatctggctgggctatgtcaatccccaaatcacagcacagggaacaaagtttacatcgtatgagctgtcagacaaaaattacaagacaaagataaaatcagatccttgagaaatagtcaacaagcacagggaaatacagaattgccttttctcaaaagagcttaagaataagtaagtttagttgttttgagattatggagaagagaatcgtgtttttgtaataggaacagagagaaattcaataagaaaagggagatgtgataaagaacctactagaaatgaaaatgcattcattaaaaaattttaaaatcagtcaataggataaacaccagattaataagtttaacttgttttaaaaataaccagaaagttctgcttttgacatatgcattttaagccttagatgaaagtggttcttttccttaatatacttttctaaataaaaaatttagggaagtagaatgagctaaaattttcataaataaattttacagcataatgaaattaacacctttatgaacttgttagttttcaaaatccctcaaactctttctaaatcctctttcttggatggcattataaatttgaggtctgttttcttttccatgaaatttcctgttgttccgtatctttgccatacttgtggaactgtctatatgctaaaacacagtttccctaatcttttgccctctcaacctctctgatgttggcatacgacattgttctattccctgcccatggaagattcttccacatgctcacttctttctttccaagaagtttccactgttgtgcaacaaaaaacccctggacatccttcaagcctcagctgcaagacttggccctcttggaaacctttaaccagcagccatcaactctttcccttctcttgtttgcagcatctttctcccagtttgtacagtcatccatttccttgtggacagggaatagatattaatatttttatttgatttccccactgtctctttcagagtctggcatattgtagaagcttaataagtacttgttgtatgaacacataagtaaatgaatgaatggtaggaacacataagtaaatgaatgaatggtgtaaatcaagcttgtccaacacgtggcctgcaaggccacctgcagcccagaagcgctttgaatgcagcccaacacaaattcataaactttcttaaaacattatgagattgttttgtgatttttttttttagctcatcagctgtcattagtgttagttattttatgtgtggcccaagacagttcttcttccagcatggcccagggaagccaaaagattggacacccctggcaatcaagagcatgtgaatgagaaggaacagagaaatcttagtgagtcttacccagaacagagagctattgtgtttgaaaataggattaaatagtcattccagagaactttaagtttgatgctctaaaggaatagggaataattctagagtcttatgcaggataatgagtggtaaatacagtgttcaaagaaatttgatctggcattgatggacaaagaatagaagcatgaacaataaaatgtacaattgtttgttggtatccataaaggattaatttcagggtctctcatagatactaaaatcatggatgctcaagtccctgatataaaatggcctgttatttgcatataacctaatcacatcctcctgcataccttaaattctctctagataacttatattacttattacaatgtaaatactatgtaaatagtagttatattctatggtttagggaataatgaggagaaaaaagtctgtacatgttcagtacagatgcagtcatccatttttttccaaatatttttgatctgcagttggttgaatccaggtatgtggaacccagtggatacagagtcaactccactacaactgaccaaatgtgtgtgtgatgaggacttatcataaatgtctataaatgaccttattgtcagcaagagctaaacaattcaaaccttcctccaagggattagcctcagcctgcccataaaaggataaatctgaaaaatccaatggtagttgatttgatgtgggaatatattccttatgttattgccagctctgattcaagtaaagggatagaaatccaattacctcctttcttcctaggtcgtgacctagagataacctataactaattattctgttaagtatccctgagttagtgcaagaagcaggaacaaaaagaataaagtctgagcgtgtctaaaaggttcttttaaatgcaacttttgaaaatccagtttaaatctataaatacttgaaattatgtcgatttcactaaggtttctgaaaaatgtatcagtttttcctgagaatgagtaattttgtgtatctgaagtataaaagtatgcagaataatatttttcctcttttttttttttttttgaacagcaaaacttagagagtaacctcaccaaccttattaagaggaacacagaactggagacccttttggctaaactcatccaaacctgtcaacatgttgaagtgagtatctctgtatttctgtatggtatgtttcatatgaaaactgccagatcaaggttttgatatcctcatgctttataattttaaaacaagaatctttcttaaaattaaatattttgcaaaagccaaaataaaagatggaggaaattaaaaggaattagaacttcagagagtctttcccatccagggctgcttcccattcccattatagctcttcctgatctagcattacatagcagtcctaatgttggagattttaattgcccttacaaagaacagtcaaaaaaggtattgtaggccgggcgtggtggctcacgcctgtaaccccagcactttgggaggccgaggcaggcagatcacgaggtcaggagatcgagaccatcctggctaacacagtgaaaccccgtctctactaaaaatacaaaaaattagctgggcgtggtggcatgcacctgtagtcccagctactccagaggcggaggcaggagaatggcatgaacccgggaggcggagcttgcagtgagctgagatcgcaccactgcactccagtctgggcaacagagggagactccgtctcaaaaaaaaggtattgtattagtgtactatggctaccataacaaattaccacaaactgggaaagtatgaaacaagactaatttattctctcagttttggagactagaagtctgaaatcaagattttggcagggccatgctccctacaaaggttctaggggaggatccttccttgcctcttcccattttctggtagttgcaggcaattcttggagttccttggctttcagctacagcgctctaaacccttcctccgttatcacattctcctggtgtgtctctgaatatgtgtccaaatttccttattgttataaagagcccaccctactccagccttacctcactttaacttgattacatctgcgaagactctattttcaggccaggcatggtggctcacaccctgtaatcccagcactttgggaggctaaggcaggaggatcgcttgagctcaggagaccagcctgggcaacatggcaaaaacccatctctattaaaaaatacaaaaaattagccaggcgtgggagcacacacctgtggtcccagttacttgggaggctgaggtgggaggatcacccaagcctgggaaatcgaggctgcagtgagctgagattgcaccactgcactccagcctaggcgacagagtgagaccttgtctcaaaaaagaaaaaacaaagattctgttttcaaataaggtcccatttacaggtaccaagggttaggacttgaacatacctttttgcggacacagtttaatgcactgcaggtgtatattaatgcatcttagttgtcagatatgtttccatgaaataaaccacaattgcaacaacagcagaacctgcaatgactacactgaataaggaaaaaatagatgccacttcctttatgtgattttcaaattcctcttccatcttctcccaaactgtcttttttaccaccccaccccatgaactgaaactaaacaattatcattcattacacttttaagccttctggcccttaaccaagcagttccctctgactggtaggcccattcctctaacccatgtctatttgtcagaatgcttcttgtgtatcctccaagtcctaagtcaaggggcacttcagttgtgaacgtttctctggttccctggaccagagtcatcgctcctttctctgaatcacgtaacattttatgataccgtgtatgtgattcagagaaaggagagatgtccccgccccaatctcatgtcgaattgtaatccccaatgctggaggtggggcttggtgggaggtgtttgggtcatgggggcagatccctcatggcttggtgctgattccatgataatgagtgagttctcacaagatctggttgtttaaaagtgtatgacactcctcccccaccgcccgcccccctcccatacacactctttctcttgctcctaatttcgccatgtgacgtgccagttctggctttgccttctaccatgtgtaaaagcttcctgaggcctcatcagaagccgagcacatgcctggtgccatgcttcctgtgtagccctgcagcacccgtgaaccaattaaaccccttttctttgtaaattacccagtatcaggtatttctttatagcaatgcaagaatagtaataatcttctcatggctttatcattctttcatgtaccagttccatttttccaaccagaatgtgaggtcttagaggatgggaatcaaatctaattcgtctttgtatctcacagactctgatgcaatgattttcacacagtaggagctcagggaatttgttttagatgaatttgcatgatgactctccaaatggcaaattttgaacactatttgaatgcctgcaagttcagctcccctaaaatatctaaagttggagaagcaaattattttgagcaggcatttaaaaattttgacagtaactccatttttgcaataagaattccttcaagtccctttgatcgtctacgcagtaattataagtttatagcctcctatgtgcctataactgtcagtagatgcacaatgtagcaaataataataaagattacaatatgttagagaacagtgtacacacatataacaacatatttaaagaacagtagagtagccaatcaggtgctcagctagtagaatattgcatttatggattctaagattagcatttttttgaagactaatattgctgaaattgagctgcaacttaaatgaatggtgagacagtttaatgggcaacatttgtttgttcctactggcacacaaaatatagatgagacagttgctggtatcttagattagatggagtatggtttgagaaggggggattaaaagagaaaaaaatgcgaatacaatttttctgaagctttgtggaagagtcaggacttgagccagttcttatagatttcacaactattatttttcagtaccctaagtattgaggtgtcagcttatttatgcaacacaatgatgtttgtcagtgatacattcctcagcatagcagaaattagcaaagattgctttcagaaagatcctatcagtgtaaaagcatgtctactatgcaaatactggtgctttggtggaaggcttaaaatactttgtgtttgtaaagtctgtgcttttacttacaagtgctccccttgtgatcagaaatgtaaaactggttactaagagaaacacatgagttagcaactttttccaactccaaatttgttgtgttttccaaggataatatccagggagacagaaattagggatgttctcatctcctacctaagccatctactccagctgttcatcatttgaggtgctgatggaggttatgataggtggaagagggaaaggcatacaaaaggaaagaaagggaggaatcagagtaaaacataggtgagagagcagattaggattgtccagtgagcttattggttcacttagtagaccctcttgctttaaaagctacatgattgtcagggtagaatcagtgtttcatcatgttgagatgaagttgagagtgtgaaggcagcagtgtgttgcagaatccagaccttttgaaccctctgcttagactggattctcttttggcaagcctcttgccagggaacatgttgagccttgttgattaaacaacattggaaataatagtgaacaagcataatgttttcattattatagggtaaagttaatatgtattatatgaataaatggatgaacaaaatggaataatctgtgtgccatattttatttttatgatgtgatggcatttgatgtttaggatagtaagaaagaattatttctcttcagttaaaaaaaaaattacctgagctttatggtaaatcttataaatgctttatggattgggtgattatgtcattcaatttcagctagttactccttaaagcattaatgtctggtttccattatgacctgttgtgatttcagaacaaatgcattgcttctaatgcaatattattatggcttgaatttacaagacgctattcatcctaacatgatgtaaaattacattctaagatgttcagtaatttcaaatgatagataaattgaagaaatttacagggagattttagttttattttaatagatcagatatgattttagttgcaatacaggcttttcaaataaagctattactgaattgattgtagtggacttgcatttacaaggaataaagaatattcattcttttctctgttgtttttgtataaatccttgggaatggaagcacatgtttatgggtgagtaaatttggtatttgggaaatttattctagataaaaattaaagaaaattatgagtacaaaaataatgatacttacagtacttatttttacgtttgtttttattcctaattattagtattctgaaagtataattttcaaaagttgaacacccaattctcctataatgaatgaattagtccacatcaaagatttttttaacttcttaatgaaggaaccagcaagatgataaagctgcttccaaggaggatgccagaaacggatacatataaatgtggggaagggggtagtagggggaaaagaatgccagactagcatagctaatttggatacaaaactggttagtgacctacagggcaataaacctgaaacatttggacaaaataagttgcatattactgggtttctctaagttaacatctaacttcgcagagtctaagccctaaccactagtaaatagaaagtcagactctgttacatcccagtctggagagtcagatgaccctgacttaggctgacttcatggaatatgctctcgtgggactttggaagggctcacagtcttctctttctcttttttccatgttttggataattttgcttaacatgactttctgttctagagactgttggtctaggagcagtgtttgctaaacaaatatttctgggaggggatgtacatttttgcctgtggacagttactttaatttgttacagtgtcttgctagtttgttcattttggtagtgcggttggagtacccactgtgtgtgtgttgcactgtgttaggtgccaaaggaccctgcccacaggaagtttactatcttcactaagacagaagagcacttataacacaaaataaagtagaaagccataattaccatgaagaaggtgtggattatctacttcaaactttcagagaaacaagaaattatttctagctggggactggggaagcagcgcaagatctgagcctgccttcaagggtaggtaacatttgagtttatggaagcagcactgcttgccaggcaaataaaggcatggggatagaaagacgaggaatgtatgtacacaaagcaagtagttcattctggagaaatggaaagcatggaagaaggaaggatctgtaggaactagtttgggagagttgagagctggaaaggctttcgtgttgcatctgaatttgaactttggttttgaaggtttagtgagggttcaaggaacacatagacctgtgtgagtttcacagtgacaactggcatttccaactcttttcaggaaatgacatttttggttattgagaaaataatatggatattgtcatgcaaaacaatctcatgtccaagggaaaccttcacagcactaggaaactccaaaaaggccatggagtttgttaggcaccagcatgctattcttttaaatcagtgcagtggaaaagaatttcctggtccacatccttggttcctagatggtacttcttccttttcctcttcctgaaggtgtccttgtatttgggtatgagcattccccgggaaaataattcccatgccagctggagctaaaaaaaactcacagcacagaggcacctcctaattgttgtaaattaaatcaatgaattccttcccacgacccatgaggaaatgccacatccttataagtccacatctcttcccagggatttacctctgcttttcttcagaatggaaaacagtttgaaggttccccttcagccacccaactctccccacccctgccacattgttttcataacttgttttttaaatgagggtaagcaaatgaatggctttttgattgtaagtgccaaacatttttaaaacggtggataacagagaatggcatgctgtggctcatgcctgtaatcccagcatactttgggcggccaaggcaggaggattacttgagcccaaggattcaataacagcctgggcaatacagtgagacctcgtctctacaaaaaataaaaaaactagacaggcgtggtggtgtgcgcctgtaatcccagtaacaaaggaggccaagactggaggattgcttgagcctgggaggtcgaggctacagtgacccatggagtgcaactgctctccagcctgggtgacagagtgagaccctgtctcttaaaacacacgcgtgcgcgcgcgcacacacacacacacacacacacacacacacacacacacacacacacacaagagcagagtatgaaggccaagacagtttgggactcaggaggcagagacattgaaagagcaacttcaggccaggtgcggtggctcacgcctgtaatcccagcactttgggaggcccaggtgggtggatcacgaggtcaggagatcgagaccatcctggctaacacggtgaaaccctgtctctactaaaaatacaaaaaattagccgggcatggtggcgggcgcctgtagtcccagctactcgggaggctgaggcaggagaatggcgtgaacccgggaggcagagcttgcagtgagctgagatcacactgctgcactccagcctgggggacagagcgagactccgtctcaaaaaaaaaaaaaaaaaaaaaaaagagcaacttcaggtagactcctaagaaatgtttgtctaggattgtaaaaactaatgggttttcaaccactctattttgttttcttcaggagagaaataaggtagaatggatgagtttgtagttacactagacaagtttggagttaattatatatgtagtgaaagacaagcttatgagaaatgatcaaaatttgggtcacctgtagaacttaacttttctaggtcagataaggactgtatctcttcatcacatttctctttccattttctttgaaaaatcagaagacacagtttattagctaagcaaacacttggaatcactgatatgtaccaaattttctgcacattccaataatcaagttcttttacagcaaatacaacaccttgacacttaatagatgttcgttttggaaatgataggtgccagtgactctaaagatgatggccaagaacaactgggaaagggtggccaattgccataatggtttcaagaggataaaggctcagcagtccttaccattcttgctcaaggtcatcctagaagggcattttctaatccaacatcacttcaaagttccagcattggcccctttggtttatcttgccttgtttgtaatcacttcttaaaattctttttgccattatttttctcactaagtttttaatctatctttgttgttgttttattttaatggaaagtttgctctcatacggctttctctgagtttctccagtgctagttgtcatgtaaagtgacaaggttcttgtggaggaattaaggctgtttaattagatttctgctcagatgatgagttttgtaaattgaaaaggatgagagtgaggtgttacttgggtgatatgtaccttgtaagaaattgtagaaaatcacttggcaaaacagatgggagtctgtagaagacttttccagtaattcaccaagccctaaaagcattcatttgtaaactttgaaataatgaaaaatcactgggttaaaaagaaagatgaaccatttgtttaattttgttgtgcagttttgtaatgccaaagcattctctctccgtagaaaacttggcaatggcttcatccggagtcattggatgaagaccagcatgcaaacaccaaacgagctatttgtgtcttgtgaacgtgtgtctgatcttggatgaagtatatcctgctgggggccgacatgaatgtccaaagttataatccattttcacttgcagatgagggtcagattcccacccgatctgaccccctgtgagaatgctttcaaggtataattagagtcagattctgggcctcattaaaccacatcatacaacccacagtcagctctggctctccatgtaataggctctagaattatgataatgtgatagtgcaaatatggtggctttcagaaactggattatgacgagccactataataatggttgatttcccaagttcacgtcttaggattcccatgacaaaggagaaaagaactgttggtctgcacagaaatttatcatctctggagaagatttgtttttactattgcatttgaataatgtctattcatatgcaatagtaagacagttgaaacagtttactctaccaagtttactaaaattgacaactcatgaagcaaatgtagtttttcttggtagaggttaaatttaattattaaagtatctaacacatacttgaatgtctccctttggattcagtgcccttgacttagaaaaatttgattcataacaggcattggatcctgtttctttcttgggcatattcataaggagtaatgagaagatatcagcaaaaatctttgagtattttggaatgagattaatcttatgaataaatgaatataaggcttagtaagctggtattacttttagaatgacattcccaagtttcagttttgaaactttatataaaacattatccaaacctttcatcgtctgcaaatctttctagtttgggtggtatgacctattgcatcatatacagaatcctacctagtggctcagattggagtatgaacacttgtacgtgcctctgaagacaaaccctctaatgtttgaatttggtagtgcagatttccaaggttaatacttaaatgtgaagcaataggccttaattggaggcccaaaggctgagcattagaaagttagagagaaagtgtgcttttttctgatatatcttattgtgctccctccctccacacaatacaagaattccttatcctgtctccattacagtattccacacacaaccttctttacctggaaatatttacttgcgtgattgactagagcagcagagatgtttctggcatgatataaagaataataggaacaggtagtgatacattttttaaaatagccattgttggccaggcacagtggctcacgcctgtaatcccagcactttgggaggccaaagtgggtggatcacctgaggtcaggagttcgagaccagcccggccaacatggtaaaaccccatctctatttaaaatacaaaaattagctgggtatggtggcaggcgcctgtaatcccagctgctcgagaggctgaggcaggagaattgcttgaacctgggaggcagaggttgcagtgagctgagatcacgccattgcactccagactgggcaatagagccagactctgtctcaaataaagtaaaataaaataaaatggccattgttatttctaactcaacttttatatgagatggtcttagctggatggtttcaggtgaaagagtcagaggggaatggaatgattgcaggtgagaaggtaactctcaagtaaaagctttggttcacttattgctcccattcatgacattcagaaacaagaataatcctaacaatcaatccaccattttgttactgaaccaaccttttacttctgggtctaatatctagtttaaattatttttctcaataaatgaacataaaattgtcttccaatgacaatcaagttgaaattatctctgtgtataaaataattacagattatgaaagaagccagacatatcattttttacctgattcggttgacttctatttttaatttgctaaattaaatgttgtaggaaaaaatgaagagctttgttctaattttgaaattccacagcaaaataattgagtcatgcatataaaatgtccgttaacaagaagacaattgtagtactggttatttttgtttgaaatagaaatatgaaattttaaattcagctatttaaaatgcccgaggctaccatggaatgtacaaggctctcagtgaggagcaacacaaagatttttacaaccaagtgaggtaacttcttggcctaggaatttatgatagagcttttactatgcttttaaaagtattttccctagatataacatcaagttcatatatgtaaagtcgtgaaaactatatagtggtctaattctctgacaaggcaagcttggtattgagatgtcataagttcattcaaggaagccttctgtcaatttccataggattgggaaggtggtgccttgtccatctttgcaggtgttggaaggggagcattattgcatagatctgttccagtttcacagcaacacatagactgtagtgtaaagaaagaaaaagtgataggacttatgtagatatgcactacaagcagttatgaccatgaccagctcttactgtcacttcctgatttaattatcccaacagtcttttgacataaacatcattcaaataaccacagatacgtggcctgaagccagatataacaagaatcagccagtaaagaaataggttgaatttaaccaagtaataagtaactggagttgttactgaacccaaaccaggtgattagaaagttagattcccaggggaattctcattacaagaaccatcttatcagataggtaattggaaaccctgttaaacccaccataacaaaggctcagcaagtgtacatctgcagtgccagtacaatcagtgagtcttcagttcttatgaacgttctgaaatcttttattattaaccattgaccctctaacctcaacttctttgagatgataaatttgtttcctttagtaaataagtaaattcctttttttcctccttcccaggaagtttgagattcatgtataaagatgaagaactaaataatactggctgagccaccctaatttgaaaatccaaaatccgaaatgctctaaaatccaaaactttttcagcactgacatgacgcgagaagaggaaaattccacacacaagtacttaacacaaactttgtttcatgcacaaaattattgaaaatattgcataaaattaccttcaagcttatgtgtataaggtgtatgtggaatgtaagtgaatttagtggtcagacttgggtcctatccccaagatatctcattatgtatgtgcaaatattccaaaatccaaaacacttctggttctaagcatttaggataagggatactcaacctgtagcataaaatcaatattttgggttatgactgggtgcagtgactcacacctgtaatctcagcactttgggaggccaaggtgggaggattgtttgaggccaagagtttagaaccaacctgggcaacatagcaagaccctgtctctactaaataattaattaattaaccaactgtgagtggaggttcttgcctgtagtcctagctactcaggagtctgaagcaggaggatcactagaacccagaagaagttggagattacagtgatctatgattgtaccactggactccagcctgagtgacagagacagagaccctgaacttaaaaatatatatatattacaacttgggactgaaatatttgtttgtatgttaatagttcatagcatttaagataatatgacatattacagaaatttgacagatttgctttgaaatgctaatttgaaacacgtaatttttttttttttttttgagatggagtcttgctctgtcacccaggctggagtgcactggtgtcatctcggctcactgcaacctctacctcctggggttcaagtgattctcctgtctcagcctcctgagtggctgggatcacaggcacccaccaccatgcccagctaatttttgtatctttagtagagatggggtttcaccatgttggccagcctggtcacgaactcctgacctcaagtgatctgcccgccttggcctcccaaagtgctgggattacaggcatgagcgaccacgcccagcctaacatgtaatttcttttagaactgttattttaagttggatctgtaagatagtttaggtttcaaagcaatattgcaatgttcaaaaaaccttaggtttcagcattttcttttttttttttttttttttttttgagacagagtcttgctctgttgccaggctggagtgcggtggcgtgatctcggctcactgcaacctctgcctcctgggttcaagcaattctcctgtctcagcctcccaagtagctgggattacaagtgtgcaccaccatgcccagctagtttttgtatttttagtagagaccgggatttcgccaagttggccaggatggtctcgatctcctgacctcgtgatctgcccaccttggcctcccaaagtgctgggattacaggcgtgagccaccacgcccggcctgggtttcagcatattttttaagtttagtttattagatttataagagctacttaaggacttgggaaggtataacgtgttaggattttaattttatcctgttagcatttgaagtgcttataaagtaaatcaaatgtgttaaattgataaatgcagtttaaagtgttacaggagtaatctgaacagtgattcctcataggggtgaggattgacctgaagagcggctcgagggtactttctagggtgatagaaatgttttatgtcttgattgagctgtcggttatcaaaatccattaaactgtcccttaagatctatgcatttccttgcatgtaaattttaccgcaatttaaaaatatgtgtgtaggaacttaatcagctaatgtatagacagaattgattgtttaatggagttgagtctattcaacttgagttaatcaaacattgattcaaggactcccgagagtgattattcttggtttcataaaatttattagatgtatgaatagaataatgagatcataatttgaacttaaaagcttaagggaaactacatagtgaattgttgacatagatgcagttcttgaacaaaaatcttgatggtctgtaagtctgtgtctattccttctcctagttggttggactcctgggtaaataggacagtcttcctagtatgctgcgtttagcatgcagcacttgactattgatgagtgaatggaacacctctagaggccaactacatcatccttctgtcctccttgtagcactagctcatttgcatagatcagcatgtccgataagctcacaccttgaagggcagaaaggacccttcttgagaagactgtacacagcactgtgtttttatgacagcaaacctcagtagccacaaatccctggaggatcagtaatgctagtgcacacaaggagctccctcccagcctgagggctctgccacccaggtagggctaagaggatggagttgacaaagggaagtcaaaaatgagagagctgtccatcaggagtgttgctgagccctgaatagagatcgatcgaggtgggtctttccttcccccttattataaacctgtacctttccttttattctctaggataccttctctatcttttctggtttgcaaaagaaaaaaatagttagatagtcactttgaatcaggcttgggaaaacacttataaataataattccacacatgtaagatggctaatcaacctaggtctgaaaatgacttaacaggaaaacattttcaatatcagtctctcatgattcccaaacacacacacacactcacaaactcaccacaacttcaaaattagcaaccaaaagacatctaaatgctgtgatctttccttttctcttccagatcagattagctttgctcttcactgtccttttgtcaaagcccctattgtacagctctccagtgtccttcctgcctgcccttctactgccattgtaacttttaccagccccactaccatttcagaagaaaactccaggaaagcaagtaagcatggatagctttaaagatcaatgctgaaggcccactaagaccaggatacaaagggagtcaattagaaaaaggtgggggtcaaggaagaactccccactcccaagttaaactcctcaatttgctgttttgttttagccagactctatggagctcagtcatggctagctctctgcaaatggcccccaaaaggcttttcacaaggggcagtaagatataactggcttcggtatttctgtctccccattcccagataaccaattcaagatgcatgcccactgtaccctgcatgttgttgaaacagaattttaatttcctctgtcttgcaaaaatgttcttttgcctctcttccctggtgccttttctcatcttcctcacccctgggtttcctaactctgtcttgcctactctgatctccaaagaccagtctctccttcatatttggcatgaaaccttcctcagctactcacacagtaattgcctcatttctcaaactctccagagtcacatcatccaatcaaagtactgtgtaatgtgagccacatatgtaattgaaaaattttcaagtaatcacattttttaagtaaaaataatcaggtaaaattaattgtactaatacattttatttgaccccgatatatttaaaatgttatcatgtcaacatgtaatcaatgtaaaaatgattaatgtatgcatttcatattcacagcacatctcaattcagactaaccatatttcaagtgctcaaaaccacaagtggctagtggtggccatattggaccacacagctctagaacttctgtagcccatggtttagcagttaattatgtgtgcacttggcatgttcgctgcttgttctctagtgaagtcattctttctagcaggccaagttctgtttctaccacaggtcctagcatggtgctttgcacattgtgggcactcaacaaatccctaagatttgcttcatagatgatccctgtacattgatagcatcttcctcattcatggaataacaagaatgacctcatctcctctcactttcattccttagctactaacactgttgcaaagatctctggaaaccggaaactttggtcacctatactttaaatggagagagaagtaaaacttgctgctgagaagcaaggactgcatagaaggtttagtttgctggtagaatcaaaataagcactgaatgaagatgtgtgtggttcccagttttataaataggttttgcaagaggagagtgtttgcttctttgtttttggtgcgaaacatttcttcttttagcatgttatctgaaagtattgctgccaaagggatgatttgccagagaaagatggtttctgtccagttccttcatatgtcaggcataacctccaattaatctgaatgaaagagtgggtgcccatgcagacaatgccaacaaatgcccctgtagagaggacacatacagatgccaacctgaaatcagacactggctactgaaacaaaggattgctttaatttttgcagaataaactatttttttcttctgcttttcacgaagtggccctaaagaattcctcttgtttgtggtctcgaaaaaattagaactatgccaatgaggcctgcctttaagggttctattaaacaataagaaggctttgttcttggcaataaaattaaagcaagcagtgtttccattacctggcaggctgccctctcccttcccacaaccctgaccccgatcctgacaaacctcaacagaccattctgtttcccaggtaggaaggttagatggtaacatctgtcaggtttgtttatagaaatatagttgaccttaatgataatgtataaagagggagagatgggggcggaggggggaggaaaaaaagggggtagggagagagagggacacttctccaaataatccttaactcaagctttaaaaaagtcaagtttactgcagaggcttcaagttctcaaaccattgttccagaaagacaataataatttcacaatgagttgaaatgatggaagttaggagtcactagatgaggaaatatacattttggtctgacacgctagatgtcacgtgttttctttttcagggaactttgcctaccattgctcaaacttagacccacttacagtcagttgcaaatgagtgcttgtaggtagattgtgaccctgaagtcaggaatgaccaaggccagtacagaaagcactgtccgatgcaaattctgtttagccccacagttagtcacaagtcattggaactgaaaaattggatgactgtgatgccagctctctctgtcctccatgagagctcaaaatggttatattgtagtctcctctagtgtaagagctcctgcctacagctgtcaaggccatacccatattgcactcacaggtcctatctccctggcctgggaactttttctgcccctcccaggaccaactaattccaaagggaagttaatgcctaccttcccccaacagctttcaaccagctcctgatgggagatgttacataaatactctgcttcttccctattagctggaatgttctgtactgtttcccagagttgcccaatggggttaatctccagttgcccaaggtggtcttggtaagtcacactttactggcttcgtagttgtccctgtttcacttcctacccagtactggtgttttctggcaacaatttgaccatccattcttgtctcatatccttcttggggaggatacaactgccaaccatgtctaaaatgaaatgatagcacaagtctctttttctagtcatggctatagctcacatgttcaatttctctaaactcaagtctctttcattgtgtttgaataaacgtacatgtgaatcactggacatcaaagatatttaaaaatcaatctactcacttctcctgatattctagaatgacaacaacagggcaagatatttcatagatatcacttgtgggtgcgtcatgaaggcagaacaaagcttaacattttccagttgtacctcccagttaagttctatcagtgacgtaatcacgtgtatttcactcactgtacggaataccaaagagcagaaacccaatgttcattttccagaactttgcagaagcagatggcttctatacctgagtaactgaaacccaaaaaggggtccaactcagtatttttccagtacatcacttttcaggaatcatggcacaacaactaaaaggaatgtcacttaatgagaaataacatgtaagattgaaagtgattaaggtaaagtcatagagtagaggtttcctctttccattagaaataacttcccttcccttaaacacgtcacctccatctttcctggcactccattaatggtcatctgctaaaagttattgtttaccctctgaccacaacatcaaatgccaaacacatttgttgaaaattatttaatagaaatcgctacttttcagaaactttatgaaaaagacgtgatagagacaaacacccatggcaggttaagtagatttcttttcattcagtgtgcccagcccaaacggaagggtgtgaagcatttgttttataaagtgtgtaattaataagagaaaggaagggaggagtttattgtttttcaatgaattatgagcaaccccttccattctgcttcttcattttggaactgcttctaacaaagttaccattaaacacaaaaagaaaaggctgtgatattgatgccaagaatataagattgaagtcagttgagtgtagcctaggaaaaacattacagaaggagtaacatttattataattgtgacagaagtcagcaggacatcatggggaaagtgaaaaccataccgcaagtatgttgtcattttcaaattgaaattccattaattcagtacttgtagctattcatgccttaaaagaagaaaactaatatttattgagcatctactatgtaccagattgtttacagatattttcatcaaaagtatgcaaatgaggaaacattctcacagaaattcaaatatttttcatacctgcagtcctctgaatataaagtccatgatttttcctttatgccagaggtcagcaaactgtgacgctcatgctaaatctgactgtttttgtaagtaaagttttatttgaacacagccacgtccatttgcatccgtattgtctatggctgctttcacactacaatagcagagttgagaagctgcagcagagaccgtctggcccacaatgctaaaataattactatctaggcctttacaaaaaaaaaaagtcccccaactcctgctctgtaccacggaagaatgttctctacccttcttcttcccccatccaaaattgcatcaggaggcagccttcaaggaacccagttaggatttaaaagtagcttcaaaaattctggagttaagcctcatgttatagcttccaaagctattattttgatgatgtagatgcatcaaagttttgattcatgctagaaagtcctcaggtaaccagcacaggctgactggtcctagaacctctagttttaattatctatggacattccagataaaaagagtttgttagcaatagtgatcgttcacatttatgtagtaattattacatgccaagcatttgtcaagggcttttcatgttttcactcatttagttctcaccacagtctaacccaggggttctcaatcttgacactagtgggatttggggatggacctttcactgttgtgggggctgtctaatgtgttgtaggatgtttagcagcatcgcacctggtctgccaggtaacaaatgttattttcctcattatgcaggtagggaacttgagatgtagatagttgaagtaaatgcccaataacatacaactagtaagcaataaaaacctggtgtttcaatcccgggaagacttcctcaagtccctgaaccccaaaccactgcctccattagcccttgctccctctaaattattttacctgtttgaagattttgctttactgaaaaactaacagcgacatcaacaacatcgtgaatggccatgttctgtatgctactattggaagtaaaactcctttatgtgaagtttcaaagttttaggcattagcaatggcattttttgctaggcagttttattgccttattacagttgtatttcattcataagaaagaatttaattgctctactcaccacagtgtgttgccatttttgatagtgtcttgcttccttgtccagcactcaagcttcataatcttagaaacctcaagaaaagaggatttatcatgaggttcctcggagctatttttttagtcccatagcaaattcccatctggataatcaatatgtagaattgatctcctctggtccaaataattttccactacgtcactatgctaaagcaggattacatgtagcttctagttgtatcactatatcactgctattacttcccaccaaaagcactttatgaaaggattccatttttaatttttctgaaaagcctttcttggagtttaaaaagatttgatcaaaaatgttaaatattaaattaacacattaaacattaaaaatattgtcccgtactctggtttgtcctccaaagacagagacctcaggagccaggccattctctctctctctcattcacttgagccaggtccacaagtatttgactttggtgtgaaagagtttcagagtgaagattacatataaacatatcagatgaattacggtaatattgtctgctgttcctcaattctccttggctcagttttatatacagactgaagtattagaatccctttcattgttcctctggcagctctgtctaacttttgccccagagtctggaatgttcatcacagctgtctttggcaataaaacccaaagcaccctcatatcatcatatttctttttgcacctggtcagtggtacacagcggggtgtagagcccacttgcatacagttttctccctgtaccctcatccacaggccaaatatcagcttatataaagctctgttttgtttcagttacttcagccttgggcaaattggaattaactcctccaatgtttttcctttggagtgagatgggatggttatgccacattatgtagtaccactaaccccttcgaatttggatgcagactcaaaattacatattcttagttatagagaaaagtccttttgagtctaaacaataacaagaacatcaacctagcatcatgtataaaaatgtttcagcctttctcaagatcaccttaatttgtgaccttggaatggaaggtcacatttattcaccgtggcatgaaacagcttttgtttttgccatgaggccgaatctaggcaaacttgtaaagtagacatttgtcttttaaactcccaactccttggtaatggtttcaaagatggcaaggttcagaatcttaaactaaagggttcacagtttgatggtgcaatttcaagagtgcagtaatggtgggccggggtgagagaggcacaactcaaggggtctaccattcttgcggaattcaaagtgaatagtagcctccggatttgtgcagtgcagcaaccctcttctcaacacccagaaatagaatatcctgtctccaacacgttggggttatcctgtcccaagcttacttcagtgtttccgtctgtgtacgaataagaagtgatatatcaagtcagtgtgtcattttcacaagaggaattataaggctgtattctgaaagtctatggatggctaacttatttcaataaagcactgcaaagtgagaaaatgagagtttctaaaatgcatgctagatcaatttcacctgtgaaaactggccagatattttttttccttcactcatgctccatcctaagagttccaaatatttctaaagattttaagcccacacatgtctgaaatctaatgatgtttatactctgcactgaacatctcattttgcagttgaatacaagtcaaattaaaagagccaggttttagaaataatacttaaaaaccacttacagactgctaaagaacatttcacagacacctagtccaatttctagtatatgtatgtaactaaatccctttaatgtttatacatatatgacaaggaaaaaatatttgtcctctttaccccacccattcctcaaaacactgtaacactattacaccataaaacttagcagggagactttgggcgttgctaaccaagtgccctcgagaaaatagctaatccatttatgtcatcattaactaatctggggaatgattacgcgtaactgcatttctagaaagggaaggtaaaccgtgcacccagtagcaacttacatgggactgcaactgattattggtggcagatatgagcattaatgaagccgagtgaccctcaatgctgaattccatctcaggactaggcaggccagatatgattgttgtgcttctacattcacatcattattcaattttgtaatatctctttcatcagactgtaaaggatcagaaagtcattggcagagagaagcagcagtattaccctaggaataggagaaagtgggtcagcaactccctacaggcaagactgatggggagaagatgcatttcaagacgcgaaagaaaactgactctagatgtagagaaggtatgtgctgagcagatgggtgaggtcaaaaatgagatgaggtgaaagtgactgagtttctcatactggtgggctaatgtgatatttgctcatgagtgtacttgaggtgagaaaaaaccatagtattgaggagcctagcctgagatctcggctcactgtaacctccgactcctgggttcaagcgattctcctgcctctgcctcccgattagctgggattataggcatgcgccaccacacccagctaatttctgtatttttagtagagacagggtttcatcatgttggccaggatggtttcaatctcctgacctcgtgacccgcctgcctcggcctcccaaagtgctgggattacaggcgtgagccaccgcgcccggccaggaaggcctaattttaagctgtatttcatcctgagaagtcaagtgccccatttccagtgtggtccaaaggcaggagacagtaattacccaccactggacatcattcctaattatcttcatctcactcttgccgttagtttaggggccaaggaggagactgatggcacaaaagtggaaagaagagtttgaacttgttttctgcatccttagattggccctcctcagagcacttccatcagccacaatgatttctgaatcaaaagatgtgaatcagaaatgaaagcaaaaatcataaccaggagctgctagcttccaaaccaaacctgggaactagaaacaccagaacataactgcaagtaaccaataaaccctgccatatttgaactaatagaaattaatgagaaagtccaatcaaatcgttaattctttgtttaagtgacacatgaaacagcaaaactgtggaaaacttctttgtagtagaaaaaattctgaaatatagaatagtatttaacttgttttattgtatcttttggaatataagaatactagagttacaagaatttggaaattcatcaaagtagaaaacaagattcaacttccctggtttcaaaaggaaagctaaatctgtattctctgaaagatctaggaaaaatacttggcctaaaatgaatagatcctgttcccaaatttctaggaatttacatattggggtgatggtgattgtgataccagttttctcaaaacacatttgcctcaacaaggaagatttcagcccacttttttggtaaagcaaacatatccattctgtaaatcaaatagtcaaaatttggattaaattgagccccatattacaatggcaactgggatactttttctaccatgcagtaactcaactcccaatgattgtgagagtgaatggaccctaaactaaatcataatctgtttacaaaatcccttctcaatgcagacaacagtacctcagatttgtcaatggcttcataagtttaggtgtttcttcatatattatttcatgtattcaccacaataattccacacggctaagagagcagatattattcagctcattttacaaaataggaaaactcataaatggagatagcctaagattttcctaatgtcaccatgtgggtatattacacaccacatttcatttcacagcccgtactctagaattagcagtgggttctcactggacttagtcaaagccagaagagcttgaagtgtggaatatgttagtgacaacattaaaacttgaggacctcacaatgtggtcaattgatttttgacaaaggttctcagacacttcagtgaaagaaagaatagtctttcaaaaaattgtgctgagacaactggctatccatataaagttagaagcctaccctcacaccatacacaaaactgacctcaaaatggctcatagacctaaatataaaatataaaacttatagaggaaaacagaacagtaagtctccatgaccttgggataggcaatggtttcttaggtacgacaacaaaagcacaagtaacaatagaaaagtagataaattaacttcattaaaatttaaaaatgttttgtgctttaaagggtatcataaagaaaatgcaaagataacccacaaaacaggaggcaatatttgcaaatcacatatttgataagggacttgtattctgaatatgtaaagaaataatacattctattaattaaaagacaatgacccaattacaaaaggagcaaaagatccgaatagtcatatctccaacatagatacacagatgtccagtaagttcacgaaaaagatggtcaacatcattagccatcaggaaaatgtaagtcaaaaccacaatgaaataccacttcacacccactaaaaataaaataaaattaaaaagacatacgataacaagcattaacaaggatgtggagaaattggaaccctcatgtatttctgatgggaatataaaataatgcagccactttgaacaatagcttggcagttccttaaaacattaaacacagttatgtgacccagcaattccacccctatatcaaagaaaaatgaatatatatgggcacacaaaaacttgtacatgaatgttcatatcaatattatttatagtgaacaaaaactagaaacatcagtgtgcatctattaaagaagagataaaaagtggcctgttcatacaatgaaatattatttggcatagaaaggaatgaagtactgataaatgctaccacacagatgaaccttgaaaacattatgctaagtgaaagaagccaaacaaaagattatgtattatttgattccatttatatgaaacgtccagaacaggcaaatccataaagagacagaaagtagactagtggttgcctcgggctggagctagggcaggtagggaaaatgtggagtgactgcacacattatgggtttcttttctgggcactgaaaatgttctaggcttagattgtgatgacgattgcacatgaaatcatctgtgaatacacgaaaacccacaaaactgcacattttaaatggacaaattttatgatatgtgaaatatattccaataaggcagttttaaaaaatcaattcctggccaggtgcagtggcacactcttgtaatcccagcagttttaagaggccaaggtaggaggaccacttgagcccgggagtttgagactagcctgggcaacatagcaagacctcgtctctacaaaaaaatacattttaaaaaaatttagccgggagtcatggcatatgcctgtagtcccagctactcaggagactgaagggggaggattgcttgagcctgagaggtcgaggatgcagtgagccgttatggcaccagtgcactccagcctgagtgatagagcaagagcaagaccctgtctcaaaaaaaatcaactcccttcctccctccccctcaaataaaacaatccttaggtcataattttgtgtctacacagtccttggaaaccaatccattacctgcatgttgagtgattactagtgataactacttgctccattacatttttgccctgtctcttcttggaaggtcattttccctatttatttattcaacaaatattttttgaatgcctattttgtgccagacatggcaccaggtgcttggaatagataccttatttaatacaacagctgaagatccctgcccatatggagcttacattctatcagatttaactcgtattctcaagtacaacttagctcttcgggtttattctagtagatacttttcaagtgtggggtctgtcaaagaaaaactagagctggacagtagttaaagctgtaaaaacattttattcaggactattgtaataaggggaaagagacctcagtatagaatgggactcaactcccaatgtcacgtggaccagtggggatttacagccaaggagcagggtgatgataagtggatggaaaattactaagaggaaacatcaggggtaagggagattctggttaaactgacctaaaaggattcttgctgaaggtaggccaagttgatcagacatcctctggggcatggtgaaggatgaagaacccaatcagatactgagagtgatcagatatggagatggaggattctggctaaaccaactcagcagggttcttgctaaaactggtttacaagaaagtgcgcagaagggcccaggagaaagttcaacactaaagtttggtcgagcaaagaagcttcgtcagtgctactttctagaaattttacttcctccatcataatgtgctcatgttatcaatatggtcccatccttttcataactcagttgtagtcagttattaaattcagtttgaggtcaaaaggaaacagaagaaatttactgagtgtaagtttcaagtaaatatgtcaatagctaaatttatttgagaaacctcaaggggagctagaaatgatgacataaaaataacaataagagaaatgaagcctaatgattatcctccttgaaatattagcctgagttccacatttgtacttctcagtcaatgcatttttaatttttctctttgttcattaaacaaatacttagcaaataactctgtctgctaaactgatgtaggacataatctcatggtttactgcaaatggccaatgactatcatcttctcaataagatgtcttgagtagtctctatgttatgtctgaacaatgatcaggaataaaattcaaggaatcctgggcctctggaaacaggacatggtttctgtgaacagccatcagtggatttttatcttgaactcatgaccctacttccagtttatctcattcatagagaatgaaattactccaattaaagccttccaaatcaaaaaggctagggactgggccatgtctcctccctgagatatgctagaataatcaatgccattgtcattctttgtaacattgcaacttctcctgtggctgtgttaaaataataaacctcatgcctgctatctccatctctcacagctgtggtttctgggtttctgtttgtgaataagcatttcagaattgccatgagatggaggaaatagcatgtgcagagtatttcccaggcctagttgccaagaatgagctaattgtaagcctcccttgaatgcaagtcacaaaaacttcaaatacaagccactctaatgatccacctttccacatgaatgttatgctttcgttgtagaaccttgatctttcagaagtatactaggagtataattttaaattatgtcataagattaataaactattgaaccatctttttgtgctttttatgttttatagtgattagatacaaaattgatgtttgtatttaagagaaatgtcaaatgtgatacaggcttgctacattgcttacggaaaatttgtctaaaagagattgatagtaatctgtcctccataaaagaataatattgattttttttaacttactttttttatgtttaacagggcaaatttgatactttttaaaaatataaaagtaggaattgcaaatatatttcacatgacacatcattttccaactaattggtaatggctatgtacatgttatgttaaagattctgcagctgagtctggcttagtagaaaagactgctgtcattggataataatgttttccaaggatgcaaattaggaagtggccatgtaagtcctatatttgcaatccttgcgtaatcggacaaagagttaacatttaaaatatcttttcagagattactagaaacatcctagtatacattaaaaatagcacttaactgaaaaacaaaggccaaattaacacttaccattgtacttatcctgtaggtcaatgcatcacgtcaagaagccaaattgacagaggagtgtgatcttctcattgagatcattcagcaaagacgacagattattggaaccaagatcaaagaagggaaggtatgatttctagggcagaagatttcatattctctacctggagaaaataaatcctaatacactccagggactttggaaatgttgagaaccctctttttctatacattctataattccctcttaagtctttaagacttagttaaaaggcctttgcttggcagttttttctccatccttttctttgtactatggtctcctgtgaagacctgtgatacaagggctgctccattgcccagcgccaggaggtagcataaaggtcttgtctatcatggccattgttttctatctcacttgtctatgagaaggtgggttctgtggaggcagagtttattttgtattcattgtgatatcctagaaactagcatagcattacataaattaaaaatgaatctgactttatttatagaaattatgaagtactttcccatgtttttgaggaaatgtatacaggtataacttcatggtcccaaaacccctggggtttcactatatcatatactcctttgtggatatagtaataatacttcttttctaatgttctaatgtttctatgttttaatttcctattgttttacagcaaactatatttttaagataaattgacatacattctttatagctgctttcttatttattcaaaattcattcacaaactgttggtcactttataatccatcagtttattctattttaaaattagtcatgtttttattgaaatacttatgatccttttaattttacccaattctctgccacattcagggataatttttctttcttttttcttcttctttttttttttttttttttttgagacagtctttatctgtcacccaggctggagtgcagtggcacgatcatggctcactgcaactgccgcctcccgggctcagacaatcctcctgccttagcctcctgagtagctgggactacaggcatgggccaccacacctggctaatttttatattttttgtagagacagggtttcaccatgttgtctaggctggtctcgaagtcctgggctcaagcaagtcacctgcctctgcctctgcctcctaaaatgctgggatgacaggcacgagctactatgcctggccaaggataatttttctatggatttttaaaaatagaagcgtttatttatgatccaataaattcatccatttctattattattgttcatagttgtactttaaaacaaaatatatataattaaaacatactagcaagttttaagtgaaacacagagataaccgtggctaatgtatgtggttttctgtgttttccacaaaatttaacaggtaccttctaatattgtacaatgttttagattactctgtctatatagattacaaaatatttatacacataaattattaaaatgatctaaaaaatagtgaaatcaaatagttattgatgctggtatagtagattaacagattaacatgaaattattccctggccaaggactcacatgtgccgaaaagctacttttccccacatacgaattgtccaatttagaagagcactgagtgtccatctggaatccttacaggatatatttcatcttccatcatcatcgtgcatcataggtgcacatctcttaattctggaagtattccaggttctcagacacatggccacctgaagtacagtcacaattaattattcatatgcatacagaaggtaatttgctatctttacatggttgcatgcagagattagctctcagtacacatattagtttattttcatttttaattttaaattgacaaacatttatatttatggagtgcaaagtgatgttataatttatggatgaaatatggaataactaaatcaagctaattaacatatccatcatctcaaagccttttcttgtggtgagaacatttgaaatttacttgcttagtgattttgaactgtataatacgttattatttatttgctgttttcaccatgccatgcaatagatctcaaagtaaaaaataaataaataaataatttttttgaaaaagcacttcctcttcctctctaattgaggttttgcaccttactcttactagtttcttattgctgcaataacaaattaccttaaacttggtggcttgagacaacatagatttattatctcagtgtgctgaaattcggaaatccaaaaatcgatctcactgggttaaacaaaatcgacagtcaaggttttggcagtgctgtttctttctggaagctttaggggaaaatccattttttcttgccttttctagctcttacaggtagcctgcattctttggctcatggtctctttgcatcaatctgacctctcttcccatcctcacgtcttctctgacacaggccttcctgcctttctcttataacgacccttgtgactacattgggattacctggataattcagggtaacatccccatctcgtgatccttaatcatgtctgtaaagtcccttttgccatgtgagtaacatattcaaagattcctgagattaggatgtgggcagcattgagagcccttattcagcctgcaagggcactccaccacaacttcctggctagcttgccttcccttctcttacttagcttggacttcccaccaccagggtttctctcatgagctagatcagagtagtgcaggtgtccccaagttccagccatagtgatgcatggagtttatgcttcggtgcactcgttctaccccaaatacatgtcagtaataaagaacttaataaaatgcaaaagcaaagacatatagctgaaccaaaaacaagataaacatctccacaggccagaaatgagacaaaactgaaaagccatgactgtggctgaggatacaggctactgggatttggtctggaagaggccaaagtagctttggctttagctcctgtggataaatagttcttgaagctttggggaaaggacctagaagtgctccagatgggatggggaatggaaatcaggctcattatttaatgccatgggctatagaaggcttcatgcttcagtcaaaaattattgccaacctttccctcatatcatagcttttagcaaagtcacattgttagcttgaagcctgtgttcacactgtttctgatacccacacagaacaggagcacagagataaggatgggattcctgaataatgacctcaagggccaggtgaaggcaactggaaaactatcagagcagggtaggctgagcaaggagggtgagagaggaaagaattataaattacttccctttaaaactgaaactctaagtttaatttcaaagtatataaagaaatcttaaatttctaaacatacagccagcaaaatcagcagacaacattatcttaccccagataaaattaattttataggaaaataagaaaaagactttaaaagaagtagtcttaagatgttcaaagaaagaaatgaaggaataacttctctttcaaaagagcaaaaaaagtgaagccacaaaagaaggaaatgaaataaaaaaatagataggaaagcaacaaattagcagttttggagggaaaaatatagatattgaaattagaaagaaaactcagctgcagtggaaatttggaaactgagttttggtcaccaccttgggaatgccataaaacgcattcttttacgtctgagtgacattaaagtttgacaaatgccgactgagtttgaactcaaaagataggaaagtatataggaaaacctacacatggggcatttttaaaataataatcatgcacttggttgaaagcaagtatttcagcaaatttcaaaaactgaataccatagaaccctgcctctaagaccacacactgtatctcattagatattatcaacaataaaataatagtttctatagttttttgacactaaaatctattcatatataaatatatcttcacagtaatattttttaaatgtagaagtaaaccacagtaaaagaactataatatatcataagtagtaagcagcaaaaaagtatctgaaggcaaacttacaggctttaattcttttgaaaaagaggctgggcatggtagctcacacctgtagtcccaacgctttgggaggccgaggcaggaggattgcttgagtccaggagttcaagaccagcctgggcaacacggcaagaccctgtccccccacccccaaaaaaggtaatactaaaagtaaaaaattagctttcaaataaagctagaaaaagcacaacaggataaacccagtgaaagcagaggaaagaaataaaggaagaaaagtaaatgaaagaaaaacaggaaacaaacaagaacagctgtcagcaaagaacaactcgcagcctaattttgaaacatctgtgaataaaaaaagtgccttttcccccatttttaaaaggttgttaaaaaaaataaagaaaaacaatatatgtgtgacagagacagtatgtggtcttcaaagcctaaaatattgactatctggtcctctacaggaaaagtttgccagcccttaatcaggaggagttttacttgtaaaaaataatttaaaagaccaatctgtagttaaggttgatgaaggaaaaaagagtgtggggccccataaacaaatataccataaatacagtagagacttttttaaacataagaaaattgtgtaaatgtcttcatgccaataatttgaaaacttacataaagaagtagcggaaaacctgaataaaccaaaaatttaaaagcagaagacatttaataagtcattgaaaatgtccatcaacttgcatttctgccccaaaatggcaccagcctcccacagttctatagcttactttaacagaagttccaggaactaataatctcattctcatataaactacttcagaaaatagaaaaaagacattttatgtagagtgtatgatcttgataccaaatacatacaacattaaaaaatctagagtgagagaatatcacccatgaatatagacacaaaaattttttttaatatgagaaaatgtaatccatcagtgttttattaaacacatcaaaatagcctttattcttataatacaaggatggctcaactacagaatatctgttaacagaaccacattaacagaaaacatacatatgatcccagagtaggagggatttttctttttagaccaaacaattttaaaaaaacaaccataaagcaaagactgaaacatctgacatagaataagatcacaatacaaaagccaatttcatttcaatatattagtaacaattgaaaattgaaatttaaaaaaagaaattccatttaaaacagcctcacaaatatgaaatacttagtgataaatctaacaaaagatgggtgagacttgaaagaccttgaaaactacaaaatattgctgagagaaattaaagacgactaaaaaatgaagccatgtatcatgttatggggtaaagactcagaaaagttatgatttctgttctttccacatcaacctgtagattcaacataatctcaatgaaaattccagcaggttattttgcagaaattgacaagccgattctaaagttcatattagaatgcaaaggatatagcataatcatttaaaactttgaaaaatagaccgggtgcggtggctcacacctataatcccagcactttgggaagccgaggcgggcggatcacgaggtcaggagatcgagaccatcctggctaacacggtgaaaccccgtctctactaaaaatacaaaaaataagccagacatggtggcaggagcctgtagtcccagctactcaggaggctgaggcaggagaatggcgtgaatccgggaggcggagtttgcagtgagccgagattgcgccactgcactccggcccgggcgacagagagagactctgtctcaaaaaaaaaaaaaaaaactttgaaaataataacaaagttggagaactaacatcagctgatttcaagatttattataaggcttcagaaatcaatataaggtggtatttgtataaagatagacaaatagatcaaaggatcagcaaaaagacttgagaagtagattcatacatatatggacaagtgattttcaacaaagatgcaaaggcaatttcagtggagaaaggattgtctttttagtaactggtgctggagcaattggatatctgtatgtaagaatatgaagtttgatccatacttcacattatatacaagactttactcaaaattgattatatatctaaatgtaaaaggtaaaagctgtaaaactcctagaagaaaacgtggaggagatcttgaccttgggttaggcaaagattctttacatacagatgacaaaagcattatccataaaagaaaatatttatatgttgggtttcatcaaaattaaaaacctcttcagaatgcactgttaagagactgaaaagaccaaccacaaactaggcgaaaatatttacaaattatttattttaataaaggattgtatccagaatatataacaaattctcaaaactcattaataagaaaacaagcctttcaccaaaatgcataaaagatttgaaaactttaccaaagaagaggtgtggatgatgtattacttagggttctctagagcgacagaactaataggatatatatatatagagagagaggagtttattaagtattaacttacacaatcacaaagtcccacaataggccgtctgcaagctagcagggagagccagtccgactctcaaaactgaagaacttggagtccgatgttcgagggcaggaagcatccagcatgggagaaagatgtagacggggaggctaagccagtcttgccttttcatgtttttctgcctgcttatattcgctggcagctgattagatggtgcccacccaattaagggtgggtctgccttccccagcccactgactcaagtgttaatgtcctttggcaacaccctcacagacacacccaggatcaatacttgcatccttcaatccaatcaagttggcactcagtattaaccatcacagatggtaaataagcacgtgaaaagatggttcagtatcattagtcattaatgaaatgcaaaataaatttcaatgagatactgcttcctacctactagaataattaaaattcaaaagatggcgcataccaagtgttggcaaaaatgtgaaggaaccagagcctctcacaaactgctggaggtgggaattaaagtagtacatgctggaaagctggcagtttcttaagtaagcatacacttaccatatgatccagccatttaggtatttaccaagagaaaggaaagctatgtccatacaaaacttgtaggtgagactggtcacggtggctcacacctgtaatcccagcactttgggaggccgaggcaggtggattgctttgagctcaggagtttgagaccagcctaggcaacatggtgaaaccctgtctctacaaaaaacacaaaaattagccaggtgttggtggctcactcctgtaatcccagctacacaggaggctgaggctggagaatcgcttgagcccaagaagcagaggttgcagtgagctgaaatgatgccactacactccagcccgggtgatagagtgagaccctatccaaaaaaaaaaaaaaaaaagacttgtaggtgaaatttcatgttaattttacttgtaatagccccaaactagaaatggcccaaagtccatcaacagatgaatgggtaaacaatttgtgtcataatcacacaatgaaatactctttggcaataaaaaggaataaactagttacactagttataatgcaacaacatggatggatctcagtataattaaggtgcgtgaaaggagtcagacagaaagtagtatattctgtatgagtagattcatatgaaattcgagaaacggcactttctactaatctacagtgacaaaaagcaaatcaatgattgcttttagggatgggatgacaggaaaggatgggcacagttaattacaaaggggcaggagtaaattgtggggcatgatatatatgtttattatcttgactgtggtgactgtttcatgggtgcatacatatttgaaaaagtgtcaaatttgcactttaagtatgtactgtttatgatatgtaaattctatctcaattcagctgtttattagacatataaattgtgtattatataatgaaaaagtcttcagaaattaaaattaatgaactagggtgatatgtattagcacggacaaatcacaaaaacagaagaaagttatataattatttgtacaagcattatataaaatttaataaactaccaaaaaatcccatacattgtttaggtatgtgtacataaacatgtttgggagtgatcagctctaaatttgagagggtcttttcttctggagagagacatgagtgagattataaagtgccacacagaggctttaatgctatcaataatattttaccaccaggtgtggtggctcatgcctataatcccagcactttgggaggccaaggcgagaggatcacttgagcccaggagtttgagaccagcctgggcaacatagtggttccccatcactacaaaaaataaaaataaaaataaaaattagccgggtgtagtggcatgtgcctgtgatctcagctagtcaggtggctgaggcaggaggattgcttgagcctggaaggtcaaagctgcagtgatccgtaatcatgctactacactccagcctgggtgacagagcaagaccctgtctcaaaaaaaaatcttttttacttccttttgaaaactctgaagctcatatgatgaaaatactgagatttagtaaacctggtactatgtacaggacagttcattatattcttaaattttttgtatgtatggaatgcttcactttttaaaaagtatacatttgctcagcaacattatctcagaaggcaatcttagaaagcagatgttacttgggaaagatgagggccgcactccttttctcttgagctagtactttggcacatgaccaaggactagttcattccaaaccctgaaactcacagtgactcaagtccctagccagggcatattgtgtcagaggcctgtttttaagaggaagggtgtgaatgccaacccgtggaaatctgaggtgccagacagggagggcaagtgtggacttggggttcactgggggacttgggtccctgcaccccaggatggcagtggcaactgagggcattgagtctaaagaacggatggtggggccttctgacaagcaattggaagtgggcaggtggagcaagaaccaggcagaattgtggagatcacaaaagtgagtttcatcaactgccttattttgcccctgtctatctctgacactagtcactcagctgtcaaactcacctcaaattctgcaattgacgaggtcaccaagcaggtgatattattacacgttagtacctactgatgattcctgctcttggaccattgtacattctctgaaacaaattaactcgacagcctttataggtgggcggactggagagtcttaagccatgaggctccctggaaaagaattttcttctttttttcagtagtcggggataagtttcatgtcaacacacaaagagctaaattcagattgagttcattcatttaatgttcagacacagagatctatggtagacttctgaaggccaaagctcaacaaaataagggtcccttttcttcactgccttttatgtacactaaatcttaaaagtttaagaaaattaacttggactaaatgttgagctctccatggccttaaagagatggtgagaacaggcctcattttcagttcagatacttgtgtgaattgaggatgcattgtttggacctaattgttttgggttgtgtatcctacatacatataaaaagatttatataaaaataagtgtttaaaacgcatttcaagcaaaataaagcggcttttaaaagaatgtgtaaggtataataaacagcaaataaaatgatataaacagccctgtgtccctgctaaaaggagattccagcaggcaaactatttccatgactagtagagagtaaattccaaaagttgcaatgtggtaatctcacttcccaaaggaaaaatgaagagttgactggaaaatatttcccttgcagcattaaggcagacacatacagaatctttttatgtgtcagtatctaatttttttaaacatcaaattttattcaccttgtcaacttttaaaaataatacattaaaaagtgttgtctaatagaaaactaagtacttcgctccatgctgggtgtctgagtttgaagtgctgtgacaagtaggacagtgtttcagagtgtgctgcaaatcagggccatctgactgtaatcatttaagccaggggttagccgacttttctgtcaagggccagataacaaatattttaggctttgccatacggtctctgttgcagcaactcacttctgcacaacattgtagcaagaaagcagccatagattatgtgtaaccaatgagtgtggtagtatgccaataaagctttatttacacaaacaggctgtatgctgatttggcccacagatcacagcctaggaacacctaacttagagcagtgtttttcttttttctttttttttttactgtaacccgcagtaagaaatatatatgacatcacaatacagcgtgcacgcatgcacacacacaaaaggttttacaaaacccaacttgccttttctaccaggaatgcactctgctatttgcttttctcctcttctatttggttttttaaaggctagtcctgactgtcctaatgattcatcacctgcaggcttaaaaacatttgttgcttgttgaaatggaaattcctcctgctctgcgaattacaactccttaactcaaatattggagcgtagacccaaacatctactgtttttctttcaaaatgatgcccagctgattcttttacactaggtttgcaaagctcaaatcagatgtatcagatgaaattgtacactaacctataactaaaattatgcccaaaattgttctctgtagaacattccgatattttcacaggcgactctcattttgtcttgctttaatttttgcatgatttagggctcttttattctttttcctgttatgtcacttttaatgttcaatatcatgatagaaaaagaaaagaagaaactggagttcaagcatcatcgcatttgaaatgtgtgtggtctttaataggcatatctaaaggataagtagttgtcatgaagttattctaaaggaatattttgaccttattttcttttgctggaattgtattaaacatctgcaattcggccatgtaatttaaatgattctttatgctgtgtgattaaatattccattcacttggtttgtcctgtggactgtaaattagttttccttctggaattttccttcctctgacagtttcttatgaacatgttctaatatcctgcgcgtactggatgccttccttagctttgcctccagatagaatgatgccagaggctaaattctatttggtgtaaaataagtgttattttattccactaatgaatacaattaatccactggggacagtaactataattataatgcattaagtcttttaccaggctcacgatcctatattatttgccctaaagttttgacacttcattctctgactctttcaggaatttttttcacccttgcctgaaatcttgtgcctgctgcttctaattcagtatgaatttcctttgtttgcttatagtacatacttggaattggatgttccttagaggcctcaagttctgacatctctttccttccttttcttagattagagttatacagggatggtaatgacgacttggagaaagaaagaatttcttggaattagcaggaattctggagagagccttgggccagccttgtctgtaagacagattgactggtctcctccgtaccctttcacccagggctattttccattccagaattatcataaagccggttgaaacctgtccctgggtgtgtggttgggggcagtaggcacacagcaattccaattagctgtctaattttaacttggcttctggctagaggacttcatctcacagcacatttcaaacacaagagcgaacggtcaagtgggttaccttggacttatcttggcctgccccggaggttatggtcaattatgtttgagggacattttcaagcgagacagaatcaggaattggaatggaggttgtgaagcaatcatgcgtttttatcccaactgggaaatgcttatcaaaatagttcctagttatcaagtaagcacaaagtgcctggaaatgacgttcccagtgaggggaaatggcccagctgtgctttttttggctttctctcatctgctcaacaggaaaaatattaatcaatgggaaaaatgctccctttctgttaatttaacacatgagttttaggtagtgtgggaaatagtaacacttaatgctttccattctcgattttattacatgaattacaaaaaacactttttagaaaatggttttcatttaaaccatagattcaccacctataaagatgttttatcttcttgatgaaaagaagataaacctgagatagagaaagttccagggttccctacagtcttgcagtcattgtgtggaatagtccagggaagacgtctggtgaccctttgtaagttgccactgggcaacacctttttttcccatcaacagggaagcaattcacaattcagtgtttcctcgtaaaacgaattagcaatgcttctccaatgagataaggaatatctaaaccagagtcccataacggagctttccatattttgatatatctctatgcctactttttgaacttttatggaaggataacacaacaaaatgaaggatccagcctgatgccttttcattaagcaagaccacccatgtaaccatctctctccatgcctcttttgttcaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagaggtgagtgcaggggcccctgggaatttctcggctgctgggctcttgtatctgcgctgtgattggttggtcttgccctcgccttgcttttattttcattttcaaggctcagtaccagagagaatagaggctttgagctgttttgttccagctaaagatgcttccttttgacatgtgaaagccctttcagtaacagcctggagtctggagttcaaggcctttgaaacaagagtccaccagttagaaagaataaaatcaacctgcttttggacgaggggggagcttatgatggcacaaaaacagcatttattgtgactctcagatgtgatgttatcgtacacttgataacaaagagtcaaaatgaaggcaaaaacattaaagggaatattttcttccatcacagggctcatctatttttttttaaaatcacacaggtgttgttctctgttaggcccattttcatttggttgaggagcttggcctcacctgaaaaggtcaaggccaactcacgcaggagagaaaggaccaaactgtcaacctcatacgggcttcttttaaaatactctttattctcaggtagggagctttaatgtgatgttatctgaatggttggctcagcagtaaaactggcaaagataagtattttttcggcacacatacttggttggtataaaaattgctcatcttcactgacacaaacacctatagcaattctagtggatccaaagaaaagcactagccgggcacggtggctcacgcctgtaatcccagcactttgggaggccaaggcgggtggatcacctgaggtcaggagttcgagaccagcctgactaacatggtgaaacctggtccctgctaaaaaaaaaaatacaaaaattagctaggcgtggtggcaggcgcctgtaatcccagctacttgggaggctgaggcaggagaattgcttgaacctgggaggcggaggttgcagtgagccgagatcgtgccactgcacttcagcctgggcaacagagcgagactctttctccaaaaaaaataaataaatgaaaaaacaaagagaagcactaggctgggccaggtacagccaatgccacataaatgacatctctaactcaggctaatggccttgacttcattcattctaattttcagagtcaactgccctttatccaaagcaataatagaatcctatctctagaagaccccagagagctcatgcatgctgatcttcatcctagagcagagatcagcagactttttctataaaggatcatcaagtaaatatttttccgctttgcaggttgtaaggtcttggtcacagctactcaactctgccattgtagctagctctaaagcggccatagataatatagaaacaaatgggtgtggctgtgtgccaataaaaccattacaaaaacaggcagtagaccatactttgccaacccctggcctaggaaaaaaaatactcgccatcttatgactcaaatttattcaaagaaagagaaaggaaactaacatttattgagtgcttgcttgtttcggaaacttgtgctaattctcaaaatatcgcatagaggaggagtgattgacatctccattttcactcttcttaaagagtaatgtatcgtgtttttacaactctggtctactgtccaatcggcttgactgtattatttcttatatttgaggaaaattccttttgtagctgattagatacttatctcttctaaaaggcatggataacagctggctatcatccctgttatgtacttaagatgctctcctccttactctgagaggcccatttctttcctcctgattccttggttccaaatgtttattttccctgggccatatccagttgctcaatattcaccctaaagttaaaaactgcaaatagcactaatactccagtgtacctaggacactaatagatagcgtttacacttaggtcacggtttccaaccggaatccaggagtacttttctccatctatgaactttgagatgtccagatgaaatggctattatgaactgcattcctcatcaatccctgaagattcaaccaagtgtcacatgaataaattcttacctagtgaccagggatgatgtgaccccataacagttattgctgaaagaagatatgcatctgaagtatagcacaggtgtgggaatgcccacatacaatctccctcagttccagtgggacgtatctgctcccattcagctctctctataacaagcccaactcatcaagagcaggaacatgactttgatttctctttctacaaagaatgtgcttctgtcaagtttgaattcacagagcctgtaaaaatttgccaagagccttgtctctgtttctgcagtcccctctcctcccatcactatttgtcaatcctcttggctaattcctgagcctttctatccttccagcagctaggatatagaaaaaggacactgggcttagactagaagttggcagacctgggttccagtcctagcactgccactttttaactatgggtctttgagctattttctacttagaaaattgggttcaggaacagtttggaggttcctcaaaaatccaaaaattaagctatcatataatccagcaatcctactgctaggtacatacccaaaagaaacgaaatcagtatatagaagagatatcctcactcctgtgtttgctgcagcacttttacaatagctaagatttggaagcaacctaagtgtccatcaacagatgaatgaataaagaaaatgtggtacatatatacaatggagtactagtcaaccataaaaaaggatgagatctagttatttgcaacaacatggatggaactgcagatcattaagtgaactaagccaggcacagaaagacaaacattgcatgctgtcacttatttgtggaatctaaaaatcaaaacgattgaactcacggacatagagagtagaaggatggttaccagaggctgggaagtatagtagggagttgtgggagtgggggtgggtagggatggttaatgggaaaaaagaaagaatgaataagacctactatttggtagcacaatagggtgactatagtcaataataacttaatcgtatgtttaaaaaaaaacttaaaaatgtaactggattgtttgtaacccaaaggataaatgcttgaggggattgataacttattctctgtgatgtgcttatttcacattgcatgcctgtatcaaaatatctcatgtactccataaatataaacacctactatatacccacaaaagaattgtttttactaataaaaaaattatttaaaaaaattggtttcagaatagctgtcactgttgtgatgacattgctttaagttcctaagaacaggtcattagcattatagctactccatgagtgttagttggatctctgttttcacgtttcaacatgtcagtctagcccgccttgtgtgtcttttttccaatgctactctctgtctacctgcccctattcatcaacctgtcacttaacattcttctctaggacatgacttcttttttctgtctcctattgtgcctgccttgggctttggctcctgtatacttccaaacaatctttattcttcaattcaggtgtggagcccagaacaaacttttaatcccgcaggcattcttgaagtgagacttagatgagattttctgcatcgttaagcgacttaaagtggatatgtcctcctacaagctgaatcaaaactgtaaatttttctttcatttcagaaacatcaaacaactccaaaaggggagagagcctcaagctttacattgtaggagatgcttttgctttggaaccggttgtttggctctgtgctaattgcttagtaattatagatagcattgaggctgctcattaacattggctaattttgctcatatactccaagtaggcaggtaccctagccaccttgtttttaccattatagccccagcacattgcgagctgcctgacatgagtgaatgagtgaatgaatgaatggatccataaatctgtaagacgggactaattattcctacctaagatggttattgtggggataaaatgcaataatgtagtaaaaacattagcctagtttctgtcacaagatgaacatgcaacaaatactagttctcttccttcccactcactagatgaatgcaaatgtataatgtactatattctcaagctacactagtagataggtctttggtgtgattgtatatgcacctttatagcattattttaaataagcaaagctattcactaagtccaggcataagaaagttggtctgcttatgaagaatctagaattaaaatcccttatagcagtaacttatctgtatcaagaaggtgataaaaagaaacttccctctgaatagtacctattgttcaaagcacctaggaggttctcagactcctcaaggtgatccttctgttcctcactacaataggcagttcaaggatcttttccagaatacaaagccaagaactccagttgtcaattctgaaaagatgttgcttggttcaaagaattagagcatatctgatcagtggttttggaagtgtgtctgcagggtgttcataggcattaagataactgcacgttttcaaggccaaatgtgtttgggaattcctgggctgaccaaagtaaacctatcttgttactgtgaggcctcactgggttttactttggtgatgcacattgtttggcagaagccttgtgagcagcatagctccagacacgtccaccttctggaaaactggccccatgtgtcccagacatggctgtaaagcaagaagttgagaaagtggcatagcgctaacagccctagtggatttggcaacttatccaaaaggccagaagatgggcaataaggatttgggaaataaaaacatggcctaaaatgttgaatttggcagatttccccttgcctgtcactccaattaggaatttgaagttgtagccaaagataagtatctttccttccatcaaaaaacaaatgtgtaggtgttaaaagctgcagtaatctccactgattcttgctgtcagcctttacctcccaggctaggaactttgatccttttggttcccatgtaacaaagttcctaccatcaagatggtagacattattaacagtgtcactcaatttaaaatgttttatttaattgtttgtagaccatggaaccaggagaaacttgggaacaaaatctattttggatgagactgaataaagaggtttctgccagtgggcagggaaactgctaaagccagggaaatgcaattgcaagtttggtgcttgtttcccagtagctcagaacagttctccctgccagacattatgatggagaattaattggcgtttcactttgcgatatcttttaagggttcaaatggcaccttagcatttcttttaacttttctgcatcgaatgcatatattctgggctctttggtgtgtagcatagtttaagggcttcataaatatttgttgagaataatcctaggacctctatgaagtttaaggactttttgtgttcatgggtcataaggaaagcatttttaaagtataacttgaccatcaatcaaaaatgcctagcaaccatctccgtatccatcagtctaaattagcagctgttggtaacaataattagcccaattccccagggtgcaatatttagtcaacaaaagcactcaactctgctattcactacttcttggtgaaagggtcaggagatgcagttagattctctaccctcattcagacacttgaaactcgtttccagagcttagacctcttcacttgcatctctcaatcccagtatcattacatttatgacattgttgattaggctctctccttccctcctgtacaacactgaaaatctgccagaaatacaactatagaaactgtatttctatgaattttgagcattttacaggtatattcttttttagatgggtgaaatttacacaacataaaattaaccattttaaggctgggtgtggtggctcatacctgtaatcccagcactttgggaggccaaggcctcccaaagggtgatcgcttgggcccaggagttcaagaccaacctgggcaacatagtgagactctgcttctgaatgcacgattcagtggcatttaggacattcacattgttgtgtagccaccacctctatcaagttccaaaacacttccatcataccaaaagtaagccttatactcattaagcagttactccccatctcccctcccctcttagcccctagcaaccaccaatctactccctgtctttatgaatttttgccttttttggacatttcatacaaatggatcatacaatatgtggcctttttgatggcttctttcacagagcataatgtttttaggctttatccacatcgtagcgtgtgtcagtgtttcatccctttttatggctgaataatatcctgttgtatagatatatacccacagatgtaatttttagagccaagatatattacatttgtaaatccaaagctttaagagccattaagagactcaaaaggacatataacccttggagtaactggcctgaaatttttctagatgaaacagaagagtacagatctgaaattctcctccttgctgctgccagctagctttgtggccttgtataaatgagcatcaattttcttaattagaaaataagtaactagatttagtactaaattgtttcaaggttgtttctttgctcaaaaattcccagcatcctacgcaatactccgcatataatagctcttaagagtgttgtttatggaacttaacaaaataccaaactcaacaagattactagtccagcatcatttgatatgctcagaaatggtatgcttcatgccacaattctcttgtttttaagagaagcacttgcatttttgaatcaaagtgttcattattaataactgaaccttccaaatgaacctgagagtacatagaaggagattgagacacaccagtgccttgctttttagtttatacatgagaactctaaccagaaaacctaaatgaagaagagaaatagtgcatccactggggggatttgtgagaaagctcatgaatattttccacagcatctgctgggaatatggtgcaagaaaatgaatacaaagagaaagaaaatgagccagacaaaaaactccctttttaatgtttattttagagagaggctagtaattgattaaactaatccaatatctggaaacattcttttttaatattcactttgccttttatgcagtttgaaattttggagactctcctttgaagtggatcagggttgcgtctgaaaggaacaaacagtttcccagacagatgtgtgaagaaatgcctagagctacgcgcttcttgctggggttagacgtgaccgggccagactgttaaatacacagcaacatgaaatatgaatattcttttgctttcgcagggaattttttttcctgatagtaaaaaggaagagggcaagccattttgttgttttctccaattccttcacttttttttaaagcttgcattcatttgttttatgttactgtgttgtgacattttgagatgcctcttaaaactcatgtgtaaaaaagcactttttaagagatatttattttccttttctttttcatttctatgcagtgatgttgaaagtcatcttgacatttctgaaacattgttttgtttgcattacagagtctccatggcaactgcatcctcccaggttctaattcctgaaatcaacctcaatgacacatttgacacctttgccttagatttttcccgagagaagaaactgctagaatgtctggattaccttacaggtattgtcttttatgttctctttaatattgtgcacacttagtgatataaacactttgccaccagatcagttattccccaataaccagaggaatgggcttttgacctaggaatggcactgatatttccataaacaatttctgtgcattgccctttgttttttcatcaaaacaacacagcccattactaaactggggacaggagaaaaaggagaatctcaaccattaaaagcatacttaccactgtttccctcactctcaaggtgtgggtgctaaaaatagtatctctctgtggtatttttcatatcatagtagtaagcaactcacaatacattggcagagaaaaaattggcagctaactgattggttgtctgtactgcttcatctccttgtatttgtgatcttgttttaatttgcacaacatcgagttgaggtaaagcattataatccccattttgcaaatgacagagatcagccgtcttgctggaaatcaggtaactagggaatgacagaattagaatttggctgggacctgtacaaactccaaaaacttctgctctttctagtaaaagactgaattttatcttggcaaatgtcaccatggcaaaggtcacaaatttacattggaattcctagtgctgtgtttcagtgtgcttcctggttggtgttttgttttgttttgtttctcccttggttgagcttaaaaaacaaaaacaacaacaaaacaacaaaaacctcaggccactcctattcctaagcatgcttctaaacttttctttgctgtcaacttctaaagtaggaactgagaatattcactggtagaacctggactgtttagacaaccttattcgtgttagccaaagccaccagtgcctgcgacttcaggaaagcacaatgtacacagtgaagccagatgtgcgctgcacttaagacatacagccttcaagagaccacgtctctaacttagcgtgacatgagcttctcaattccaattctgtgtgtacatgtttgtgagaaagcgattgaacaaggtggagcaggagaaagggaacattgtgtgatgtttgtttttacagtctgtggatagaaggccaggggttctatattcagggagcattgtacccagaagatgagcattttttctttgcgaggacccaatgtgccgtttttagcctttctgcattgtcaagcaaggcaggcaggcattccacaaacttcttatcttatgtaactctctctttcaaacataccactcctattaaggaagaaagaaattgactaaaaaagcatttaccgtatggaactaaacttggtttcaaatatttgtgtacataatgccctcctatttaagcttttaactctgagatttatttaaactgacactatccaataaaactttctatgatgatagatatgttctatatctgtactatccagcgttagctgcctcccacatggggctattgaaaacttgaaatgtggctagtgaatttttacttttatttaacttcaactaaatttaattgaaatttaaaccaccacatgtagctcgtggctattgtattgaacagtgcaggtctagactttctccagctaagctgtttttcacagtggcatcctgttaaaaatctcctttttcttatatcatttgcgaatgagtttagttgcaagcaacaaaaaatccaactagcagtgaataaaaccatcaaggagtgtttgtattacagtcacagaagagaagcctgtgttccagggctgggcagtggttcagtgacgacctcagaccccaggctctttcttttttcctcctctgccgccttcattgtgttgcctttttgccacatgatcacaacatgactactccacctccaagtgttgtgctcaagctctaggcaaaaagaaaggggtggaggggaaacgatggacaaaatgctctgccagtgaagtttgtttatcagaaaaacaaaaagcttgatcagaagacccgcctagcaaacttccacttatgtctggtgggctgtatctgtgttacaaggtcatgtccagggacagaaaagactggaaaattaagtatttgcctaggcacatggccattctgcccagaatcagtcttattgacaagaatgtgcccttgccatttcccaataattatttcatagtatttcaacaacatatacccattttaatctctataggaatgcaaaagtattgattaaaggggaaattgtgaaagtagtttagactgaattgtaacatacaccatatttcatcccgatggctgtttatttcaaactaaaggccatatggggtacctgctattatgtcttctgagctgtcaaccccaaatacaaattcagtccatttctagacataacatcgatcctgaccataacatatgatgcttggctgatactgccaagtccaaatagtttatgacatttgtaagcaggaaatgaagtctttgtggagtattagcccaccattccttgggtggtgtttgtgacagagacaagaaaataacacttctggtactgattccatgagtattgaaattggcagcatgctgctgttctcatttacactaaattgagtattgacttctcaggacaaactcattgggtttacagtcaaaataaggttagcctgtctcattgtaaaaacaagattttttttttcctatgacatgcctctaagtggtatatcaagttaataacccatagaggtgacatttccttcctgattatggctactaccatgtgtctcacagctacttgcctattttgaacatacgttttctttctatttaattgtatattgcaatacagaacaaaatttttctacaatggttgatggagaaataattcaatgaactgtttaaattgtgagagagtaagtatttcttcactggtccatgcaggagtgatcccacaccaacagggaccacacagacaataataagcacattttacgatgcagctggacctcctccgtggaatgcatatcctgattggtgtcactgattcatgcacatccaagtcataccacatgacactaaatctcacatgtgaatacttcaggagacagatgtacaaatacatattccagaaagaatgctttaaaggttatgtagaacccttctgtcttaatgcacaatttaatgccatgcctgtcacgttggaggtgctcaacaatgtttctggaattcagaaccaatagataaagctaagctaattgacttaataccgtagacttgcttctgtgatacttgtcctagaggtatattcaaaaagcaaagtgaagactactaacgcagagtttaaatttacagtttttataaacttttcttcctctttgggtttgcttaggactcatcaattctaatcataatttagagcaggaaataactctgaaatagtacaagcaaaggttgctcctagtttgtagagtgcaggtatgtttctccttttgaagtgagattctagtgggtagaagagtggaagtaaaggccctggatcaattctctaaaccagaggtcagcaaactttgactgcaaaccaccagatagtagacactttaggctttgcagtccatatggccacaactactcaactttgctgttgctccaaagcagccatagacaatacataaatgaatgaatctggctgtgttccaataaaactttatttacaaaaacaggcagtgggccagacttggcccacagtcacagtttgccaacccctccctctaaaatattatttacaatgcaaagcactcattttctcatattttccttgctcacatactcttctcataaaaccagttactgaaatcaattcagtagaagtcattttaaactcattattttggtaggacttagacttctctgctccagaatgtgttaaagaaataaaacagcagccttctacaatgataaattaaccaaatgccaaaaaaaagttttttccttggggaaggaaaatgtaccttttagatatgattgactatgaatcatggtcttctgaatttgaaatatcgcatgagttgagaaatgagaagaaaatagggctggactagtaagttcttttttttatgtaagtcatcgaaacatctaatgaaagaaaaattcaaacaattatgtggctgattttttgtaggataacaaacataagtattttttcaattgggtgcctaaagatataagtatctggcaccacgtattaataggtcaggggttggtgaactttgggttacagcccaaatctgaccctctacctatatttgtaaataaagttttattggaacctggccatgcccacatgtataagttgtgactgttttcatgctacaatggcagagttgactagttgcaacagagactgtatggcccacaaagctggaaacatttaccatcaaggcctttactgaaaaagttagccaacctcccaaagtgaatgcagctatgaaactttatcttgtttactttttatttgacaagttttccttcatgcacaagaaagtattatttgtttaacctcccaaacatattctcatgatctcatgataaacacagaaagtccatactggctgactctagtcacactccttattaaaaacaaaagcaataaccagccaatcagatattctttagattggggtcaccatctctaggatagtagtcctgatggacctattgagaaggacctgcttaactgtcaaacatctcctctgaaatggtatcccagttgtgtgtgcttttccactgataagcattcttgacccccacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtgagtatctcatggcctatttatttctgtctttggtggctttcttcagattgattgcattcctgaatttaaacttcaaaggaagacaaggaaggaaagaacacacaatatttattgacttgtctttcttgaacaaaaaagtgatagcactcacttgtactacattagtaaaaacagctggctaaatattgatgaaaattaatgacctctagcaaaccacatggatgttaagggaaagaagccagaaacaaatatatagagagaaacaaatatatagagagatacatagagagagaaacaaatatatatatatagtattaatccacatataggttcataacttaaagatcaaaataaactattttgcttaaagaaacattcataggtgttaaaactataaaccctgggcaacctggtgaaaccccatctctacaaaaaatacaaaaaaaatacaaaaattagcggggtgtggtgacacacacctgtagtcccaactactcaggaggctgaggcaggaggatggcttgagcccaagaagcagaggttgcagtgggcagagatcacactacagtactccagccggggcaacagtgagaatgctgtctcaaaaaaataaaaataaaaagtcaggatgatggctacctccaggattaaagggcaagtggcaccactggaaagaaatatacaggggttcttggggttaatggcaatttctaggtgaaagttacatgctttagtcattttatcatacatttagttttatgtactttcctgagtgttacttcacatattttaaaagaaaggatttaataaaataaatagccaaagaaagttaaatacctggtcccattcagaggagagagctgggcccatcacttaaaatgttagtaactggccccacccgggaagaatttccaaccttacctgaaacattagaggtgccccctctcactgaggcctatttgatatctggcatcagagataacttggtgatttcaaatagcagtagtagcaggccacagagatgataacagaggaagcagtcctccaacccacagagttatttaaattgaactgggcaaatggcaatggaccagaagacatggcttttcacgggagcaagcttgaaacttctttaacaaagaaaaatacaatatgtcaaaatagaacagaatagaatagcagtcatgtttcaacaaagagatgttttgaataaattcatatcaatttaatgtgcttttattatataaaccttttctctcttaactacaaactgctctttcctagcacaagtaattctgagtcatacgatgcttaacatagaaatttgatttaggattaattaaaagagtgatgcagaaatacaccaagttctaagggactaaagtataaatgacccataccaacaaatggctccccctaccttccttatatccactctccccaacttctccaacttcctctcctcaactccctcaccttctaccctataattggcctgccgtggaagcttttattaaaatcttgccatttaccaagaatgtgtaatttttaaatgaaagtggagaaagtcatgcaatgtcaagaacagctctggcaagctgcctgagtcagtagggaatatagaaaggtcagaaatggtgagtgggacaaaaatgtcttgggggaagttgtggttaaactaagtcttgaaaaaaagcgggtgcattttagcaagttaaggctgtaccggacagctatgtcatcataagcaaatctatcaagatgtaacgtagcagggcatagtgggaggtcttgcctaattaagcctggctggtaagtgaggaaagggagacagtgagaaatgaagatagagaaatagaaccagggctcaaacctatattggcctagctccaaaaagcacatgttcttaatccttaatcctcagtcacctaatcctaattcacaggcaagagctagattgcagagggctacccaggccataccatgtttggattttaccctgtgggcttgagagtcatgcaggacagtaatgtaatcagaggtataactagaaggtgactcaggagcactgtggagagtggagaggaacagggcaggaccagaagcagagacatcagctgggaagtttcgtagtaattcactgaggcagaaatagccaggacctgcaaatggcaccagcatcagagatggaaaggaaaagataattccaggaagacttctctgcgtctggcccattttcctgggaaaaaatcatcagtgtcctcagatatttgaagtgctttttggggcaagtcgcagaaggcctgtatagcaatggtttagtaacattttgctcaccttctaggattttgaattcttctggtatcattcctcatttctgactctatatgccctactgcaaatcataaagaaatactaattctctaaaatatttttctacatgtgcatatcatacacaatgctttaccttgtttttttcaataaatattatgtctgagatatcattccatttcagcacaaataaagaactgcctcattcctttttgaggcagtatcatatcctattttaaagatatgctctaatttatttatcccatcttctatagatgtttatttagcttgtttccaatctttggcccttacaaacaatgccccagtatccccaaggatgttcaagatatccttgaatatctctccttccacacacggggaattatatctgtagtataatctcttgaggtgcaatttctaggaaaagattatttgcatttaattttacttgacattgccaaattgcccttcagagagatgacatgatttttaaatgcatttttccagctgtatgagcttattgtatttcactgatcttggctacatataccataaacttaacgtggaattaaagtctagtaaaattttaaaccttgattgtgcttcaccataaacctgaaacacaagttaatctatgatcactaatatcatactaaatagtcactccttcatataagcagtgattctcaacaagggcagttttgccccctaagggacatttgacaatgtctctagagacttttggttctcaaaacctaggaggagggtgctattggcatctagtgggtagaagtgaggaaagatgggaaatctcccacaatgcacaagaaatcccccaacaacagagaactatctggcccaaaatgtcagtaatgtcgaagttgagaaaccctaatttaaaacaaggtaaatgtataatatctacatgattacatgctaaatactgagaccataacacactgatccacacacactactatactatgtagcatggaaggaaaaacacaacaaaaaggggggaatataattaatgtattttgtcttcacttaaggaattgttttctcaatattttgtgattaatatcactagcatatttgggataaactgaaccagggattgtatcaaacttgaagaagatgaaattcaaaagatgatcagaaattccaaggtaagagaaaagaagcacgtgaaggtctgagaagagcaggtagaaaatggagagatgattcattgtaaaacaccaaggaaggttctctgaaaatacatagaggactgatagaaccaacgtctgttgatgagtgaatagtctaaccggaaaaagaaaacatttggagtcattttataccaaaagagtggttcttggcccatgtgagaaatgctatatttctctcaaatcattttcgtctgattcaggaaaagtgctaacagttttctattgctgtgaaacaaatttccaaaaacttagcagtttaaaacaatacccacttattatttcagtttccatgggttaggattctggcatagttgagctgggtcttcttcttagggtgtcacagtctgaaattaaggtgttggctgggctgcattcatctggagactcaactaaggaagaatctacttcttagctccctccatttgttgacaaatttgtttcattgtggttgtggaattcatggcagcttgcttcgtcaaggccagcaagggagagagtctgctacttcaaatctgtcacctccaaacctgtctttaaaggactcacttgactaggtcagactcacccagaataatctgccatttgattagctccaaatcaaataattagggaccttaattatatctgtaaactcccttcgccttcgcctttgtcatataatgtaatataaaaacaggagtaataaaagtgatagacctttgtcctttgccatattctgttggttagaagcagatgacaggtcctgtttacactaaggagataatattacacagttatgaataccagggagttggaatcctggggaccatcctagggcatgtcttcctcagatggttatgtctctcctgaaatttcttttggttttcttttattctttcatatatgtatgtgtgtgtgtgtgtgtgtgtgtgtgtgtgtgtgtgtgtgtgtgtgtatatatatatatatatatatatatataaaatttcagacagtcttgctctgctgcccaggctggagtgcagtgtcatgatctcggctcactacaacctccacccccagagttcaaatgattctcctgcctcagcctcctgagtagctgggattacaaacatgtgctaccacgcctggctaatttttgtatttttagtagagatgggatttcgccatgttggccaggctggtctcaactcctggcctcaagtgatccacccaccttggcctcccaaagtgttgggattacaggcatgagccactgcacccagccctctcctgaaatttcttaaatcaaatcgtcatggacactttgggagtacatgtagccttggccttgactgatgggctctgtatccgttggcttttgctgaatagccaacaaccacagggcctaagtagaattcatattgcttatgcatctggagtcaactgagtgtcaactaggaagccctgctgatcttggctccctcacatggcagactgataactgtggcaacccgactgctgcacatctgtctcatcctcctacaatccagctcaagtctgctctcaccctgattgcagagatgaaggagtaaaggcaggaccaattacacacattctttttaagcccctgtctgtgtcacattagctaacatgaggtttgtcaaagacgtcccctgggtgagcccagagtgagaatgcaaagacctgcaaaattacaaggaaggagcaaggaattggggccaaaaggccctaactcaataccagagcttcacctcatccccaaaatgaaaggaagatatttattgcttgaaacttagggtttctcacttggctaaactgtgaccaacttgatttctgtgctatttgcatcgaaaataataccaaacatgatgcattaatagaatagatgatgcaaaaaggtcatgcataaaaaaactcaacaagagcaaaaccactcagtataatgaactcagaactttatgttgggtgattccagagatgttttgttcccagaaaccagttgccataagaaaagaaatgcaaatggcttagtgaagattatcagcctttaacgcatagatgccagaaaggcccattctcccaggatggaagaaaaacagtgaaactgctggtgctgaccaaactgggatactctcaccgggttgtttgtatcaggatgtgttcctcccttgatgcccattaaaccagaatagtgaagtcctaatgcctacaggatccatttgcgacaaagaaagaattcattcagataaaaagctaaccgataggcaaagattttcaaattattttcttcttaaatatttttcacatttgtagtgaccaaaggagacctggatttcaatcttgactttggacctcactagctctgcagtcttgagcaaattatttaatgtcctccgaatccgtttcctcatctgtaagaagggatagtgttttaacttcacatggttgagataataatagtaaacaccttagtcttgtgtttgccacagtggtagcacatagatattcaaagttattattcctacaaaaatacggactgtactcaccccataattgcattttaaaagaaagaccagttttgcaattttccaggattatctacatgatagctttttacacaatcagtatgtgaaaggctttccttgaatgatgttaaataatctgtcctattatttggagaagtatcctttgcagatgttgtattgcgtgacaaggtctaatggtaaaactctactgaaaatgagaagatataatgctcaaaacctggctgtagctccttatatcactagaaaatcttttactgtctctaggtcatggttccttcactcatcctaataaattgtagttaattgccttcaactggcgttagtgaaggagacttagataatatctatggagctttttcaatcttacgaaaaggccctcactaatgaaatacatacattcaaatgcaaaagtaatgacattaatttttattttttatttttgttaatagagttatgactatagatgttaatgaattgcttatcaataactagatatttatttaattttacaacgtttgccacgttttctctaaaactacttttgatgcttcattttaagtcttaaattgggtcctttccccagcagcctattcttattcttagcagaaatcaaaagctgcatttttttcaagccttaatggctaagtagttatctgtttttaatttattgtagtcacttagaaaacattcatgaaaattattaaacatatactatttttacagaggagaaggaaaggaatgttcacttctgtccagtctgttggaagagacaaaggatgttagaaaccagtgtgcagcctctcctaagactgtccacatcatgtgacatttttacacataattttttgtggcaagatgacagttgccatacaaggctctgaaatcccagatgtaattaagatcttataatgagccacattatgtagggaaatgcttctaacccattgtgaatgaaaaaaaaaatgtataaaatcaaaaaactcaattaattaggtttcattgtggacaaattattttccaagctccgttgttattttaaactgagtcggaggaggtgaatgttggaacaccctcaaagatgactgaaaatgagtttggagaaaagtgaagtttcaatcaggatggttgtgtgggtgtttcataaagagatgaataaagcctggtcaagagtcctaacacagtggggtgtcaaggcagagaagtcttgcttaagcaaactcagtgccatatgcaagaagttaggtggtgctggcgtaagaccaacaccggtaatggtgcactccaagtcaccccacttactccagcccccagaagaaaattgtcaatgttgctttcctggcatttttaatcaacttctcaattattatcttggcaataataataacataaaggtaaacctaaacagtaatagtgtttgttagtattcatgaaagtagattgtcccagtataaagctaaccaatgaaattttactacttcataaacattttgttcttttaattttcaaggaaaaaatagggacctcttcaaaataatcaggatagtcagagtccctttttgtttggaaaaggtttctgaaacataaaatctttgttgggttaagactttggattttaggccaagttacagttttcagcaatttcagacatctgctttatgatgttactgaaagcgttcccccaccacattaaacccagcttttgggttgtacagtgatgtaaagtttattgaaacatttttacacttgctttctttgaccacaatagtcatttttttgtaacatattcaattaaacaggaacagtataaaggcagtgaaattgatacgattctcatttgaatctactgaatgccttaattgttctcattcgtggctgactgccattgacaaagatctaggaatatgagtacactatcctacataatagaaaagctaattttttgttttattactactgtaataatattaagtacctaaagagagttataggcctcttggggcccagaactcagagttcaaaatgacccttctttgattggatcaaaatctaatatttggctgtggcattatccagaagtatggagtttattatagctatgttcaaggaaaaggtaaggtgaaggaagatcagaagggatatatagtaaggagattcccatgttactaaactatttgtggatgttttcctgcatcatatgcaaatgagaattggtaggaaaacagagggctaagaattagagaaaataaatttggggaggagggatggattgtgcctcttattgctctgctgaatctccaaatataaacacacacacactcaaacccttctatgagtcctaaattacattcttgcttcaagctggctttttcaaatctggcagtccactggcgaaaatgtttgcaggttagagaaaaaaaaaaaaaaaggcaacagaaaattcacaagaccaaatatgtgtgtgtgtgtgtgtgtgtgtgtgtgtatctttagatatctttagatgatatatacatacatacatatatatatatatatatttaattcactgatgtgtacttgaaaatattatgcacccaagatggaaatcatataaggtgaatttttcaactgtgacaataccatgaataatttttaactcaaaagatggagtaagtaagtattcagtaagattcaaagacaggcttcgggagcctgtgactaccttgaaattctatgcatatatttgtggtttggtgtgtatatgcatttgtgaatttcttactacagaaaggttttattagattatcaaagaggtgagaccaaaaaaagattaagggactgcttcttgagaatctggtaaagtataagttgcctcaagatcaaaggaactaaccctttgacttgcaaatcaattgaaagaggagtggggtggtggctttggagtcctctggaagtggagggggcccagccctctcccagggatcagtgaaggaaattcaacagagtcaggaaacttcttgacagcctggtcaccaagggtttggaaaaaggttctattggagtggagattgatgggtggaaaaaggagagaggggagttggacctgataccaaagagatgttttcagccatcaaccagctgcaaaacaagatgggcttccttttcctacatattcttccaagcatcataaatactcggtctgctccccaacccacatcctgcaggatgcagccagagcaacagccccactccactctgaaaccagtcatcctagggatgatgatcatttcttagcttccctgttggaggtcggttggggttggctgatcgctgcttggttcactcctgcactggctgggcgttggctgcatggtaaagctgttccctgtctcatcctgttgggataaacagagtatcctaggcatattttctccagagcagtggcagacacaaagggtcaacagaaaccctcaaggttttgtcatgcctactcttgcaactagcacattgtcatttcagcctcatgctattgaccaaagcaagtcacttgaccaaattcaaagccacatgacagggaaatatattgcacctctttagaaggagcacctgcaaagttatttgggcctggatatacagggcagggagaattttggaggcaaaaatgcaatctgccacatctacgttagtgaagtcagtttttcgtacatgactaccaagacaaagcacttcacttaccaactctattcaaataaatggaaattattcaacctaaaattatgcaaacattgctccccttgtgccaaagaactgcaccatgtctgattggctttgcaggtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagtaagtgctgtgaactcaacagagctgtcatgtcttatctgctcttctttcagctgactctgtccccctttcttttccttttctctgtcttgggtatcattgacagccccccaaaacaagtaaaaagccagtgtggaataatggaatttgcatcagatacctctaggttccaaaactgattctattccttcacagccgtgaggccattactctctctgcattactcaattttaaaaaattgagtcttctcattttttaaataaatattcctggaggcattcttgtgagaagtagatgatgtatatgtaagacctgacacacagtaggggctctgtaaatggtggatagtgttatttttcatagcagagtagccaactaatcactcttcagaaattcttttattctagaaaacagtcggagtctgtggttctcaatcagggacacttcttcctccccctccaccccaccctaccaggacatttagtaatatctggaagaggtttttagttgtcacatctgaggtggatgctaccggcatgtagtgagtagaggccagggatgatgggaaacatccccaatccacaggacagtgcgcatcacagagaatggtctggcctatatgtgtgtctcatgatactgtcatctccctctctctgtccacatgtgttttgttttatcctctcttctttctttacatccttttgatctaggaatattatgttatgtaacatggtgtttatttgcataagacctcccaagagaaagcaaattggagtgtgtcggtatggcgccatgttgtgaggttgccaggcagtcaacaggaacaattaagtgcttttcaaggggaaccctcatttaacctatatccttgtttctcagtacaagtgttgtatcctagaggaatgtgttggatcctagaggaagaacaagggatgtaaagagagcactgaattacgaatgagaagactgtggctttcccacttggtacccatatagctatatggctagtttcttcatatttttaaatagattttttattttggaatagctgtagatttacaggaaatccatagataatacagagagttctgtacacccttaacccagtttgcccaaatattaacatcttatgtaaccttggtacagttatcataactaagaaattaacattgatgaattactcataactaaactccagactttattcagattttaccagctttccactaatgttcctttcctattccgggacccaatccaggatcccacaatgcatttagtgttccttcagttttaaaatgggaatattttaacaacttgagggttgttatgagttgtcaaaaagaccctctcaaagtaattctaaaagtacataagagaatataacatgatgatatatttctttacagtcatacaacaaatggcacaatacctatgcacacttagatcagcattatttgatttgcatttgaacatgtaaatatttgttccttcaaaagatatgtttgagcaccaagtgtgtttgggatgctgtgcaagatgctaaggatattatgagtatcttcaactccctaaggtgtgcttctctctcaaaaaggtcctagactattggggaataaagcacattaatcctaattaacattcaatatgtgaaatctctgactggaataaccatgagaggttctaagttgacaaagccagggtgccccagcacaaccttgagaggctttccaaggtaggttaggagcaggggatgtgaggacacagtgttccatgcagaaggaacagcatgggcaaaagcccagagacaaggagaatatatttatggaacagaaaattgatccatgtggttaaagtgtgtcttaggttgggaggataggtgagccaggaggctggagacaagaacagatcgcgaaagcctcctgggccacaccagggagtttctttgtataccaatgattggtggagagattgaagagtttaaatcaaacaggcaggatgaaaatttccatgaaataaagctctcttgcactatgatgtggtgagtggattacaaggaaggaagactggctgctgggcacagtatcaaaagattattgaaagagttgtccatgtaagtaaacaacggcctgaataagagtcgtgtcccatacaaatattataatgaattgaattatttagtaaagtaagctattaatctctttcttgaactaatttgtcttcactgaagcaaaagccttgaatttgggcagagtaggtagtggtttatttgggaaacatatctgaggcatgggcagaatttgctcaccaagattgcatgattctgctccacacatgcgtgggtgagggtgtgagccaaggcaggcaggatgtttgaggcagtatgtcaccatcacaaggccggtctttccaatggctctgacattctgatatatctcaccggaaggaggccgagcagaacttggccttcattgtaaatgatgggcgccattaaggaatttcttcctgctctgcccattagtatcctatcaatcatttttaatccatattctaccttccacctttaaaaattgaaatattttaagcaaaactgtcttcatactcttcttgtcttagttcatagtttatctctgatagttgctagcatgatcattcctaaggacttctttttacaagtcaaaatttaaactacacatgtaatccaatagatcttacggcctctgagaatgtccaatccctgctcagcccttgagggttttctctgctccccctttaaagcttttcttttcttttttattgttatttttttgagacagtgcctcactctgttgcccaggctggagcgcagcggcatggtcttggctcattgcaacctccgcctcccgggttcaagtgatactcgtggctcagcctcccaagtagctggaattacaggtgtccgccaccacacccagctaatttttgtatttttagtagagatggggttttaccatgttggccaagctggtcttgaactcctgacctcaggcaatcgagctgccttggcctctcaaagtgcaggcattacaggcatgagccaccagcccagcctaagcttttctttgatatgtacagaaatagatttctaaaacaaaagccagctaactatagctcaagggccaaatctggctgcctgattttgtaaataaagttttattagcatatagccacacccattcatttacctattgtcctgtccgtggctgccccctcactatagcagaagagttgaatagtcacaaaagagaccacatggcctggcctgcatagccaaaaatatttactgtcaggccctttgcagaaaaagtatgctggtccgtgacctaaaaagaaaggattttagaggtgctggtgttgtgttgtgtttgtatccaaaaggcaactggaaatcctttggcctacccacatgtgacaacacacactgtcctatactcactgggtcagtttctcgcccagcatcgtgtattgccacagttgaatttactagaccttttcctgtgattgagagctgtatactgggcagaaggaacctgccaactgcaacagtgactgtggagtttggacaccatggcatttgtatcaggttgcaatgcatttcctgcctttaaacgccttgtacccaatgcagtgttgaatgacaggcagtactccaaaccaatattgaattgtcaaagaagaagtaacaactatgacaaaatgtccaggtgtgactctgccaagatttttttaatacttaaatctttaagacacaaatgtgagtaatgaaatagagaaggccttattatatataaataatttcatgagtagaaaacccaggcattgctatcacattttttcctaattttgtggcctgaaaattgtattctcatcctaaattcctaagagtaatgctttaatttttaataatctcagaataatataaacctctagaatattctatatgttaagacccaagatcttgatttgtttggtttctggtctgaagtctattgagcatgaatgcatcttatgctggatagaacactgcagtggttgaaaatggagtcttcattcattcctccttttcaggatgctatccagccagtatgtacctgtgctgcttgtatacacctggaatccgtgaagctagctcaccctatgttttctggctaagccttatccatgctgttgttgaatagttggcatgccaccactggatccctatcttagaactggtagactgaaagcttatgaagacaggaacatgttctttttcactcttactgtgtactgtactatacacagagttgctgctctctattgtcttttgaatattatgaaaactttgcaagcaaatgtctttgaaagttgcttataatgtttaaattactattaaaatataagataccactttgtgataggaggcatgactcagggagggctggcttgttcctgtcttttaaacctgattttgaaaatatgctattggttatgataaaataaacaatcctcttcctcttcctttttctgttttgtgaatttgttttcaggc

SEQ ID NO: 2998 - DNA, 144353 bp, human
ccctttcttctttatctcggtgtctgaggagttttgtctgcggcttgtcttgctacatttcttggttccctgaccaggaagcgaggtgattaacagacggttgaggcagctccttaggtggctttagcctgccctgtggaacatccctgcgggggactccaaccagccggagcgacgcggatcctgagagcgctcccgggtaggcatttgcccaggtgggacgcctcgccagagccgtgtgtggcaggcccccgtggaggatcaacgcagtggctgaacactgggaaggaactggcacttggagtccagacatctaaaacttggtaagactagtctttggaacttgcccactccatttgtgtggaagcgtggtctgatcacccacggcatgcctttatcggcactttggttttggttttgacttggtttgaattgcttgacggaactggtcttgggaacttgcccgctccatttgagtggaagcgtggcctgatcacccacagcgtgcctttatcagcactttggtgttggttttggttttgacttggtttgaattgcttcacaggactggtcttgggaacttgcctactccatttgagtaggaacttgcctactccatttgagtggaagcatggcctgatcacccacggtgtggcagtaccggcactttggtttttgtttttgacttgacttggattgcttgatacttggattgcctggattgcttagttttggttttgacctggcttagatttctggatactctaattttggttttgattctggtttggtgtaaactgcaaaagtgtgtgtgtgccctttttacctgttctttgttttgtggtgtgcgtgtggtgtgagcatggtgttttgtctcaaagaagcatgggtcaggcacaaataagcccaccctactaggaactatgttgaaaaatttcaagaaaggatttaaggaagactatggagtactatgacaccaggagaacttaaaactttgtgtgaaatagactggccagcattagaggtggcttggccatcagaaggaagcctagacaagtcccttgtttcaaaggtatggcacaaggtagcctgtaagccaaggcacccagaccagtttccgtacagagacagttacagctggttttagatccccttccccccacagtagttaagagaacagcagcataagcggctggcagaggcaaggaaagaccagcagacagaaagagagaggcagaaagagaggaagaaacagaggcaaaaggaaagtcagagagagacagagagacagaaagtcaaagagagaaagaaaaagagaaagagagaaatatacaagtagttaaaaaaaaaaacaacagtataccctattcctttaaaagccaaggtaaattaaaaacctgtaattaataattaaaggtattctcagtaaccctgtaacactctaatactactttgttgtcagtgtaaacaagggcatatcccaagagcactgaggccttcctatcaaaaatccttaacccagtaacccgcgaatggcccagatgcattcaatctgtagcggcagctgctttgctaacgggaaaaaaaaaattatgcaaaaaatgttgtataatttaaaagtactcagtactattgaagaaacagtttatgttcaaggtgtataagaaaagtaaaatatacctttggtaaaaggattataaggaggcataagaatgtggatttttacctacattaaaaggttaaaaaaattattgttttgaaagtttaagcgagttttgagacgttaattgtaaagaaaattctgtgtgtaaacatattagctaaagttaaaaaggtatcatccagtttttctgtgaactggacattaaaataaaaatgcaacaggtttttcttaaagcaccaacctgctctttaacaaaaattatgaaaggttaaaaagagtatataaaatcttgcttatggtcaaacattaaaaattagataaatatgtctacaaggttttattaaaattaagtttaacatcaataacactaatataaaggtaaaatttggcttatctagtataaaaatcatacagaaagcattgttaaatgtaaaatggtatttggctttctttggtctaaaaactaataaaaataggtgctaaaggaaacattcattttactagaagatcataaaagttaaaaacttaaaacaaactttggcaattaagacagcataccaagatgcaaatgcctggttggaatggatcaaatattccatgtgcacgttaaacaaaagcaattgttatgcttgtgcacatggcaggccagaggccctgattgtcccccttccactaaggtggtcctccagtcgacaaggcatggactgtgtggtagttcttttccaggattctacagcctggagtaataagtcatgccaagctctctctgctatatcccaaagtccggcaccctgcgggtcagcccccgagggctgtccagcctccgtctcccaacactaagttcacttcgtgtctctcacgacagggaggaaacttagcattccttggagacctgaagggatgcgatgagcttaagaattttcaagagcttatcaatcagtcagcccttgttcatcctcacgcggatgtgtggtggtattgtggtggacctttactgggcactctgccgaataactggagtggcacttatactttagtccaattggctatccctttcaccctggcatttcatcaaccagcaggagaaaaaataagacattgtaaagcgagagaagccccttgtaggtctttcaactctcatgtccatttagacgcaattggagtcccatgaggaataccagatcaatgtaaagcttgaaatcaaatagttacaggatttgagtcaatattttggtagatgacagttaataaaaatgtagattagtaaactacatctattacaaccaacagcagcaagcttttcatgagttaaaagaaaaactcacgtcagccccagccctggggctacctgacctaacaaaaccctttacaccctatgtgtcagaaaaagaaaaacatggcagttagagttttaacccagactgtaaggccctggccaaggccagtggcctatctctcaaaacaactagacggggtttccaaaggctggcctgcatgtctaagggccctagcagcaacagccctgttagcacaagaagcagataagctaactcttaggcaaaacctaaacataaagtccccccatgctgtggtgactttaataaataccaaaggacatcattagctaatgaatgctagactaactagataccaaagcttgctctgtgaaaatccccacataacaattgaagtttgcaacactctaaaccccgccaccttactcctggtatcagagagcccagttaaacataactgtgtagaggtattagactcagtttattctagtgggcccaacctccaagaccatccttaaacatcagtagaccgagagctgtacgtggatgggagcagcttcgccaacccttgcaaagtgactctgaagaagacgacaagccctgcttcagtcacacccagaagctaactggtccatgcacggccgaaacatgaggaaactcatcgcaggactcattttccttaaaatttggacttgtacagtaaggacttcaactgaccttcctcagactgagggctgttcccagtatatacatcaagtcactgaagtgggacaaaaggttgctacagtcctattattttacagttattataagtgtactggaactctaaaaaaacttgtttgtataatgttactctatacaaggtatgtagcccgggaaatgaccaacctgatgtgtgttatgacccatctgagcctcccatgaccatagtttttaaaataagattaaggactgaagactggtggaggctcataaacgatacaagtaaagtgttagccaaaacaaaacaaaacaaaaaaagaagtgcccaaacaagtcaccttgaaattcgatgcctgtgctgtcattaataataataggttaaaaataggatgtggttctcttaattaagaaagaggctatatggcagaaaataagtacatttatcataaattaagactgtgtaaaaataaatgtggatactggtcttgtgtcatttaggctacttggataaaaaaaaaaaatcctgtccaccttcagcaagggaaaagtggcccttcctgtaccagtggtcagtgtaaccccttagaactagtaataaccaacccccttaatcctcactagaaaaaagaggaacgtgtaaccctaaaaattgatggagctggactggatcttcaagtaaatgtcgtggtttgaggaaaagtttataaacgctctcctgagccagtatttcaaaccttctatgatgaactgaatgtgtcagtaccagaaattccaggaaaaacaggaaatttgtttttgcaattagccgagcatatagcccagtctctcagtgtcacttcgtgttatgtatcagcacaagtgtaaatatgtgaatcattatcaatctattgcacaggaagacataagtagcaaaaataagagtgagaactcccactaataaaaagtgagagtctcaaaggggggaaatgagagaagagagacagaccctctcatattgttttatattgttttatactcagaaaaggaaagagaagcaaaactaaaggcaggtagcccggcgcctagcaaccagacgtgaaaccaaggaaccagacctgaaaccgggcctgggcctgcctgacccaagcctggtagttaaaattccacccctgacctagcaactgatgttatctatagattataggaagacattgtaaaacttcccagtctgttctgtttcactctaaccaccggtgcatgaagcccctgtcatgtaccccctgcttgctcaattgatcatgaccctctcacgtggacccccccaccttagagttatgagcctttaaaagggacaggaattgctcattcagggagctcggctcttgagacaggagtcttgccgatgcccccagccgaataaaccccttccgtctttaacttggtgtctgaggagttttgtctgcggctcgtcctgctacccaattttctctgcgattattttccttctaaccctttcttaaagtgatgggctctaaaaaatcatgattcagctgctattgcaattttacctagccagtgaatttatttattttgagatgctttttgatattattgtcattgtcaaatgacattatgacatttcaaaagacattggctgtcagccagtgggatctagtcttaactcatctttggtgctcaccggtcataaagctgtagtcacatgtgtttatttcccccagcactcttccctcatttccttcctttccttcctgaaatttcctcttccagtggtgcaaaagctggtgagtaagtactgacaaaaccaatgcctcttccaatgtctctattcatttccttcctgtccatccctataagcttaactgtacatccatggttattttcaactttgagttaacatcgtagaatcaaacacttaagatattcaggtaattctgaataccatatgctatggtttgaatgtgtctcccaaaattcgtttgttggaaacttaatccccaatgcagcagtactgggatgtggggcttaatggtaaagcccttacgaatggattaatgccgctattaaaagggtttgtggaagtgggttcttcctctcctgctcttttgccatgtgaggacatagcattcctcccttccagaggacacaggcttcaaggtgccattttggaaacagagataccaggcccctaacctgctctctgttcttcttttttttttttttagatggagtctcagtctgtcgcccaggctggagtgcagtggtgtgatctctgctcaccgcaacctctgccgcccgggttcaagcaattctcctgcctcagcctcccgagtagctgggattacaggcgtctgccaccgtgcccagctaatttttgtatttttagtagagacggggtttcaccatcttggccaggctggtcttgaactcctaatgtcgtgatccacccgcctcagcctcccaaagttctgggtttacaggcgtgagccaccgtacctggcctaaatcgctgttctttataaattacttagtctcaagaattctgttatagcagcacaaaatggactaaaacatcatggttcctgcttttttggctcactaagtgttcgtggcttttctctttcaaaattttattgctaaaataaataaagatgtcactactttacaataattcatcacattccatttttttgtaagaaatagtaaaagttggatttctatgcccttgaaaaagaactctatccttgaggcaatctgaaactaagcatttaacaacttgaaaaattagatcacaaccctctgaccaaacaccagaaagttttatactgaaattcagatactctttgcttgtttattggcagggaaaaagccaaaatatcaagaaagccagcacaaatatgagtagtaatatccccttagctaacatagatttgcaccacccatctaccttctatcatgtcatcctttttatttctttcattttatgtatgagtctttgaaatgtttgtgtttttaaaaaccttttatttttttatttccttcattaaaatgtaagctctccaagggcaggcctttatgctcatatttaccaccaatttgctgctgcctagagcagctcctggcacacagaatgacctcaaaaaataccagtggaatgaaagagtaatgaaagaaatgactcatctggttttactccaaaagaagtagttctaattttttttaatgcttaaagaaagccaaatggatatacatataggatttccagtgtcataaaagtaacaaaattagcttactcttccaaactcttattttattaatattttttaataataaaaaattatagaatgcttcatgaatttgtcatccttgcattggggccatgctaatcttctttgtatcattccagttttagtctatgtgctgctgaaacaagcaccaaactcttaaaattagcttaggttcagagtgaagagctgaagttgcagaccagacccaagctgttttgggactatgaaggacattaagggctctgtttatttgagcaaaatctatgggtgaggcttacctgctttctgccaattttccttgtacaacagctgatgtcagagggtggttggataaggagcttggagccgttggtaaggaagttcttatcactttcttgcaggctccttttacctctagtcttctatgactcaagggtcattcagtgccaaatgaaattctgcctctgtggtaactgctagaaagtccagtgatgatctgatttctagtaacaactattggccatatccccaggaggagataagaattgtgtctattaggaaataattttccatggatctatcacctttttgtacctcttgtgagctggagcactgaatgattttattccagactattccccaggatgtttgtatagcaaacagtcttgggagatagaggtagtatctcgcgccaggggagaaggcaggtttgtttgttgttcattatattaaagacaatgtcttcctccagggcaaaagttgggcaggctaacttgcagtccattataaaagattcagatttcctaagcttggagttgcttaggtatgatgcaaatctcctgagtgtgcaaacatggacctaggatgctccgtaggacttcgagaacaaggggaaccaacagaacatgaaacacataccatttgagtaaaaacagcctttatctttgattcaggtgtcttctgccagcattcatgaaacgaaactggcaaatagcaaaaatctgaaacatttcactgttcttgatagtttcacatgctccatccatgccagggtcccttatttcctgcaaaataaaaaaattctgacaaagagtgcatatgggacagggtgaccttcactgggaagcggaagtgaagccccaagttcatggtgggagatcagtggtaatgaacagaggtatgtcatagtgtaggaaacagatgaaattgccaatgtgaagataagtcattagtgttaagaataaaaatgctagttcatttcacattcacatactgtttgttcacataagatgctccataaatgttattgaataaatggatttatatccttcttgcttgcaaaaatggtatgaagaggtttccagtaaaaaacacagataatgaatttattcaaagaagagtgggaagaggcgattcaggacaagaagggaagaaggaccccaatcccccatcccctaccaccctgtccttccataagagtgagaattttgtcaggcattttaaaaagttcacctcactaatcctcaaaggacccttaagattgctctcagataaggaaactgcatagaagataggaagagcatctgtgagtataagatatgtacagtatctggctccgatctgcctttgcaaggaaatggcagagccaggatttgaactcaggttatctggcttcaaggtactacatgttttttgtttgtttgtttgtttgttttttgtttttgttttgttttatatgactgagtttttttactctatcacccaggctggagtgcagtggcgcaatctcggttcactgcaacctccgcctcccaggttcaagtgattctcttgcctcagcctcccgagtagctgggattacaggcacccgccaccatgaccagctaatttttctatttttagtagagatgaggtttcactacattggccaggctggtctcgaactcctgacctcaggtgatccgcctgcctcggcctcccacagtgctgggattacaggcgtgagccactgcgcctgacctctacatgtttttttttttttttttttttttttacaggacaccacattgacagtgtcagcccaaaactagaccaagaacacttgggcacactgagctcagggcttagcccaaagttttctgaaagcatgccagagggaaagctggatgaaatgctttggtaaagaagaaagcacatcagctcatcactcatctgacaatagaaaggactgatcaggaagtggggaaaaggagaatagtggcaaaacatagaaaagagaaaaaaaaagactgaaatttttaatggagcgcaaaatcagacatatttttttacttttttgaacttctttagagactacaataataattcttatgtgataagtccaataagctatgatgatgttttattaaatgtaccatcatactagcagcttttgcagaatttgcatcagaagaaaagtataagatattaccaccatgacttggcaaaagcggtatactatattaatgttagccacttagttgctgtcattgtttctcagcacagtacccattgcctagtttccctgggagttcttgaaagctctattgaaaagttatatttaaagtgtaagttagagtgtgctgtgaatggagagaaaattgtttttctttttgtaaaaaattcactttccttgggactatatactaagttagctcagttatttgacagaaccagtatcttattttacaaagagaaaaacatagatctagaaatttccagaagcagatcactggttgaaagggcggggcgggggggggcatgtgattgaatgtgatttgaaggcagttttaattttatgacactttacagtgtgtgtgtgtgtgtgtgtgtgtatgtgttttaatgataacctaattttattgtcccagacttaaagatctgtgccacctggagaaactacagttcatccattagcatgtaaatctgttaagagtatttttgcttgaatttctccgagaaggctcccggctttgttctgtacagacacacagtcccgacgctgttcttaatatcctgttttcatttgtcagcgctgttgtccttttcattgccatgttcccatcattcctcttctttcatgtggtgctttacaataacattcagaacaaaagagtcactcctctttctgttgcctttaaaaaaaaaaaaaaaagacttcttcccctgactgcagagcttcagtgatcaggggaaatgtttaaagcatgttattcgtaatagttaaccaggagttgtgaataagggttcgttttccttactttttaagatcaggaggtagcttcagggtattgtgagcaaaaggtttttgtgtgtggctgactttgaagttgagggaaaaagcgattttctttgagaaaaggaggcatcatatttgagagaatttccaatctgctcacacaatgggaatcagttactctataacatcgtcattacctccatgagtcacgagactagtatttgttcttgtctttgaacttaagctttccagtgttcagagaacagttgtgaaatgttgcattggccatcatcaataactattttgctcctggttggtaataattgggaaggggagggtgtgtactttctctgccttctaggagagtattatataaataaagtgagaaaaagtttccccaagcggcaagcttttctccagggcacaatctattatacttgctgcaaaaatcccacttgactggtctttcagagaatagatcacttgcgtcattttgctcatttccaggtgaccttttgcagatatgagcaggcagttgtttttaaataaacattatctacaggtttctgtttctgcactaaggaaggaatgtttctgtaatgcagaagggatgctatgactgaggggtttgtgaagagtgaattctagccagtctcaaataattctgaaaaggtgcttttgtatatgtatatgtgtacttatgtatacatgcacattgtatataactacaaaaactaattccattatggacatatataggactttatacagacatagttatatgaatatatatagaaatacctatcaaactataaatacatttgagaaagcattcagggacagcagtgttaaaagcttttcatctgtgactggtttcacagaaattagtgacttccatttctgctaccatcacgctgttggtctgttcaccaggagggttgatttagacttctgccaggagactaggtgtggccatctctcaccctcttcctctctgtccagtctgctatcattgccttcagaaccaaattcttgcatgatacccagtacagcatagacctggaaaacatcggtcattttcaatataatgtaaaataggttctgtgtgcctttaaaactaaatgctttatttcttaaactgtaaaagacatgaaatgtctgagacattcagatagtgggaaatttcatctgcaagttgtcagattatgccctttagaagattgtaattttttttgttgtttatcattttctcttgaggggtggagtaaatatttctttcctgatgtttcaacttcagatgttcaggctaattttccactacagtgccaaaatagggaaaagttaggcctgtagaattttgacaatttaaatgttgttttaacaaaagccatgtcttgatgaaaagttctttagaattctacttgatgatctatgtgtgtctcttccgaggacaatgagaacttcttaaggaagtcatctatatgtgaaattgagtaatccttttattcattgttaaaagacaaatgaagttataatttggagagacataagccaaaaaatctatgtttgcatttttatgtcctaacatgtgaagcatgctttgatttactgtgaagtgttgcaatggcaataaagtagatgttgagacgtgcagactgggcagcccgaggaagcagttcttgcctctgcttcccctttatcatgaatgttccttaaacacctttggtggagtccaaatgtctggattatgaattgaattgtgcaagattctttttttaaacactttcctgatgatttactttacttgcagtttcttgtcttgcatggtgataagcaatatccttcaaagaactgcagcgcaggactttttttttttttttttcttttaggaagactacttccccttcctcctttagtcaatcaaattttaaaagattacttctttccattctcagttcaccctttctttgccattctggagactgaaattttggacacccatcacagatttgctattatatatataccgtgtatgtaatattaaatatatatatatatatacacacacgatgtttttatatatgtgtgtacataatgtatgcatacgtgtgtatgtgaaacctgtgtgtatatacatatattttaaattgtttatcaggatgatagattgctatttaggtcactatttttggaagaaataaatgactgttctttgtgtctgtactggagattgttcttcctgatataactttgaagaaaacttcttccagacattatacattaattcagaagataaaggcacaaaataatgtgtatattatttttttaaatgaacaagccagcatgcagagcataatgtgatcatgtgctcagtacgacactgaaaggccccaaaggcaaatgagtctagtgcctgttcccagccccaggagctgggcaggacggctcctattggtggcattgaaagctagcattcagccttctgccacaggacagtgtctcattcggccaagctgctgctggtccctgtaaggaatgagagtacagatcccgttgccaagtcctcatttttttggaccaggcagtgggtgttgagctgacctgagctacctttccatttgggttcagttgaacattgagtaggccagaggatagggaagttgtggcgggggccgtggaaaaggcagttgattcttcaactcgggcaaccctggcggagtggatgaggtggagctggccttcctggaattgttggaccgattttcctgttgtgtttcactgttgacgcactcacagacacacaggaccgctccagcactgcctgccacccaccgtctggtctcggtggcctgtctatcatttcgtgggtccccatcctctgcctacggcgatgtttcttcaaaaagaactagtgtgcagtccattggtgggtattcaaggtgatctctttgtcagaatctagagaggtgctcaaagaactattaaggaccaatgtactagttcctgtttttaacctgtttatcagtctttcaattgaacaaattggatttctgaaactgctgaggggttttctgcactattaggacagaacaggatagggtggttgttcctccaggaatctgggttgttcttttgcattgccatttgtctttgtgcttgtctgcttgtataaatgaacctcgagaaggagtgtttaagtattctgttaagtaaatttggaagactaggtttcaattaaaataaccagacagtgtgacccagcttccatttccccttaattttgatcattaaagccttcatatccccacagacatctgccatgcttcgaagtgattcttctcaggaatgttcattcattattaatcaggttgcatggtcaggcgagtatgtgattattttaaagaatgtcctagagatccagttactaagaatgagcatgttataggcagatgtgaaagtacagaaaagatttggttaacagtttaatttgatttgcatgaattccaccaggtgggtgtttggcgaaattaaaagtcttccctggttctcacttcagatatgaggtaaaaaaataataataataataataatttcagcacttcttaaagaagaaatgtcaagttattcaaaatatctattgtattaattattttaaaacttgaggctagcatctcagtgctcatctgcttgtcacttttttttttcaaacagtccctctggtcccctacaattttcttggcagaaattcttagttgtctgttactggttgagcaaatgaatttgagtgtgctgacatttggaggctaaatgcagtgataattcagagtaacattctttacctataaaatgttactggatcaccttttttcacctgttcttacttgatgtattatttatactgttgtttttaagaaccactttgcgtttgtactgaaacagcctacattatgctatcaatttccagtctttcagaatgcagttaaatccaactggatccccttctcccctttttccatcagttcatggccctgttttactgtgcctttgctaacccacctgcttctcaaattggccagagtgctaatcagtaaagtaacatttgggtagtgtctttattcggtggtctttatcactcaaagtcaaatactaaatggcataattgaatatgcagatgctgagtgcttgtattatgttattcaaaataccctatgatgaattcatcttggatgtagcagccagtttttattgagtttgtgttagacaagtttttgagttgagaaattatgcttatttaagatgagagcaagtcccttctgagttgggtccccgttgcaatctgcctcccaaactcaggttgatttccagtgtttcacacttcagtagttttgagtcctctgaaagtctgtatttctgctggtccaagatagaaacatcactctgcagtctttaaaaaatatttcacctatagttctataataaagataatctcatagcaaaaatccaaacagcaatagtcaactaaatctaattacccaggtgaataggggttaagaggagcggacaatcaagtaaattgacttgatttcgtttctgaaatttaggactctcaaataattcatttgtacattttcaatgctatttgttgtttgaaatacttataggagcttcctgttctgaaaccattttcgtgtggcttgctgtaacatcgtgcaattttaacagtgtgtttgtcatctcagttatgttttggtaaatttaacaataaagttagtctctatagtccagaggatatttggaaaagaactagaggaagtgccttgggaatcatctgggcagtggctgacagccacgtggtattaacgattaatcacaggccacccagtgttggcatacaagtttattccttggtctaatgactcactaatttccctggtagtgaaggctttagagttgtacaaagtgaggggctggaagtaaaattattgatagaattgatagaattgcatgttctttttcatatactccaaattagaaaaataattgtatttcatggagtatgcagacataacctagaatacttgtaggaaagcattgagaggtgggtttaccttatcattaaaaaggtcaatgcctccattaagggaaatttgggataaaaattatggatgatgtgctgatgatgggcgatctccttattctaatggatgctgtaacaagttagcacaaacctgatggtgttaaacaatgcaaattcattatcttacatttctagagtcaaaagtctgacacaggtctcactgggctaagagtaaggtatctttagggctgtattccttttgggggcccttggggagaattcatttccttgccttttccagcttctagcctgcattccttggcttgtggccccttcctccatcttcaaggccaggcatggctggtcgagtctttgtcatatctcatcattctgactctgactcttcttcctgccacttccacgtttaaagagccttgtgattcctttgggtccacctagatgatccatgctgctctccccatctcaaggtcagctacttagcaatcttaattatatcagcaacagtcagtcccctttgctctataacctaaaatattcacaagctctgaggaggaggctgtggatatctttggggaccataattgtgcctcccccaaagagggaggagtagaaactgtggtgtctgctgtctggtgaccaggaggacagaagccctgtgaggagacaccaggagccctgtagagaagacaaagacaggctaatgagggaagaggataaatcccacatcatgtgcattccaagtctgaggcacttgcagtacatgaagcaaagaactgtcagtgctaaaccgggttccagaaaggggttctcgaccatcttgggatacaagcctagcagtcattctcagagaggcagtacatgaaacaaacaaaaaactggatggccctgtcaaaggaaccatagaccatcagaaaacacttaggctttgattagcaagaggtagaagtcagcagtggttagacagaggaaaactaggaaagtacagtttcagtgacatacagtgatgtggtttgtttgtccccaccaaaactcatgttgaaatgtaatccccaatgtggtggcattgggaggaggggcctagtgggagatgtctgggtcatggggatggatccttcacaaatcgcttgatgcccttcttgaggtagtcagttcttgctctcatggagactagattggttctcacaggagtggattagttcccatgagaatggagttgttataaagcaaagttccttctcttgagcagatgccagtaccatgcttcttgtacttcccagcctgtggagccacgagctaaataaacctcttttgtttataaatcgcccagcctcaggtattctgttatagcaacacaaaatggactaagatacatattatgagagaggaaaggaaaggaagaagagggaggtgtgaaaacatttacatcattattttccagcaaaacatctacttattaattttccattttaaagaagtactttcctcataagtcttgaatctataagaaagttttttcaaaagatgtatccaatgcctcccacgatgtggggcttcactgtaatctgtcactgaagactctcctgcctaggggagtgattagagtgagtgctagagggactgtagggaacatctgtggacactcacccatggatactcagacagctaataagtagcagaactgcaggatgtcttagattatcccgtcacctgtccagctctctcccctttcattcattattctgtgctgtgttctagatgtttaaaccatggacaggcagaggtgtgagctgtgatttgttgccattcccagtttgttgcaagggactctcaagattatctagatcctcttctcaatgaggaccaatctgcccattcacaaaaatgttaagctataggatttcctgacaacaatatgcatgtgtgatttccttttattgaagtagaaatgaagaagtttttttttttttttgaggcatggaaattacattatgacagttaagaaaaggcaaaagctgctgttttatgatattggggtttttgttgttgttgtttgtttgttttgagacagagtcttgctctgttgcccaggctggagtgcagtggcatgatttcagctcactgcaacctctgcctcctgggttcaagtgattctcctgcctcagcctcccgagtagatggaatcacaggcgcacgccaccacacccagctaattttttgtatttttagtagagacggggtttcaccacgttagccaggctggtctcgaactcctgacctcaagcgattcacccaccttggcctcccaaagtgctgggattacaggtgtgagccaccatgcccggcctgatactgttattaatgatataaataacaatgtaagctatatatatatgtgtgtgtgtgtgtgtgtgtgtgtgtgtgtgtattagatacatatatatatagagagagagagagaaagagagagagaaagggagagagaaagagagagagagagagagagagagtgaaaagaaagataacattttgcataaaattcccacccatgtaccactatctgcttggtgaatccctgttcatcttttaaaacccacttcatactttacctccttcaggaagcttctccctgtctcctctccccctatatagagttgattattccctgtctgtctttggcatgcatctttttttatgttgcattacaccttgttcatttttttttctcgatatgggctcactctgttgcccaggctgtagtgcattggcatgatcacggttcattgcagcctcagcctcccaagtatctgggaccacaggcatgtgccaccactcctggctaatttttttatttttattttttggtagagatagggtctcactatgttgcccaggctggtctcaaactcctgggatcaagtgattatcccacttcagcctcccaaagtgctgggattacaggcatgagccaccacacctggccttgttcatattttctctctcggaatgaaccataagatcatggagacaggggccagctgttaccagtacttgtctcaggaccaagtacatagatgaacttaagtatttggtgaaagaatgaatggcaaaaaaaaaaaaaaaaggaatgaatggcattttaatttctccaaaaagatattttaaagaaagctagaaaataaaccatactaagtttcttttagaagaaggaatggaatgagtacaaataagatactgtagagtcatttaacaaaaatgctatctatgccattgtaaaatctgggtaaaagtggaaaaagtgggatgcactatagatatcaaaccaaaaccccttcctttttggtagcatacaggcaaaagatttagaaaattggctgaaattcacctaccacatctgagtattgtgtcttcacctaatacaattaaccatttacagtacagacacttgcataaagcactatgccaggtgctatggcagtaaaagaaaatatctagttttgagcagctactattaattcgttcttacatgagttgcccctaagcactcgagtcacataatttccattgatgtcagattcaaagcccattgcatatcatttcccattagcactggaaacttgtaagtgcttgttcaagtcttgctccgccatccttgctgctgttgcccacacagcattttattcatacctctctgagaatgattttcatttatgttctggttatctgtatatgcctctatcttccaatacatggctcaacaaaataagatgtgcaggccaatgctggcctgtgacctgtttttctaaatatggttatgttggaacacagccatactcattcctttatgtattgtgtctgattgcttttgcactacagtggtagattgagtagttgcaacagggcccctttggcccacaaagccaaaaatgtctactattttaccctttatagaaaaagtttgttgacctctgttcaaatatattgagagatccttaaagtcaagggctgtgtttgattctttttggttttagctgaaaagtcagtacatttaatggaatcaatgaatgtttgagtcattttgtgtgctgagtgctgttctaggtgttggtggtacgttcttcaaagagcaaagcaaaatctctgctttcacagagcttatattctagtgttgaggacagtggggacagaaggagcaataaacaaactaaaagaatatgtcagtgataaatattataaagaaaaataaaccgagatgggggaagaattaccacgatgggtaggtggtatagtggtagaaggggaattggttttatgtgggttcagagagaaagtgacactggagcagagagtcatgtggattctgaagaccttgcaggggcgagcaggggattgatgtgcttggcatgtttgaggagtcagaacgaggccatgtgctcagagcagagaaaggagtgggtagcgtgggaggaagtgagctcactgtctgagtctgtgttttctggggctggtttattctggtgaatttctctctgggtgaaatgggaagcccttacagggcagagcaaaaggagatgcatgttctgtcatgttttaacaacaggctctcttgcttctgagtggaggatagactatagggggaagggcaggagtgaacagaagccaagagaccatttagaaaggtcttatgatagtccacataagagatgatgctggcttggcccatgataatagagatgaggtgatgtgaaccccagattctggcttcttcatctaactcagtgcctggcacacagtaaacatctgttgaaggaatgaataaaatgtcagtatttccactgaggtctccccagtggaatcctttctagaaattctcatcacacctctctgggatggaatcctggcacctgcattaaaaatatagtcatcatagctctccagacataatttgatgctcatccttctattcagattcattggtaggcattcttgttttatctgagaacagagcagaccaaaagggctacatttttcctttaatttatatgcttctgatgagaaggtaaaagaactttgatttaaagataattctacattttttctatgattaaccaaaataattattaataggtaaaaacctttccatttcttctgagccatctgtaggaagaggtgacagaccaagtggggatgatatgtttcttacaacagcaaccctagggtttccattgcaggttgtagaaagatgtacaagctttaatatttcaagtcacagttgctcttttattctttcctatataataaatgctagtgaatggttgaagattttttaagataccaggcttttatgaagccagtagctgtttaatttttaacaggctcgggacatactttatacttttaatgatcagttaccattcagttggtagcaagatgagcattaatttcaccaaagcaccatattggtatttctgagggatgctatttcagaaggggtcagggtattctagaaaccgtgaattttgtaaataagcggaggtgtgaatacaaacgattgattgtcagaatcactaaacatagctttggatgtgaagccttcccataaatccggctgagaacgctctccccaccacccccgtgggtgatttgaacctcccgaccactgggtgaactgcactgttctcccacagcctgcaatgggctgcatgtaatattcccatcactggtctgcagacctctgctaatggtcttgaaagggagaaggttcaaagcggcttggttcccaggcctgctaatgagcatgaggcctcttcacccttaatgaactggggtttgtgtggaattctttctactactctttttgatgggaaggcagatgagagttcacaaaagcactcaggtctttatggcaaggggagcaggcagctgggccaccctcgggtggcctggaggagagcaacatagctagcagaggtcgtacccaggccaacatagctctgagtgtgaggctggacctcctgccagcctggcctgttgctggcaacagtgacaagcccgtggtgggagttttttggccaaaagggtccctcagcagttttgtaagcctccttaaattgctttctcaactgtaatcattatcattgtcataacataacttatcacatgaatatgatgaccactgaaatccttgttctaattaactaaatcattgctctaaatattagtcattggtactcaaacttactgcagccactgaaaaagcccccagatatttttctccacttcgttctgcctacccacgtcccactgctggattaaacaatagaattattcagaaacataatgaacacatgccaaaaatattgcctctatcacaatcatctttgtgaaagtcaatgttttttctcaggaatatattttggaaaatgacatcccacacttaaacacgatcatctctgctgaaatccccacatttgatttcatgtacatttcatgcccatttctatagttactgccttcctattgttctgaaacctggtttggtattgcagagtaaaagtccttaaatctcgtatacattaatacgtaagtttataaattcaaatttataaaagactctagtttattgatgaatatttctacattttaattttctgtgcgaggttaaacctgactctgacacaataagattattctgattaaatacaaattatggaaattacagtttcaattacattctagttttgaatgaagccttttaaaaaacaaaattgaaaaaaaaaattgcacattttcagttactgaactttgagaaaatgttaactggtatatgatggctcaggatgctttttcctccttttttccccagtgaatagaaagagaattatttggaatgtacacacacttaccctttcatgacctgtgtttggaattattctgagatgcattcaaagctgacacccccctatggttgacctccctgtgcctaatcaaatcttacattcttgtttccagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaaggttagtccgatccgccttaagccaacccctttctgccagaaaatgtcatggaaataaaaagtgtattcactgctagctacatggcaggtgaaggttttctcctcacctttgttatctgattagttttagcatgtttttggcaacctataaatgttacacaataagggtatcttgtaaaagttgactgctgcttgtaattttagcgttgtcaaggtgagggcaaattctaaaaatctggatcattttcaatccatgcagtttttctggatcattttcaatccttacagttcttccaaagagagtgctgcctctctctgagagagagggagagagagagagagagagagagagagagggagagagagggagagagagggagagagagagagaatgacagataaaatctggctttgggcatttggggaacacttacttttctcactcatctgggaaaactaattcactctcattgtacctgtatctagttactgcacaaacaaaagaatagagggaagaatgtctgtagcaaatgtgggattttagaggacacgtgaccttttattccttgtataaacgatatccagcttattggtgaaattcagtgctctgacaatctcaggtttcacgaaagaattccttttcgtgtaggctctttattcagtaaggttacagtcaagactatttgaacttcattttttacatgaaattattaacctaactccagcttgggggataatgattaatatgactatatgtgaaataaaaggatcactttctaggcagggcgtggtggctcatgcctgtaatcccagcactttgggaggccgaggagagtgaatcacttgaggtcagcagttcaaaaccatcctggccaacatggtggaaccccatctctactaaaaataaaaaaattagccgggtgtggtggtgggtgcctgtaatcccagctactcgggaggctgaggcaggagaatcacttgaccctggggggtggatgttgcagtgacccaagatcgcgccactgcgctccagcctgggtgaaagagcgagactctctctcaaaaaaaaaaaaaaaaaaaatcactctctaagtatggatagaaagcactagggaagaaataataagccaagtctccacatgtttgttcaatttcaggcaacagtgggtctaattattgaaaactcagctgagagagtttgagtgagatactatgttcatcagctaattttagatcacaagacaccaattaaaagaaaggaagtataaattaaaagctctaagtaaatatatattgaagtccttcctctcaggaaaaacacataccatgttgttgagcaaacaaaatgaatcacatgatcaaaagagtgttatcacttagaaaacagtgtcacctttaacaaatggtttctatcacctctccttagcgctaatgggtggttgtgtttactgggaccacatagtttattctgtgacagtgggattaacggaccacatctgggatttggctttgctatttcttgacatgttgagggaagccgacatgctgaagtcaattcctgcttctcaatgtcacttgggcaacaaaagcatcacctgggcagcatgtttcacttcaagtatccaaagaattactggtgcaaatccatctttaaaccatgtagaggaagtcaagcacaaggactcaggtgacacagacaacagaagacagccgctgacaggctttccagaacagtgcatggcagcacaggagaaaagtaccaccaaagttaatcatagcaaaggcaatgcatgtatgagctgtgcctctagagcaaattctgaagaaattgcgaaggctattaatttttacaaaccaaggtaatctttttttttttttttttttttaccccttttttggttggtggtggagctgaagggagaatatttaggataactgaacagagatgtttgatttttgttttccaaaatgtaaacatgccagatctttgtttctttattaaaaatgttcctttgattggatttgcactaccttttaatgattgtttgttaaaacaccacaatcataatgatgttcaatatttaacaactcccaggcttgatatttatttaaatcttgtggtcaggttctgctcaagtactcatggcctgtcacagcagagttattaaatatttacataacatctccaaatttatgaagaattcctgtcatgctctagccctctttgtgataaaaacaaaactcttcagttacgagccctgcacactttaattgagccagtggcctatcggttgttctactgtcacatggagggcctgacaattaatgatgtggtttctttttatttcctagttacagaaatataagcatataaacagcatccaatgcaccgaaacacatttacagccgttcaataagatgtacttatgagcatttgaacaaataacttatcgacatagcatgtttgttttaaaacatgccacttacgttagaattttaaaaataataattatgacatttggatgtctgatatttcagttatcgcatacttatgaacatatgtacatccttgttttatttaaaacctaagcacaatataaatgttgatttttttgaaggaagtaatagcataccaagaggaccaaaaccaaggaagtatatttctgttaattactactttggtctgaaatgtgctctgaacatgcatttttctgtagctctaggatctcatatagatgtggatttgtgatgatgtgagaacacagataaagcatggaggaatttgaggatgctttcattgataagacaatagatttgctttattaatttgcatatgtaaggaccctggtgtctttggaaacatttttgtccttctgttagtaaaagtttattacctgaagaagggaattctgcaattattatgaagaataatttcttgcaataatactaaactttgggggacatattttactcattagatctcagtataagagatgtttgtttatacaaaaaatcagaatatcattttgtacattacaatctttttctaagtgtaaaagaaaaagagataaaaattctaacatgttgaactcgtacaaataaaatcatccacatcatgtaaaatagcatcatgtcagtaatctaacgctttcggagactatgcattgagaggcactcatgaaatattgaagcaaagagaaaattaaggtagcatttcctgaactctactaagataaaaagagaaaagttttcctgccaagtgcaaaggtctctaagtggagcgtatccataatgtggatatttctttacatcgttttaattgaattttaagaagcctctcagtccttcaaacttggaggaaaaatttgatttgtgaaccacataacatataagagaatttaatataattaatgcattccagagttttcaaggaattaaaatgcagtagtcctctttttctgttccaacatacaaggttggagctcttgtttcttttctctaattatacctataaaaatatacaaattgaaaaaaactgacctttccttgcctttcagtttcagcatagccccttcaaattagctgaagctgaagttccaaactattgttttgctattcttattctaaaggctggctgaggaagtttgtttgtataatgcatgtttcaacggatcatcccattgtaattttttaatagtttgatttaaaagttcaaattaaagctcagcatttctatgtagcactttttatctggaagtgaagacatgagatttcattcttgggtttaatttatagattgtaaggttctatgtttgaaaaatctttcccagtttgcaactaggaaagttgtaagtgtatactgagctagacttctttttattataatttctataacttgtttcttctttgaaaaccagtagcaggcatagtgcaggttctagtgctatggtgtgtgatgcacacacatacttgcatatacatatacatacatgcatttatttatttatttaatattataatcttcctgaatctaagttggagacaaattcaagtgaccagtattttcattagggatatttcattctgcaggcaagagatgacaacaaacatagcaataataactatattcccatcactcaaaatattttacctgttccttgaatgtttggtagatggatacaagtcaactttggacttggtatattttttgtgggaagagtcttatcttgaaggggtttttttttgaagttacaaatatgtgtattttttaaaatgtgtctttctgtttattggtttctagtttaaatcccttaagatcagggctcaagacaattgcatatggtctcacttatggatgcagtatgctttaagaaatattagaataagtttattgtatcttcaaaatttccatgagctcattaatgttttcagtctgtgtaatcaattaatgactaggagaggtgcacttaggccttccactcagagagtgaaattttcttttttttttttttttttttactttaagttctgggacacatgtgcagatttattacataagtatacatgtgccatgatggtttgctgcacctatcaacccatcatctaggttttacaccccacatgcattaggtatttgtcctaatgctctcccccgctcgccccacaaccctgacaggccccagtgtgtgatgttcccctccctgtgtccatgtgttctcattgttcaacttccacttatgagagagatcatgcggtgtttggttttctgtttctgtgttactttgctgagaatgatgggttccagcttcgtccgtgtccttgcaaaggacatgaattcattctttttcaggcctgcatagtattacatggtgtatatgtgccacattttctttatccagtctatcattggtgggcatttgggttggttccaagtctttgctattgtaaatagtactgcaataaacatatgtgtgcatgtgtctttatagcagaatgctctataatcctttgggtatctacccggtaatgggattgctggatcaaatggtatttctggttctagatttttgaggaattgccacactgtcttccacaatggttgaactaatttacaaccaccaacagtgtaaaaacattcctatttctccacagcctcgccagcatctgttgtttcctgactttttaataatcgccattctaactggcttgagatggtatctcattgtggttttgatttgcattttcctaatgaccagtgatgatgagctttttttcttcatatgtttgttggctgcataaatgtcttcttttgagaagtgtctgttcatatcctttgcccactttttgatggggttgtttgattttttcttgtaaatttgtttaagttctttgtagattctggatattagccctttgtcagatgggtagattgtaaaatttttctcccattctgtaggttgtctgttcactctgatggtagtttcttttgctgtgcagaagctctttagtttaattagatcccatttgtcaattttggcttttgttgccattgcttttggtgttttagtcatgagatccttgcccatgcctatgtcctgaatggtattgcctaggttttcttctagggtttttatggtttggggttttacatttaagtctttaatccatcgtgagttaatttttgtataagatgtaatgaaggggttcagtttctgttttctgcatatggctagccagttttcccaacaccatttattaaatagggaatcctttctccattgcttgtttttgtcaggtttgtcaaagatcagatggttgtagatgtgtggtgttatttccaaggtctctgttctgttccattggtctatatatctgttttggtaccagtaccctgctgtttttggttactgtagcctcgtatagtttgaagtcaggtagtgtgatgcctccagctttgttcgatttgcttaggattgtcttggctatatgggctcttttttggttccacgttaaatttaaagtagcttttctaattctgtgaagaaagtcaatggtagcttgatggggatagcattgaatctataaattactttgggcagtatggccattttcacgatactgattcttctatccatgagcatggattttttttccatttgtttgtgtcctctcttatttccttgagcagttgtttgtagttctccttgaagaggtccttcacgtcccttgtaagttgtattcctaggtattttattctctttgtagcaattgtgaatgggagttcactcatgatttggctctctgcttgtcgattattggtatataggaatgctcatgatttttgtacattgattttgtatcctgagactttgctgaagttgcttatcagcttaaggagctttggggccgagatgatggggttttctaaatatacagtcatgtcatatgcaaatagaaactatttgacttcctctctcctattcgaatacccatcatttctttctcttgcctgattgccctggccagaatttccaatactgtgttgaataggagtggtgagagagggcatccttgtcttgtgccagttttcaaagggaatgcttctagcttttttttgccgagagtgaaattttcaagtcctcttcatagttctgtcattttgcttgctttaggccttttgaacctatgttattaagaacgatatggctgggcatgggggctcacacctgtaatcccagcactttgggaggccaaaaaggagcattgcttgagcttggtcgtttgagaccagcttggacaacatagcaagaccctgtctctactaaaaataaaaataaaaattcaactgggtatggtggcatgtacctgtggttccagttactctggaggctgaggtgagaggatcattgagcctgggagatcagggctgcagtgagcagtgattacaccactatgctccaacctgggtgacagagcaagaccctgtctcaaaagaaaaaaaaaaaaacccacaatgaaagttaatataggttttttgagaggtcataaaaaattaatatgtgtttaattaattaaggtaatatgaacagtaacagtccctgccttcatggagcttatagtctagtagggcattccaacagctactaaatactttctctgttgatggtggcaggaagcacattgtgcccaaagcaaaggtactgaccccagtcctgagagatggagaaaggcttcccagaaaagggatcactgcacctaccatttccaagccttgtattagaaaacaatattgaatttactagatgtctgtaaaatccctgttatcagttattcctttttaactttttaccacgtatgatgttctttgtgtaaccctatatagtttttcaaacttgttcacagtaattcccagttgattttaatctaaaatacagacagactatatgatgtttcaccatgtggtatgtgaataactcagacacatgtcttctaaaatgttgtaattttatggagtttcaccagttccaactgactccaatatgcaattctgtttgtactaattttatggcagcatttgtttagtctgcaatatagatatgtatttttttccttttatctttagttggacacttaataattgcacatatttatgagatatagtctgatatttccaaacgtgtatacaatgtgttgaaatgtatattttttaatagtttccatgtgattaaaataagatttccaaatatttgtaaaatgtattaaaactatattttaattttgttagtttggtacaaggatatttatgatagatggaataaaagaaagcatctccaggcatatgttcttaatgggaaactcaaggcagcttccttttcctcctcctcacctgtctattttctggatgagtcctctctcaactccttcacctgcagagagcaatgtattattgcctagtgatttattattgttggaatcattcttggtaagctcagagagttcgaaaaatgcacaaacaagtacacatggtacctcttcatcatgtggctgtgtaaacgtaattcttgggcaccttgttaacgttcttgtgctatattttactcgtctataaaacagggctaatgtatagtacttactttcacagaaaattgggagagcaaaataaagtgtttcatgtgccttagcattgtgcctggcctacagaaagcctgcaacacatgtcagaacgactgttagaaactaggaggcagaatgtgtaatggttaagtgtatggacattggatgtagactgactgccaaatattttttaaccactgtcttgtattatgtgtatgtgagataagagtatatattgttgctttaatgtgttttgtagttttgtttctaaagcacctgccaaagggcagagacgtgacaattaataaacacttgttgatggacatgtgcagaattgatgcattagacgagtgttttgggattcggaggaggaagagatgaatctgcttttgagtagacaataaaccttgcttcagggtggtgggatttaagctgctttgacagatctgtggattatgcatcaaagaagagtgaggtgctctgcaggagtgagaccagcagagacctgtcggtaggaataggcaagacagctttggaattttagacaatcctaactagagcacagggtgccaaatggggagccaggaaagaggatgttggaagagtcacctggagggaaggtcttgaaagtctttaaatgcaaggttaagggtttaggccatttttaccattttctatagagtaatagtgaagtgttttttttttttttttaagagagagaggttaatgtatattttctgaaataaatttcatgtgagaatataagaatggatagggttactgtgttcatggaagaaataaaagggggaagagacattcacattactttagattttgtggtctctcttttaattggcagaaagaagtagtatcacaggtcaaaaaccaccaccctgtcaacagaaacatgtaaaattgtgagattcaaggtcctgccccttaaaactaggaagaaataggagatgtcgttgctgattggctcttaggtacagacacaaatgtgattcttttcctgcttttctagtgcagtaagacacagtggggacaatgcatggttatttcttctggctttttgattcacaataaggagaatgctgttcaaacctccgaatgcccactataaaccaaaataatgttttagagccagaagcaaccttggagctcatgtcattccatcctcattctgcagatgaggaaagtagggctgagagtagtaaaagaagttttccgcaatgacctagtgggttagtgactctgaactaggactagagcacagttcccagctgtccagttttgtgtctttcctgctacttcctacagcggttaacagtgccagccagcacaggcaggattgccttttgagtggttctgaaatttctgaggtctcttctgaggttttcaggagtaaacacaatgattttacggtaatttttaaacgcctgcttggcctggcaataaaccagcatcatgggtgtaggatgatgccttaccatgctgtctgggaattattgcagagatgtggctttgcaatgatgcctccagggccaccaaaataagttgcctagaagatgcccccatgctgacattttctatagctgagccagtgtagatttggccatcttgaagggccagacttcatgcctggagctgtgttcatgtacatggacccagacaacctcggggacactgcaaaagaaagcagagttaggacagtgatgtcaatgaggaaacaaaggaattgtggttgcaacttaatgggctcactaattcccttcttaggattattgttttcctgaatgtcttaatatatagattattcttagactggtaaattttttgacattgccataaagtgggcatgagtagtctgagaaactgaatgtggctaaagatttaatttattttcagtatgtggcataaacattctggaaaaatctgatacaaatgcaattgtaaaaatccatttaaaacttaatcactttatattctggacttttgggtatgacacaacgttgttgcgtacccatgaggtatggactttaagctgacaaaggaaaacacattttgcatgtcgcatcaaaaaggaaaatgcttgtaaagtgccgagcatggtgactggcacatagtaagtgttggatgtacacgaggtattattttatctgggcatttactgttacaataaaaccttcattggtgtaatccaatggtggatttcttgacagtatcataaattactcagtggttatagggttgatatgtgtttctggctgacatgggaaactttgaacaactctcaagggaattataattgggtggaaactttgatttgtcctttctaaaccaagctaagtagtgaaatggacttttaagaagcagtgagtggtgaattgaaagaaatggctttaaaaacaaggcccaatttgaagtctggggatgcgggtggcaggggtggaggggagcggctctttcatgtttctggttaatctgattggatcagcaccacaggtgccatcagagcacctacagctgtttccaagaaaagaaaagctggcattggtttatactatggctgtcacatttatacacatctagacagatgaggaaaagatgggtgacatgatacacagtaagcctagactagtcagacgagctcagggggctagctttctttttttttttttgtagggttgcctttggtatgtgagtaaatgatgaagcaagttggccctgggctgtgtgttagcagctgtctctcttagaataggaagaggaaggaacttcggtatcgactggggctggaggaggaggaaagcgctgaagtgaaggagctgtacaagaaggcagcttccaactcctccactgtaggggccctggggtgttttgttctctgtgctctcttctgtgccagttgtgcagggtgcctagaatagcggtatcatcgtctgcctcctcccttatatctcttttgctatttattgagggggaaaatccggaaaatatggtttttatttttatttacattgggatagactaggttcttattactgaaacaatatggaaatcatgagcagcttctattccttttgtgcctttataaatattcttttccctatctgctttatcagatcctgcttttaaaaaaaaaagaaagaaaaaaccttatttgtttactcagggaatattttatgtagctactatgagataaacactgagtaaattctgggaatgcagaaatgaaaaacaaagataagtcgttgcttccatggtctagagctcattataacatgtaataagaatatatagacaggatatgaaaagagctccatggagctcaatcaatgagataatttttaatgtgaataataataaaaaaccactgacttcggtgttgatatctggaaattgcctaattccaaaagctgaagtaaaaatacatttcaataaaaagcaacatttacagagaacagtgacattcagtcatttggaattgcaaattccactgttcagtcatttggaattgcaagtaagggcaaaatatgaagactccaatccatgaaaaaagccggctggatgctttcttatgaaaggtctactgttcgcgggctggactgctagcccttctcacgtgctttcctcagaggtctccatttccttcctgaacagggctaataggtcagataaatatccaggctcacaagcagtttatgtcatttccactctgaaaggatccatccctaggaagatattatgggagcaaacttgcggaagtgctattgtgttaaccaagccagctggtgggtttgctttatctgttatggaatttttaccaacttaggtgttaggatgaatatcctgacctggtagagtgtttatttcccccttctttgacccttgacacagctgtttagagctcagtcactcttggttgacatggtcagattcaaagccaagaagagtgaaatgggcaggcttttagactcacacactgagtatggcctgtgtgagtgagtctgaaagatctaggagacatggggaagccgtatgcacttcacttaaggagcttggagggagatgctatttttgcctctggattgctgatttaagctctagagggtcccagcaaacaagggcctcacttatttatagtgtccagcttgttaactggttccagtagctctttcattctaaataccctgacttgatcattacagattctatgcatgtaacaaaatatcacatgtaccccataaatatgtacaaatattatgtatcaataaaacgttcatctgataacatattaggcaaggccatagggctgcttccatacctctagaaaactgcctcgtaggtcagggctgagtggtagtacaggaaggtggagtaatctgtcaagatgctgctttaagttgttttgagatgtggttcaagggtgtttgttgatcaaacaccaagagctagctattaccaagaataataactagcatttgtaaatctccagattgacagtttgcaaagcactttcaagtattatttgatccttggaacaaccacgtatctcctgcaaaaatatgggaatgataatacctgctcattagggatcttgggaggattaaatgagataatataggtccaagtgtctagcctagcatttagtgggtgggagcagctgggtaaataggaaccatctttaacaatgcagaacatgaggccatggaaaattcaaaagcataactgtagtcagatgactacgttttggagctcagacccagggaccccattttgcccttgactaatcgtcacctatgattaaagcagaaacaactatggtccaaacataccacccttaaaaaattagcgagaaagaaagagagagagtttgagtatggagagagcaagtatttttgccttcacttttgacacacaggctccctggactgagcaaagaagttccctttgaagtggtgactatgattgaggatgagctagtttccactctaatataaataaagaagtaaaaatacaaagttgaaatatggaaatccatatggaatcattttatttacttacagcaatattgaattatccaatactcaatagtttctctgtacctaagtgttaacataaatgaatgaatctctgatgatccctaaaatcatttcatcacttgaaatgtgattatttacttaccctggctaaaaatgtaaatttatagtcttggtctatgagttcaacatttcaaatttcttaagagaccaaaacgagttaatattcatatttagttattcatgccaaagcgtggatacatataaaaatgatcaccatgtgttagtcaataataaaactttttgatctgttatccattcctctttctaggatcgctaatcagtcagaattgtagatttaaattggtttctaaaacaaagatatctcaaacatggttgtgcacaaagccactcagggttcatacgtatatatatgtgtgtgtgtatacatatatatatatattttttttatttctttttttttttttagatagagtctcgctgcatagcccaggctggagtccagtggcgtgatctcggctcactgcaacctccacctcctgcattcaagcaattctcctgcctcaggctcccgagtagctgggattacaggcatgcgccaccacgcccggctaatttttgtatttttagtagagacggggtttcgccaggttggccaggctgatctcgaactcctgacatcaggtgatctgcccgcctaggcctccaaaagtactgggattacatcatgagccaccatttataagattcagcagatctgagacaggtttagagtctgatttcaacttgtgtcctggcgttgccattttagaattgtgcgaacttaagggaaaaaaaacaaaactaacttttcaagcctcaattcctcatcagtaaaacagaggtaataattcagtaataactccataatgcttgtcccctaggaagccctggacaaaggatagtggttcctctttccatcactattgttattccttgaatgcctctatctttaccccgttattctaaattttaagccttttctgtagttatatggacaatgcagttggccctccatatttgtgggttctgcatctgaggattcaaccaatcgtaaatcaaaaatatttgaaaaaaaaacaattaaaaaagataaaaacacaaataaaaaagtataacgactatttattgtattattaattattaataattattgtattattataagtaacctagagatgatttaaagtattgcaggatatgggtaggttatatgcaaatattataccattttatatcagagagttgagcatccatggatttttggtatctgtaggagggtcttgaaaccaatcccctgtagatattgaggaatgactgtatatgttcttatacaaagtcaaacaatacagtttatgtaagtgaatcctcagtccttccagctcttcctctaccaactcttgattattcttaaaggatcaactcaaatctcatggaggactactctaatttaacttttaataaaattatctgatctccgacattccctattttttttttttttaccactccttcataattgcatgctgtttgtgtattatttcatattctttgggccggattcacaaaggataggataaagtaataccatgtacagtggcttacgtttgtaatcccagaactttgggaggctgaggcaggagaatcgcttgagcccaggagttcaacaccagcctgggcaacatagtgaaaccttgtctctacaaaaaaataaaaataaaaaaaaattccaggcatgatggcacacgcctatggtcccagttactctggaagctgaagcaggaggattgcttgagcccagagttggaggctacagtgagccgtgatcacaccactacactccagcctgaatgacagagaaagaccctgtctctaaaacgttaaaaatgtaaaaataaacctactttgggcataagtcttccctccccaatagtgtttcaatttctcaagcccagtggctgtattttgtgttcttttatatctgattactcatttttcaacaataagagcattctgaaaagctacaaggtattttatcagtagtaaatagttgttgaaaccagttgaaaaaggctgtaatgatttaattagattacagtctgtattgtgtaggtagaagttgcccatcagattaaaaaaaaaggaaaatcctagcccaccagccattctttcaaattttaaatacatagtcaagcaaaataatgcctttcaggtctctgcacacctttctgaatctacaagtttcttctcaatgatttctttcaagaaagtcttataaagagaccatttgaatttttaaaactttaattcaggcagcagtgatcaaatatttgtgattcacaaaggataggataaaataataccatgtacatatacaatcggccctccgtatctgtggatttcacatctgtgtattctaccacccgaggactgaaaatattcaaaaacaataaatggttacatttgtttgtactgaacatgtatagacttttaaaaaatctctaaacaatacaatgtaacaactatttactaagcttttacattgtattaggtattataattaatctagagataaagtatatgggaggatatacataggttatatgcaaatactatgccattttatataagggacctgagcatctgtggattttggtattcataggggtcctggaacgaatcccctacaggtacctcgggacgactgtatatattttgtgtgtgtgtattttcttccctattgcctcagaatagagtttaattccactttgagacaggatggtaaggtatcatgaggaccatagggtaaacttagcaatatacaattgcttagttttcgaaacttgggagaggaaggggctgccactggcgcacaatgggtcaaggccacggatgctgctaaacatcctgaatgcacagaacagccccccagacagatagtcatccagccccaaatgtcattggtgccaaagcggagataccctgagtcgaagcaaagcatctttgttaatgacataagagaaatgctcagttttactcttacagacatttacttgtttgtgtgacccctaaaccaaatctactttgagatgtagagagctgagacattgcagaactcccctcccgccatctgcagatgccctgagtggcagcctggcagcctggcagcctggaagcagccccagagttctttgcacagcgggcttctctcacccatgcccccagcccaactctgagcagtctgggcccgcacatgccagccttcaggctgtttcaacagtatttaaacctccaaaggcttatgaaatattctttaatcccttcccaaaacatgatttaggtgtatttgatattatctgctatcccctagatttcctagtgtttgcagcttattttcaggactaccttccaggtgtagccgtctgtgtcagagacaggagagcctgaggctttcctccaagtggggagtctgcagagaacaggctggcagctgagactttcgcccaaatggcttatatttgatgtataatagttttaattgtgatattattaaaagtgaattatttccatagatcaaaagttaactcattaaatctgttagtctattttaagttggtcttccaaaggaaccatttatatttatatagcattgcgtctttatccttgcaaaactgtggattctaaactcctcaagtcagagacttggaatagcataaatcagatgtgagtcttcattgctgaggctgaatttattcagtcataatttccaagcatttgttcctgctggaaggtactacttatttcacaagaagttcatgtcatgaaagcgctgagctcgaagggccatcacgcatatctagtccagtggttctcaacctggctgcacagggattaccttgggcagaagcccagcccaatgggacaagatcttctggggtgcagctcaggcattggggtttccccaaaactaccccaagtgattctaatgtgcaaacttggtggaaaaagtttattcttttccaattcctcagttacaatgagtaaactgagggtcagattaattcataaaggcagaagtcagcaaacaccgtaaaggactagctactaaatctttctggcattgcaggccatatggtttctgtgggaactgctcaaaagcagccataggcaattcagaaacaaatggatgtggcaggctgccaatgaagctctataaaaataggtgactggccggatttggcccatgggccatagtttgccaacctctggtttagatctcacagttggttagtagaaacccatatgctaggccacagatagactaaccttcaacaagtgatcttccttctactagatgcagttttcctgtttgaagcagtgtctataacatacccaacttctgtagaggttaaataataattatctttatgtaagttaaggcaaatatcttagcataggtactcatagtctagagcgcagaaattttcattatctgtgtctttatgagaggtctgcattttgatggtatttaccaaatttaaagtaataatcacagtatatgtgttttactaaagtaataacccagacaataatattcctatccaagaaattttttcagctagaaagtcagaaaatgagacagcgtgatcagaccaccaaagcaagcaagaaaaaaaaatcagctaagaaaaatggagatctgattttcttttcacccagtaaaggaatcagttgaaaatctcttaattcttccttactgtgctgatgactcatggggagatactttatctcagatttcttttgaatacatctgagtaaatttgaatatgaattatatctaatagctagagatgcttcctacgagtccttgggaaacagcatggactaaggctgaagaagtggaaagaaagccatcacaattaatgtggagagttatgtgtttggtacttatgaaactttgggtatttttcactgtttgtatagcctttcttccaaagtacactcataaaaatagggttcctgaaatgttaaaaagccactggatctggtcattttccttggagattaatttatctctatttggcaattacttcgtatctatgtttttcagagaaagtcactctacctcttcccttttttatctaaataacacattcaataaaagtgcttcatgtcctgaaaaaacaaaactgtcttatttacgattataaaatggtgttcaatcaatgatttccctgaggggataaacactagagatggaaaaacaaaatcaatttgtttttcacaaattgacatccctctgtatgatgccatcattgaactgaagttattgaaaggggccttatagagagggcaccatagagggaaatcatagagaataacatcatagagaggggtatcatagagataataactgcatggagaggagcctcatggagagggagctttgagaggggacatggaacacacagtggtagattaaaataatccagtaatcaatttggccacataaataatagtgatcataatttatgagggcttcccatactaattaaaatatgcataataacaacagttcattttcataattgtacacttaagtcatgctattttttctctttttgcctagttctatggtatgtgtgatcatggccttacaacttttagaaggtactggcaaatgtggttgcagtgaactgtttttctctgaagctttctgcagtaatcctcctggcattattaaggtttccttaatcatacttggttagaggtgatttgcggtcctaccaaccttaatttgaattttctctctgcctcagataagcttgactctggggaggtttctgaacatctttaaatttgagttcccaaattataaagtgggttcagcaatgactgcttttcatggcttatttgagaatatatgagattgtgctttaaaggattgagtagaatgcctggtttgttcattagttttttcttttcttttcttttcttttttcttttctttttttcttttcttttctctttccttccttctttctttctcttcctttctttaccctcccttctttccttccttttttttttttttttttttttgagacagagtctcactcttgtttcccaggctggagtgcaatgatgtgatctcggctcaccgcaacctctgcttcctgggttcaagtgatctcctgtctcagccttcccgagtagctaggattacaggcacgtgccaccatgcctggctaattttgtatttttagtagagacagggtttctccatgttggtcaggctggtctcaaactcccgacctcaggtgatccgcccgccttggcctcccaaagcgctgggattacaggcataagccactgtgcccggcctccttctttcttttttgagacaacatcttgctctgtctcccaggctagagtgcagtagtgcaatcatggctcactgcagcctcgacctccccggctcagcctccagagtagctggaactacaggcatgtgccaccatgcccagctgatttttgtatttttttgtagagatggggtttttgccgtcttgcctgggctgatctcaaacttctgggctcaagcgatcttcccacttcaacctcccaaagtgctgggattataggcgtgaaccactgcacctggcccccaaaactttcaatgatgacaaattattccctgtagtaccattactattattctaccctttggcataacatagcctaggctgcatgttctgtcttcttcaaggaagtgtctatgattaggagaaatgcaagagggaggaacatactggaggatgattttatctctcgcacatatgtgaggacagcaacacctaagtttgctcactccaccctagtaaaacttcactactggcttaatccttgattcttgagtctcagtggggagtcattttctagtactgttgagagttatatagccctaagggattttatgaaataaagtgttcccaaggagtgttctagaagatgagtgatatgagttaataccaagggtttcttctgacagggagtgttaggtgataagacaactgctgaagattgaactgatctttatccagggaagttctgcacttgagattgtctttataggacaggcaacaggcataaaaaaaaagtgctataaaaataggtttgtttgtttcacagtatcattgagaaaacagctataaagaagatatataaaaatatataaatctatcatgtggtcattaaatgccagcgacttattgaacgatgatttataaatggctgaaattcaaagaattttcatggaaccaaaccaaagcatttcagaacatctttcgttctttcaaaattgaatcaactgttcttcattttacagcttctaaatattgtttgtgtgtgtttttgctgttgttgcacaggaaataatttttaccttaaaatattaaaaacttttttttctaaataataaactccatgcagtaaaaggcaacaatcagagagtgtaatgctagaacatttcaggcatgcccaaaatgcccatggcaggatgaaggaggcaacctcatggggcccagccatttgtcttgtaaagtcttaaactaccataggaaatccctgtaggatgttctattgtgtaagagttccatttaaaatacattggcaatatcctaaaaaaaaaagcagtgaaaatctaaactatgtcttgtagcttattcaaatctattattcatctactgcagcagccaacactgctgcatagagctaaaggagaaaaaaaacgaagataaaataagcaagagaatcatgactactatgaactgataaataaaagtgttaaaaaagcaataaaacaaaccaccagcttgttattgggctttcaaataggtatgtttccgcctcctcctcctcctcctgctccttctccttctccttcattcagaagcaatcatcataccacaagcaaacaaaccattttgaaggtgtttaccaggaatgtttccctcccttttaattttctgacctgagtattggtacaattttttctttcatcctttttgcaggcaaaggggttactggatgtgctaaaggaaagtatgattgtagagtgggaaaagggtgaagaacaatgttttatcttcttatgtcaattaggcaggacaaaagacacaggctcccaaaaataccttcagagtttgtcatcctggatcatgataaccttcaatatgttgaaagtctcgttcatctgggttcaagatcccacacttaacgaaagaaaggccgaaatttcccgtaatgttctttactttgggttttacaaaaacacttctatccaggtattttttcttgttgaaattctgaagtaactcaaggtgtacacatgtaatttaaaacttagctttgaagccgggtgtggtggctcatgcctgtaatctcagcactttgggaggccaaggtgggcgaatcacctgaggtcaggagttcgagaccagcctggtcaacgtggggaaacctcgtctctactaaaaatacaaaaattacccagcatggtggtatgtgcctgtgcctgtagtcccagctactaggtaggctgagacaggagaatcacttgaacctggtaggtggaggttgcagtgagccgagatcacaccactgcacttcagcctaggtgagacagcgagactcagtctcaggaaaaacaaaacaaaacaaacaaacaaacaaaaaacacttagctttgaaaggaaatagcctatgtttccacaaattagagttcataattatgttgcatttctactatataggacagcaacattttcacctgatctgagctcatctattagcctttccttacaaatttgaatcaaaactttcgccaggctataaatctccctataattggtagagagctagataagaattatcccataataagagtttgggagaaccttgtggtattaaagggatgctgacatggaatactgtatatatttctactgttaaattagatgcagtcctaatactgtttgtgaaactaaattaggtcaatgactcagagctggttttatttagagtgagctatatattaaaatgtagcaatatttcccttcttctgaaaagccttctggtaaggatttcaattcattgtagaaaaacatttcccaaattaaggtattttaattaagtcctggtaagaaattccaagcatgcttttttttcccctcctcaaaagaggccttccacattgtgcatttagtgtttactaagatttcaaatctctttggttctaaccagtatcacttagataacacatttcacttttttttttctcccttaagtgtaacctgggaaatcccaactttccctttgatgcactaagtctttggcatctcaatctgttaaaccagtgcaacaatcataacaggcattttctggagatgttacaagggatgaaaaaaaaaatgaatgaaatgagttgactttttaaagaacgatgccataagaagcaagacataaatttgctccagaagtcaaatggtgtgtggggagaacaggctttgaaatcaaatggaactggtttggagttccagcgctggcatcactagtcgtgtaaccctgggaaacagcctgagtacattttgtttgtttgtttgtatttttgagacagaatctcactctgttgcccaggctggagtgcagtggcacgatctcagctcactgcaacctccacctcctgggttcaagcgattctcctgcctcagcctccctagtagctgggattacaggtgcatgccaacacacctggctaatttttttttttaaaaaaacagagtctcgctctgtcacccaggctggagtgcaatggcataatctcagctcactgcagcctttgcttcccgggttccagtgattctcctgcttcagcctcccaagtggctgggattacagatgcacaccaccacgcccagctaatttttatatttttagtagagaccgcgtttcaccatgttggccaggctggtctcaaactcctgatttcaggtgatccacccgcctcagccccccaaagtgcttggattacaggtgtgagccaccacacccagctctgagttcatctctccatcactagaaatcagggtaatcatacattccttatcacattattaagaggactagagatagaatatgcagaatactgggcatgtagtatgtgttcaataaatggtagctgctattgttactgctactactacagctgctgctactactaaactgctgctattctcattgttactattatgactcctactattatttctactgccaaacaaggaggactgtggaaaaagaagccactttatccagctctaaacaaatgagttgttacctcactgtagcccacctttctagcaggaataggagaatgaccaagtgttttggaatcagataaacccaagagtaacttaaggagaatgataggaccatcgttgataggagagcctgagtacattcccagtgctgtacttgtgtggctgtgaaaattattgttccaaagttgaatattgtcaagggtgttgagatttatctcatggtcaatatttgatctttcaaagctgacctatacctaacacacttcaaattggttcagtgtatgtagcccttgttacgtggatattattgtgagcacttatataccagggaatgtgtcatgaggaagaattattatgtgtttggtatgtagtcattgaattaagacttccacataatgaactggaatggaattgcattagaaattctttttttcatccaaaataaaagtaaactcaaatataattatgatgttgccttctaatgtgacctgattgccatatctttgtaatgttccgttactcctgccaacctaatgtcagtgtgtactccaattcaattcagcaaacatttattgatcctagtcagggatgggaagacactaagattagcacaaagatacctttgtcattagtaagttactacccagtaaatctggctagtatattaaatctatggtcattttttacattttgcttttcattctaaacatgtaaaatgataataaaaaaagaaagtatttagaacagtaaaggttcaagtccaccccttttttcttcacctttttgtttagacactatttctgacgttaattaccacattaattgggtcttaagttccccttccagtcctcattatgacttccacatttcttacaactggcagaccttgctaagtcgtgaactataagttttttttaaaggttcagagcatttagtccagcaacacaaattaccctatggagacactatatacactagtagcaatgagcaaatgtttcttttatttttataattgttttggaaaatcatatgattgccaaagacagcctacacatggtcaagttggattcatcccagccttaaaaagtctgcgaaacacattaatacttgtgatgtatagagttgagggatgttttgttttgttttaacatgcttcttatatgtacattggtaatgtttaatttaggttaaaattctatgaatgatttaattgatattatccaggtttgttaaccattttaaatggccgttgattttgccaaattccattctatgccattagaacgctgtccacactaagttccgttaatgggggtaaaactcccatcatttgactcttaagtatggtaaaatagctgtctagaaataaatgaaccagagtcctggaaaatccagtggagatgcctagcaatgggggtccccaaagacttcagcgtaaggtgcttatcccttgaagcccccaccctcccacccttcctctatttgtttcttaattgcacattgttgttcagaaaattcacacttgggatttttatattttgtgatttgaactcatttttgcaatttcctttttacatttctagagagctgcttgaaatggatgctaaactacaattccagccttatgtgttaggaaatactttttctctactacaaagtgcaaagaactggaaactactttagtagagttttcatttaaaaaacctctatcgtacttcagtactggaggaaagaaaatgcttgtcaatcaacagccttgtgtttttcagtcttgatatatgtaattgatatatgatatatcaattatatgtaatatcaaaagagatggtgtgcacaaagcctgcctcggagtacattgaataatattttattcagatattcattttaaagttagtgatttcagatatggagaagttgtagtcaccagctgtgatttactggggggtggtgggagggcagggggacctattactggcacctgaactggtgatttctgtttacctgtaatccaaaaataagtaagtgtctgctaatttcacctgctaacatgtgacagcatctttccaggcaaagagtagaggtagccctgagagtgaggcctttcttttcggctcatgtatgggagagaattgtgttttttagcagagaaggagatagcttagacctattgcatttggtaccttccgtagaatgtcagtatgacaagtaactggactcttccagacagatctcaagagaacctgagtgcccattcaagagaactggaaaaactttcaactcccaggcagcacccgcatagctctgaaatttgagagcactctgcactctcaattcattcccaggatttgaaaccaaagtgccaaattgttttctcaaactctgtaggaaccgttatccacctactcacccatctacctgcccatttctttagcaaatatttgttgagactactatgcagcaaatactgtgttcggtgctttgaatccaatggggagggagagcaacctgggtcttgtcctaaggatgctttccttttaagggaattcatgagtcttttctgccctaaattgtctaactgtaagaagaggcagggagaacctcagtatgtgttactagagaacattggcactagtcgatttaattttcaccaaattgactatttggatgagatcctcattatgcacagtgcacatccaacttagatggaaccatctaaattggaataatagacctttgtgatctgtgactccacggatgaaatattgggtctcagacaatcaaagacagactgactctcactttgaagcaatgcatcaggctttataattaaactagtttagtcgcaaacttcttactatgaacctcaggacgttctgcaggtaacaactagaattatttgtgtggaatactaacagcccaggaaacagattaaagtcacaggcagaattctttagccttgttaagtacttggtgttaggaagaatatggaaatttcccagatcttgaaacattgtaaaggccctgggatatactatctaaaggcctgcaggcagtatccagaagtcttccacgatccttttttctttttcttttttgagatggagtctcactgtgtcacccagtctggagtgcagtagcacaatcttggctcactgcaacctctgcctccaaggttcaagcgattcttgtgcctcagcctcctgagtagctgggatcacaggcatgtgcaaccacagccagctaacttttatatttttagtagagatggggtttcaccatgttggccaggctggtcttgaactcctgacctcaagccatctgcccgcctaggctaggattacaggtgtgaaacaccgcaccgagcccaggtgtcttccacaaaaattagccaggcatggtggcacctacctgtggtcccagctactcaggaggctgaggtggaaggatcacttgagccagggaggtggaggctgcagtgaactgtaaccacaccactgtactccagcctggctgacagagtgagactctgtctcaaagaacagaaagaaaagaaaagagaagagagggtttgatttttttttggctattgaggaaactgtagctgtaaatagtgttaattctcagaaaaccagttaaatggtaaaattcaggagatcattataatcaactttaatcatgaagagatagttacatatgtggctcagtttctttttttgtttgtttggttttgttcttgttgttttgaattcagaagcagctttattttaagaatctcaatttatagtgaagtctcaatctctttagtcatcattatgtaaaatagaataacattgcaaagaaaaatcaaataaaagattaaaaatcctagggctagcacatgattgaagcaatattgaaggtcacagatagtataaattctctgattattaacagaggtgagctttgttatagggagatggatcattattaagtcatctgtctgatctagagccagccgcacgatctaatgatttcattcttggattatttttaatatgtagaattagagatgtttgggaagtgtttgctattatcttgatagtacagtttcctcctaaattacttttgtaaagtaaaataatgttacattggaagaaagtgtgtatttcttagtaatgcttcacaattcctcatcctacatttcaataaatcatcttatacctgtcagcacatgtagtctaagatttattgcatggtccattgtgaagcagatagctccttggccagagagcaatttctgaaactaatttaatcaaaatgtttttataatacagtgaactatggcttgatgtcttaaatatgcattgatgtcttcagaaccatatgattaaactctatccaattttgaaatggaattaagatttggcttcatatgacttctgttatagtcaggaaatctttggttgcattaatattatttatgtactgttattgagcaaacattcatcagtgcctctatttgcacagccaacccgctagatgttaagatgttgtgggggaacaacaacaaaatactagtttagtagaaagacgtaactgagagcttggaaggagcagtagacatggcacaatttattggccaaaaaggaatccagttttgctgaagttgaatgttcattttgcagggtggtggtaattatagctgccttctactgggaaagttttaaacctatagttttgatgagtttgcacgccaactcaggagtttgaacttcatcctttaagagttgaaaaattttggagttttgagagtgatgtaagcttactggaaagattacgttgacggccatgtgtggacccaactggacaaaaattagaggaatgaaaaccagtgattcatggaagattgttagaatggaaaccttgggaagaaaagggaaaactgaagtcaaggagtcttttaaaaaaacaactccccaaaatctttagagagtgattagatagaagacatgaagagcatagtaatatcttttgtaaagatcgaggccgggcatggtggctcatgcctgtaatcctagcactttgggaggccaaggtgggtggattgcttgagcccaggagttcaagaccagcctgggcaacatggcgaaacctcgtctctaccaaaaatgcaaaaatcagactggcgtggtggcacatgcctatagtcccagctacttggggaggctgaggcaggaggatttcttgaacctgggaggtcaaggctgcagtgagctgagatcacaccgcagtactccagcctgggtgacaaagtgagacactgtctcaataaaaataaataaataaataaataaagggaaggtggggagaaatttcaaaggaacagatgatgcatttaagacagttgagtttaaaataacaggggaccagcaaagctgaaagttggtattgaactgatagtgagagactaaagcttaggtcagagttgagatctgagatcaaaatctgaatcgtgtcaggacagaggatggagttaaagctgtgaaaaagaatgccattgctgatggaatatgtacatatgaagccactgttttattataattgtttggatagaacatgttctggtgggaaactcacttgcagtcaaaattgcacagtgctaaagtctgcctttaattatagtaaatgcattcgatttgagaatttgttcattacctgtatcagtgacactttattcaaataaaaacagcacactggagaaagataacagttgtggaaggccaaaagtcctctttgtgatttactatcaccatttaattattaagctgtctgatgtcatgtgacactgcctccccagagtgtcctatcacagtgatagacgaaggtcacagacatttggaaatcaaattataaaagtcacactaaaaagtcctgagagcaaagtttaacatgtttgttttcagctttatatattttctgtcaagctgaattttgaattttgaagaggtacactgagtccaaccaatggttgggggggcattattttttcatcataaacagatgagtctggatcctctgctggctggttgccctctccccctttcaataccacttaatttttttttttaagaacgacgtttataagtaatcaagaatacactgggagcaacttcagcatgactgtttttttgcgtgtgagagagggcacgttgtgaacatctgagttctatcttcatttttattagaaaaagcaatttagaactgccagtcagatgggttaaaaagcacagctgatcgaggtgcagcatccatgcctgaaccttctgtgtggcatgacattggctcataacccccttacaccttctctagctctctcttcagttctgcttcctgttccgcagtagagactgaaggaactcgggaaaggcccaagaatgggacctgattacaaagccttagtaagtaataagataacaaaatgtccacaagaaagggaaagtggggagagaagcagagcaattgcttacttcctacttagcttttcctctctttctgttttcccaggggaaggtgcccaacaatttgtatttttaaccggctccccaggtgactgctgtggttgggccaagctacattttgagaactcctggtctaccttctagattctacagaaaagatgagactttgcaatttgtaattgttataactggcaagtctccttccacttctgagtattggacagttttctctcactggattaaaagcaaatggcttggtttttaaaagtttttgaaagtaacatttattatttgacttccgctttagcaacacgttgtatatgtaaactcaaatatagttcagggaactgagagctagttcacttccaaaatacagtgacccataaattgtctttagtcatgtataaacaaatgaatgctattgggaaaatgccttagtaaatattttttgtaaaacacagcaaattaaatcactttctagaaaatctattttttttttccccaggcaagtggccatcaatcaaagaagcagaatactaggtgtggttttctttgtttttgttttgttttgtttgaggcagtgtctccctctgttgcccaggctggagtgcagtggcacgatcatggctcactgcagcctcgacctcctgaactcaggcgatcctcctgcctcatcctccggagttgctgggactataggtgcatgccaccacgcccagctaatttttaatttttttttttttttgagacagggtctccctatgttgcccaggctggtctcaaactcctggattcaagtgatcctccagccttggcctcccaaagtgctgggacaggtgtgtgtcaccatgcccagcctcagaatactttatcactttggtttccaaatattgggaatattttgcaatttaccttttagactacacaaggcttcagggcaatgctcttgcctgagttgacgtttgaaagtgaatagagctgtaaatctattcttttgtcgtcagaatttttttaatgtttttcctaaatatttaagttaaatgtgttaaaatattgttgaatgataaacatctgtagtacacttctgttgtgtttctggtgaaagtaactactgttaaggtcaacagaccaaatttgtatacaaatgctttggcaaattagaaattgaggtgaccattcagtagctctttttaggcattgggaatactcgaatgcaagaaagcattcccttatattttcaagtataaaaagtcctctaaattccttaacagcaacaatcagtgtttccccgctaagcactgttttaataaagttgctgggattttctatgataaaatcacataaatttatacttctacatacatctatatataattttattcctgtacttgttatatacatataagctgcattacaaatatatttttattctgaataaatcctaaagtataaaagtagtaaattgaataaattattgattttccttcactgtatcacagaacctgtttctccattttgagcaatggttctcgaacttggatgcacattggaatctcctgggtagctttcacaaatcctgctccctggacctcactcaggcgaagttatttatactctccggttgggaagggaggatagatccaggtgattgccatgtgtaggccagaatgggaactactcccctagtagacactcctcatcttctttccttccatgatttccacatttctttcaactcagtcgaaatcatcttgaatagacaaaggcagtgtcggtcctactaaaggttgaggaaatggctgagtaaagatgatgaagtcagggacaaaggatgcaatgaattttaagaatttgagattcaaacttcaaaacttaggcaagggtctgtttttgaaggttcagagctgaaaaacaatggcatgctttcatattcttctttgattctgtaggatgtcccaaatggggaattctcttacataatattgattttgtaaattcctgacagatcgtacccactttggatggaatggaattttaatctatttttttgagccaaagagtgtgacctcccttggccttaaatatttttttgtaccacacatgtggggatatgagtattgtgaaagctacgaacctttcctttgaatgccacaattcaagaacaaagctgatcatgtattgaattttaataatcattttcagcagctggtccagaaaagggcattttcctctaaaacctaaaaaattcagaagataaattcctatagaaaaaaaggaaatcatacttatctattcaaaattattagatcaaagactttcaactattttagcttcaaatatgtttaatatattgagtttaactgacatgaagtacctgcaggatgcgtggtgctggcttagaaaaagatttggttttcctacagtatctgaaaaacaaaaatgtattttcatccatccaaggctaagcatccactatgagactaatttgacattcaggtctggtaaaaatgtttgatggtatcagttaaaaccctgttgaagtaggaagaccagaacatgttcattagtgagtatctggcaatgttatcatctacttaagatggaagaaaggggataagatcaaaattattcaatccctgagtgatggaggaagtaaagcttgaaggggcctatacagacaacatgtatgacatccatcagtatcaggggattttatagacattaattatctagtgctctacaccctccctgcctgccttttaaggtgtattttatgattgaggaaaaaaaaaaagaccaggataatagaattgaggaagatagcaatcaatgagtaattccttatccagtcggcacttaaaactcaatgctttatatatttatttgcagagtggtaggaactaactaatcctcatgctgtgccttccttactcacttttgaccatgtttttgctatagcaaccttgatacaattgaagattgtcatttcttactcttcctcagtttgaagctcctgctttcctggacaaaagacacaaataaaacaggaatttattcaatcattgcattttatccataatttaagacatcttatctataatttttttctgagttaaaatttattttggtggttaacaaaaagagtctttagaattttgagtacctgaaggattggaatttgaggcatcctcctacactcccatagtaggtgttgaaaatgttaagttaattgaattatattgaaattttaaaatggcttggagcaacagaaaaaaaatgttatgtataaattaattaaaaactacatggactgtttttttttttttaccatccacatggataccagggatttcttttctttctctttctttctttctttctttctttctttctttctttctttcttttctttctttctttttctttctttctttctttctttctttctttctttctttctttctttctttcctttctttctttctttcttggattattaaaaagagaaggttgttttttaaataaggaaaacaattttctgcaaatggccagatagcagatattttggtctttgtaggtacaagtcctcaactttctcattgtactgtgaaagcaacagtaaacaatactttatggctacagaaatgtgagttttgtatacttttcatgtgtcataaaatgttattcttttcattttaaaaaaaattatttaaaaatgcaaaaatgagggcgggcacggtggctcacacctgtaatcccagcactttgggaggctgaggcgggtggatcacctgaggttgggaattcgagaccagcctgagcaacatggagaaaccccttctctgctaaaaaatacgaaaattagctgggcatggtggtggcacatgcctgtaatcccagctactcgggaggctgaggcaggagaatcgcttgaacccaggaagcggaggttgcagtgagctgagatcgccccattgcactccagcctgggcaataagagtgaaactctgtctcaaaaaaaaaaaaaccattcttagctaacaagccacacaaaaacaggcggcacgcaaggtttgaccagtggaccaaccatagtttgccaacctctggtttaggacattgaatatctcctgatttgaaagttttcacttgaacaaaaataattaactactattagtctgttctacaatatcctcctcaccatgtaattcttaactggcaagtagattgcctcttttgttttatttatttatttattttaaaagacagggcctctttctgtcccccaggctggagtccagtggtgcaatcataactcactgaagtgttgaactcccaggctcaagcaatcctccctcctcagcctcctgagtaactgggattacagatgtgtaccagctgtagtctacaaatttgacctgtacccaatccttggcttaatattaatttttaatttttaaaaaagtttttgtagagatgggggtctcactatgttgcccaggctggtcttgaactcctggtttaaagcaatcctcccgccttggcatcccaaagtgttgggattacaggcatgaaccacagtgccctgcctgtggcctcttttgatattgctatggcagcccagagtactgtgttgagaaggattcagaagttgaacaagggcaaatgagcagagagggctgccagagagttgcccaattggaccatccacagctcttctagctgtgttatagtcttacaaaatgcttcctttatgtcctgctgataaaagttatagacttattcttagaagcatttttctgcaggcataaattttgcaactgagatcattgtttttaagttagagaatttgaaaggattctagtaatatagcttcatgtgatatccattctcaaaaccaacaaatgtatttattggtcatttgctcacctctcttattataggcagaaatggggctggggaggaggagtgaataaaaaaggccattcacatctctaatacctggaaataactagtcgtcattggatctgctaaaattataactaaatgaatagaactatactaagatacctatttatctccattaaaataaaagctcttctagaccatacacagtatttaaaagttgttctctgtatgttattgactaccaggttagaaaaataaacactgaactcctaatgatggaatttataaatatatggaacagattctgtggtgttaatatagaaatttcaaataaaacctgacaaggtaaacactgtatcacatatcaaaatgacttaaattgtagtccatggaatactagacttaaatttatatgcagattgtattttattaggtttttgaagttccctcggcggcctgtcttgccagggcatttggaaatggtagctattataaccaatgaaaaaaatgcattaaaaaattaaaacaacctaaattacatgtatttgcggtctgtcgagtcaaacctgaagatagtctcagcctcctgcagtgcaattaaaacatctttaaaatttagttacatataaagaatttatgcttttatacaagtggcatgtgttaatatgggtgtgttttcatattaactattgtgattaaagtttcttagaagaaaatatatgggtcgtggcacttgacgtgtccatatcctgatcacgctggagtggtggtgttgggtgccagggctccgaatacagttgctgaatgtcactctgaatattatggaatgaaacaagccagatctgtgtttgccttgaaaggtatccagacctaatattgtactttaaagacattctgaagtattgacttcggaataagagcaagcattctttaagtcctgggcaaacccaaaaggaattactgaaatctcctgtttcaagcatacattttaatagtagtgctcaatgacaagtcattaattccctgcaacctgactcttaggttcaggtctccaaaggctaaaattaggggcatttgtctgcttcccttgctatttgattgggtatcactgtatgtagaagtacaaagctcatctgttaagttggatttactattctctgctggtgtccctatccatgcctaaaggctcatattgagattggtgtaaaatcagctgtcccaacatgaattgttcaattatcagctcaaataagccttactaaaaactacctaacatgaaggaggttgactgtggctctgtgaagatgcatccaaaatgtgtgcattaaaaataaaaattataagaaaaattaatcaccctttttgcataaagtatgtaaggaagcctcattctttaagcaacacatgttttataactttgccttccacaaatttgacctatacccaatccttggcttaatattaagaaactaaatctgcccacaggtatccttgccttttataaggaccattttgaattatttgtatttcttttctttggtggtagtggtgggagggtagtattgaatgccaccaagtcgtaaacctcacagaataagagcactatgaaaaaatcacttggggaaaaggtaatgaattaaggctgggagcaacttgactttgggtttagatggaacttgaagttgatgtgttagtgataattgctatagcatctctctatttttataaatcccggtttggaaaaatttgtttgataatgttatatttgccttcacaggaatcctgtgctctggacagtgttatataacattcctcaaaaattcttctaaactctcaaggccctcttcttggggtcagactcaacggtaccaatgagaaaagcctgaaagcatggaagacttctgttgtttagcaaagctgagagaagacattgtcttaactatctacactagttgttaaattaactaatcagttgatttactacattggatttcagaagggttgtccggtgaatattcagttttccatgctaattggaaatatcattgcatatttaagggtgtacggtgggaagggactaagcaatgatgggtatacagcaagtactcaatacatcctgtggctttattatactctctttttgctggtagaattttctgctacacacatgcattccaggcaaagggaagagactgcgcccatgctcagacccagaaacaagcctggatccataaaacagcttgttcacaatggcaggagcacagcacaggagtggggaaagtagaggaaaagaggtatgagtaatactgaccacgaaaggaaagggagttgcccattcaaactaacagatgagaagggcttcatggacgagatgacaacaaatagtagcattagcattcattgagatttaggacattgcacaacattttagaaatatgtacacttagtctaaaacagggacccgcagtccagatgggaattctgacaataatcacatcatgagaaagctgagcaaataggattcagtgtttttggaaaatgtaatcttagggggaaatatattcttgtagctatgtactactaaattgaaaatctacagaacaaatcatttatgaaatgtgtgggcatgcttttaatttggtggtggtttaaatattttattaactgtatgggcatgcttttaatttggttgtggtataagtgttacaaattaagctttttttaaaaatcagtctaaactcgaaacttgaaaaacaagttttttattttatttaacaagcaccgatacaacacatcgtgagccaggtactcttcctagggcttccatgtatctcctcctctaatcatcttgacagccccatgaggaaactgaggcacagaggttaagaacttgttgaaggtctcagagctaggacttcaaaccaggcagactggcaccaggttctgtgtacttaaccattatgctccttaaattagaatatctacgagtcaaaatgctgtttaattttcttcagattattgtgggttctgtcaagctaagctttctgcccataagtgaaagtgctcttagcatcttgtacagaaagaattcttcctagaggttcattgagtggcatctatttcagacttacacaaaaagtttgggacaaatgttagtgtttaacagaagcagatgtttatcagtggcccagacaatattatcattttgagttttaccttctaggctgggggcgtggcaaacaacagttgtgggtcaaatctcactcaccacttgttttggtaaataaagtttcattgaacacagtcctatccactcgtttacatgttatctatggctgctttcatgctaaaacagcagcagaattgagtcattgtgtccaagaacatatggccaataaagcctgaaatatttactacacgatcttttatagcaagtttgccaccccctgttctagaccagtgaggtagccaccagccagatgtagctcccaagtgtttgaaatggggctggtttgagttgagatgtgtcataagtgtaaaacatatcagattccaaagacttagtaaaaagaaagaacaaaatataaaatatctcatcagttttcaaatattgattgcaggtggaaatgacaattttattaaaattaacttttcttggttctattttttttaatgtgactactagaaaaatttgaaatgtgactcacatttgtggctcacattaggtttctattgatactgctgatctacagcctggaatttggaggatatgtgacctctaggaaaagcagaaagaggaaagatggggaaagagagaaaacctcttgtatttgcaaatgtctttctaaagcaataaaatattttctgatttggctcttcctcacagaaaggcatacgcaaaaatgggttaggtggtctatggagatgatcgtagatgagttctcccagaagcagactctgactcagaatttgaattgggaggtgatccaggaagcacctggagggagaggggatgcaaacagggaagagattgaagaggaaagagggttaatgagcaggttgttgctgtggacccatgtgctgcctcccaattgcgccctgtgggagattttgtagacagaggctcagagtggttccacccaggaggtgaaaaagctgggctgcatatccaccaattgccagtaattgccacttgagggctgctcctaggaacatcagcttcttcttactctccccagcacctgccttgcctgaagccaggtaaggccctggggtgaaaaggcacaggtgcttgcaggaaaaagccatgagcaagctggagaatggtgcctcccagaggcacagggttgggcccttctagtgtctggaactgtgtccaaactaaatgttccatcttctaattcataatttcaacagacattcatgtagttctctggtgaatgtgttcattttctcatttgatcttaacaatagtatagataggtagatttatcattatccatacattatggatgggaaaactgagcccaagacacatccagtcatttgccgaagagagtccagctgggatggtagtcccggtctcctccctcttcatatgtggtcactgactccttggatttctacaaaacttgccttgagtaaggagatgtcaatatattgatgttttcaaggtgagaacaggaaactaaaaccaatttttcttgtgctctgtagaatttttttagatatccatagggcagtatagaaactgatatctacttaatcccatgacttttatatggaaaagtatgatctctgttttgcacaagtcacaatcaaaatcaagagattatggagactgctgaccactaccacacaggatgttagtgatagagttaatttccagaaaatcttcagagaagtccctgtagtggaagcttatgggtgcatggctcattaaggactggattttgttatcttcccattacccaggttcccttcaaaggtgttgtcagcccctttggtaccacttggaaacaagtctctctcccagcttaatttccctttattatgcttctaactgactcggtaattctttgcagacttcagtaacacttgtactatttaaatttgaataaccccaaaggatctggataggtcaatgtgtttaaaccacaggctttagtctatgtattagttgattaaaaacagatttgatgcatgatgtatacttaataaagggagggggaagcaagcagatgtttgtaaaatctcaatgtgttggattgcatttctttggccctcttttgctgactaactttagaaaagtcatacttatgacaattgaactgtaaacagttagatgatgtatttccctagaaatttcctgctgtgaagggtcagccaaaaagaaaagtatcccctagtattaacataccaaaaaagttgacaaatatacgttataatggttatgtctatatcaaggacattgaagaatgggatgcttcaaaatcatcctctagtctctgaccataaagtgattagcagttgcgattcatttaatccaaacaataaaaaaaaaaaactttggcttttgttgttgttgttgttgttgttaaaagcaagtttttctttgatgcaagcataagatcaagttgtacataaatcactgtgtctagttcattctctgactcttcagcctcttgtatcccattctttaagtgaaaaagttattcttcccctttaaaattgtcatatttgaaatgttttgagtgattccaagacagaattgaaggtttcttgttggttttccagtccagatgaaatgtgcacaaagccttcctctgaagtttgaacacatgagaattacagataaaatattttaaaatgtattttagtgaatacataaccaagcataaacatatgtggaaagcctccaaggaccggaaatgaaagaaagtgtagagtggtgagagaagactgacactgggctactcccaagaagtggagatgacatggggcaatggtgacttcagtggacacatagggaagtgaacatcacatgtggcaagagccttgtacacctggaggccaagacccccatgcatagactggactcaaagggaacctgacatcttctctggaattgaagccagacacagaactctcatggaaggaagcagaggcactgagtcaaactaggatctgtgcctctgttgcacacgagtgccttgtgggagcgtcttctttgggaaaagaacctcacgccctaacctcagaatatgcttcttatctggctgggctatgtcaatccccaaatcacagcacagggaacaaagtttacatcgtatgagctgtcagacaaaaattacaagacaaagataaaatcagatccttgagaaatagtcaacaagcacagggaaatacagaattgccttttctcaaaagagcttaagaataagtaagtttagttgttttgagattatggagaagagaatcgtgtttttgtaataggaacagagagaaattcaataagaaaagggagatgtgataaagaacctactagaaatgaaaatgcattcattaaaaaattttaaaatcagtcaataggataaacaccagattaataagtttaacttgttttaaaaataaccagaaagttctgcttttgacatatgcattttaagccttagatgaaagtggttcttttccttaatatacttttctaaataaaaaatttagggaagtagaatgagctaaaattttcataaataaattttacagcataatgaaattaacacctttatgaacttgttagttttcaaaatccctcaaactctttctaaatcctctttcttggatggcattataaatttgaggtctgttttcttttccatgaaatttcctgttgttccgtatctttgccatacttgtggaactgtctatatgctaaaacacagtttccctaatcttttgccctctcaacctctctgatgttggcatacgacattgttctattccctgcccatggaagattcttccacatgctcacttctttctttccaagaagtttccactgttgtgcaacaaaaaacccctggacatccttcaagcctcagctgcaagacttggccctcttggaaacctttaaccagcagccatcaactctttcccttctcttgtttgcagcatctttctcccagtttgtacagtcatccatttccttgtggacagggaatagatattaatatttttatttgatttccccactgtctctttcagagtctggcatattgtagaagcttaataagtacttgttgtatgaacacataagtaaatgaatgaatggtaggaacacataagtaaatgaatgaatggtgtaaatcaagcttgtccaacacgtggcctgcaaggccacctgcagcccagaagcgctttgaatgcagcccaacacaaattcataaactttcttaaaacattatgagattgttttgtgatttttttttttagctcatcagctgtcattagtgttagttattttatgtgtggcccaagacagttcttcttccagcatggcccagggaagccaaaagattggacacccctggcaatcaagagcatgtgaatgagaaggaacagagaaatcttagtgagtcttacccagaacagagagctattgtgtttgaaaataggattaaatagtcattccagagaactttaagtttgatgctctaaaggaatagggaataattctagagtcttatgcaggataatgagtggtaaatacagtgttcaaagaaatttgatctggcattgatggacaaagaatagaagcatgaacaataaaatgtacaattgtttgttggtatccataaaggattaatttcagggtctctcatagatactaaaatcatggatgctcaagtccctgatataaaatggcctgttatttgcatataacctaatcacatcctcctgcataccttaaattctctctagataacttatattacttattacaatgtaaatactatgtaaatagtagttatattctatggtttagggaataatgaggagaaaaaagtctgtacatgttcagtacagatgcagtcatccatttttttccaaatatttttgatctgcagttggttgaatccaggtatgtggaacccagtggatacagagtcaactccactacaactgaccaaatgtgtgtgtgatgaggacttatcataaatgtctataaatgaccttattgtcagcaagagctaaacaattcaaaccttcctccaagggattagcctcagcctgcccataaaaggataaatctgaaaaatccaatggtagttgatttgatgtgggaatatattccttatgttattgccagctctgattcaagtaaagggatagaaatccaattacctcctttcttcctaggtcgtgacctagagataacctataactaattattctgttaagtatccctgagttagtgcaagaagcaggaacaaaaagaataaagtctgagcgtgtctaaaaggttcttttaaatgcaacttttgaaaatccagtttaaatctataaatacttgaaattatgtcgatttcactaaggtttctgaaaaatgtatcagtttttcctgagaatgagtaattttgtgtatctgaagtataaaagtatgcagaataatatttttcctcttttttttttttttttgaacagcaaaacttagagagtaacctcaccaaccttattaagaggaacacagaactggagacccttttggctaaactcatccaaacctgtcaacatgttgaagtgagtatctctgtatttctgtatggtatgtttcatatgaaaactgccagatcaaggttttgatatcctcatgctttataattttaaaacaagaatctttcttaaaattaaatattttgcaaaagccaaaataaaagatggaggaaattaaaaggaattagaacttcagagagtctttcccatccagggctgcttcccattcccattatagctcttcctgatctagcattacatagcagtcctaatgttggagattttaattgcccttacaaagaacagtcaaaaaaggtattgtaggccgggcgtggtggctcacgcctgtaaccccagcactttgggaggccgaggcaggcagatcacgaggtcaggagatcgagaccatcctggctaacacagtgaaaccccgtctctactaaaaatacaaaaaattagctgggcgtggtggcatgcacctgtagtcccagctactccagaggcggaggcaggagaatggcatgaacccgggaggcggagcttgcagtgagctgagatcgcaccactgcactccagtctgggcaacagagggagactccgtctcaaaaaaaaggtattgtattagtgtactatggctaccataacaaattaccacaaactgggaaagtatgaaacaagactaatttattctctcagttttggagactagaagtctgaaatcaagattttggcagggccatgctccctacaaaggttctaggggaggatccttccttgcctcttcccattttctggtagttgcaggcaattcttggagttccttggctttcagctacagcgctctaaacccttcctccgttatcacattctcctggtgtgtctctgaatatgtgtccaaatttccttattgttataaagagcccaccctactccagccttacctcactttaacttgattacatctgcgaagactctattttcaggccaggcatggtggctcacaccctgtaatcccagcactttgggaggctaaggcaggaggatcgcttgagctcaggagaccagcctgggcaacatggcaaaaacccatctctattaaaaaatacaaaaaattagccaggcgtgggagcacacacctgtggtcccagttacttgggaggctgaggtgggaggatcacccaagcctgggaaatcgaggctgcagtgagctgagattgcaccactgcactccagcctaggcgacagagtgagaccttgtctcaaaaaagaaaaaacaaagattctgttttcaaataaggtcccatttacaggtaccaagggttaggacttgaacatacctttttgcggacacagtttaatgcactgcaggtgtatattaatgcatcttagttgtcagatatgtttccatgaaataaaccacaattgcaacaacagcagaacctgcaatgactacactgaataaggaaaaaatagatgccacttcctttatgtgattttcaaattcctcttccatcttctcccaaactgtcttttttaccaccccaccccatgaactgaaactaaacaattatcattcattacacttttaagccttctggcccttaaccaagcagttccctctgactggtaggcccattcctctaacccatgtctatttgtcagaatgcttcttgtgtatcctccaagtcctaagtcaaggggcacttcagttgtgaacgtttctctggttccctggaccagagtcatcgctcctttctctgaatcacgtaacattttatgataccgtgtatgtgattcagagaaaggagagatgtccccgccccaatctcatgtcgaattgtaatccccaatgctggaggtggggcttggtgggaggtgtttgggtcatgggggcagatccctcatggcttggtgctgattccatgataatgagtgagttctcacaagatctggttgtttaaaagtgtatgacactcctcccccaccgcccgcccccctcccatacacactctttctcttgctcctaatttcgccatgtgacgtgccagttctggctttgccttctaccatgtgtaaaagcttcctgaggcctcatcagaagccgagcacatgcctggtgccatgcttcctgtgtagccctgcagcacccgtgaaccaattaaaccccttttctttgtaaattacccagtatcaggtatttctttatagcaatgcaagaatagtaataatcttctcatggctttatcattctttcatgtaccagttccatttttccaaccagaatgtgaggtcttagaggatgggaatcaaatctaattcgtctttgtatctcacagactctgatgcaatgattttcacacagtaggagctcagggaatttgttttagatgaatttgcatgatgactctccaaatggcaaattttgaacactatttgaatgcctgcaagttcagctcccctaaaatatctaaagttggagaagcaaattattttgagcaggcatttaaaaattttgacagtaactccatttttgcaataagaattccttcaagtccctttgatcgtctacgcagtaattataagtttatagcctcctatgtgcctataactgtcagtagatgcacaatgtagcaaataataataaagattacaatatgttagagaacagtgtacacacatataacaacatatttaaagaacagtagagtagccaatcaggtgctcagctagtagaatattgcatttatggattctaagattagcatttttttgaagactaatattgctgaaattgagctgcaacttaaatgaatggtgagacagtttaatgggcaacatttgtttgttcctactggcacacaaaatatagatgagacagttgctggtatcttagattagatggagtatggtttgagaaggggggattaaaagagaaaaaaatgcgaatacaatttttctgaagctttgtggaagagtcaggacttgagccagttcttatagatttcacaactattatttttcagtaccctaagtattgaggtgtcagcttatttatgcaacacaatgatgtttgtcagtgatacattcctcagcatagcagaaattagcaaagattgctttcagaaagatcctatcagtgtaaaagcatgtctactatgcaaatactggtgctttggtggaaggcttaaaatactttgtgtttgtaaagtctgtgcttttacttacaagtgctccccttgtgatcagaaatgtaaaactggttactaagagaaacacatgagttagcaactttttccaactccaaatttgttgtgttttccaaggataatatccagggagacagaaattagggatgttctcatctcctacctaagccatctactccagctgttcatcatttgaggtgctgatggaggttatgataggtggaagagggaaaggcatacaaaaggaaagaaagggaggaatcagagtaaaacataggtgagagagcagattaggattgtccagtgagcttattggttcacttagtagaccctcttgctttaaaagctacatgattgtcagggtagaatcagtgtttcatcatgttgagatgaagttgagagtgtgaaggcagcagtgtgttgcagaatccagaccttttgaaccctctgcttagactggattctcttttggcaagcctcttgccagggaacatgttgagccttgttgattaaacaacattggaaataatagtgaacaagcataatgttttcattattatagggtaaagttaatatgtattatatgaataaatggatgaacaaaatggaataatctgtgtgccatattttatttttatgatgtgatggcatttgatgtttaggatagtaagaaagaattatttctcttcagttaaaaaaaaaattacctgagctttatggtaaatcttataaatgctttatggattgggtgattatgtcattcaatttcagctagttactccttaaagcattaatgtctggtttccattatgacctgttgtgatttcagaacaaatgcattgcttctaatgcaatattattatggcttgaatttacaagacgctattcatcctaacatgatgtaaaattacattctaagatgttcagtaatttcaaatgatagataaattgaagaaatttacagggagattttagttttattttaatagatcagatatgattttagttgcaatacaggcttttcaaataaagctattactgaattgattgtagtggacttgcatttacaaggaataaagaatattcattcttttctctgttgtttttgtataaatccttgggaatggaagcacatgtttatgggtgagtaaatttggtatttgggaaatttattctagataaaaattaaagaaaattatgagtacaaaaataatgatacttacagtacttatttttacgtttgtttttattcctaattattagtattctgaaagtataattttcaaaagttgaacacccaattctcctataatgaatgaattagtccacatcaaagatttttttaacttcttaatgaaggaaccagcaagatgataaagctgcttccaaggaggatgccagaaacggatacatataaatgtggggaagggggtagtagggggaaaagaatgccagactagcatagctaatttggatacaaaactggttagtgacctacagggcaataaacctgaaacatttggacaaaataagttgcatattactgggtttctctaagttaacatctaacttcgcagagtctaagccctaaccactagtaaatagaaagtcagactctgttacatcccagtctggagagtcagatgaccctgacttaggctgacttcatggaatatgctctcgtgggactttggaagggctcacagtcttctctttctcttttttccatgttttggataattttgcttaacatgactttctgttctagagactgttggtctaggagcagtgtttgctaaacaaatatttctgggaggggatgtacatttttgcctgtggacagttactttaatttgttacagtgtcttgctagtttgttcattttggtagtgcggttggagtacccactgtgtgtgtgttgcactgtgttaggtgccaaaggaccctgcccacaggaagtttactatcttcactaagacagaagagcacttataacacaaaataaagtagaaagccataattaccatgaagaaggtgtggattatctacttcaaactttcagagaaacaagaaattatttctagctggggactggggaagcagcgcaagatctgagcctgccttcaagggtaggtaacatttgagtttatggaagcagcactgcttgccaggcaaataaaggcatggggatagaaagacgaggaatgtatgtacacaaagcaagtagttcattctggagaaatggaaagcatggaagaaggaaggatctgtaggaactagtttgggagagttgagagctggaaaggctttcgtgttgcatctgaatttgaactttggttttgaaggtttagtgagggttcaaggaacacatagacctgtgtgagtttcacagtgacaactggcatttccaactcttttcaggaaatgacatttttggttattgagaaaataatatggatattgtcatgcaaaacaatctcatgtccaagggaaaccttcacagcactaggaaactccaaaaaggccatggagtttgttaggcaccagcatgctattcttttaaatcagtgcagtggaaaagaatttcctggtccacatccttggttcctagatggtacttcttccttttcctcttcctgaaggtgtccttgtatttgggtatgagcattccccgggaaaataattcccatgccagctggagctaaaaaaaactcacagcacagaggcacctcctaattgttgtaaattaaatcaatgaattccttcccacgacccatgaggaaatgccacatccttataagtccacatctcttcccagggatttacctctgcttttcttcagaatggaaaacagtttgaaggttccccttcagccacccaactctccccacccctgccacattgttttcataacttgttttttaaatgagggtaagcaaatgaatggctttttgattgtaagtgccaaacatttttaaaacggtggataacagagaatggcatgctgtggctcatgcctgtaatcccagcatactttgggcggccaaggcaggaggattacttgagcccaaggattcaataacagcctgggcaatacagtgagacctcgtctctacaaaaaataaaaaaactagacaggcgtggtggtgtgcgcctgtaatcccagtaacaaaggaggccaagactggaggattgcttgagcctgggaggtcgaggctacagtgacccatggagtgcaactgctctccagcctgggtgacagagtgagaccctgtctcttaaaacacacgcgtgcgcgcgcgcacacacacacacacacacacacacacacacacacacacacacacacacaagagcagagtatgaaggccaagacagtttgggactcaggaggcagagacattgaaagagcaacttcaggccaggtgcggtggctcacgcctgtaatcccagcactttgggaggcccaggtgggtggatcacgaggtcaggagatcgagaccatcctggctaacacggtgaaaccctgtctctactaaaaatacaaaaaattagccgggcatggtggcgggcgcctgtagtcccagctactcgggaggctgaggcaggagaatggcgtgaacccgggaggcagagcttgcagtgagctgagatcacactgctgcactccagcctgggggacagagcgagactccgtctcaaaaaaaaaaaaaaaaaaaaaaaagagcaacttcaggtagactcctaagaaatgtttgtctaggattgtaaaaactaatgggttttcaaccactctattttgttttcttcaggagagaaataaggtagaatggatgagtttgtagttacactagacaagtttggagttaattatatatgtagtgaaagacaagcttatgagaaatgatcaaaatttgggtcacctgtagaacttaacttttctaggtcagataaggactgtatctcttcatcacatttctctttccattttctttgaaaaatcagaagacacagtttattagctaagcaaacacttggaatcactgatatgtaccaaattttctgcacattccaataatcaagttcttttacagcaaatacaacaccttgacacttaatagatgttcgttttggaaatgataggtgccagtgactctaaagatgatggccaagaacaactgggaaagggtggccaattgccataatggtttcaagaggataaaggctcagcagtccttaccattcttgctcaaggtcatcctagaagggcattttctaatccaacatcacttcaaagttccagcattggcccctttggtttatcttgccttgtttgtaatcacttcttaaaattctttttgccattatttttctcactaagtttttaatctatctttgttgttgttttattttaatggaaagtttgctctcatacggctttctctgagtttctccagtgctagttgtcatgtaaagtgacaaggttcttgtggaggaattaaggctgtttaattagatttctgctcagatgatgagttttgtaaattgaaaaggatgagagtgaggtgttacttgggtgatatgtaccttgtaagaaattgtagaaaatcacttggcaaaacagatgggagtctgtagaagacttttccagtaattcaccaagccctaaaagcattcatttgtaaactttgaaataatgaaaaatcactgggttaaaaagaaagatgaaccatttgtttaattttgttgtgcagttttgtaatgccaaagcattctctctccgtagaaaacttggcaatggcttcatccggagtcattggatgaagaccagcatgcaaacaccaaacgagctatttgtgtcttgtgaacgtgtgtctgatcttggatgaagtatatcctgctgggggccgacatgaatgtccaaagttataatccattttcacttgcagatgagggtcagattcccacccgatctgaccccctgtgagaatgctttcaaggtataattagagtcagattctgggcctcattaaaccacatcatacaacccacagtcagctctggctctccatgtaataggctctagaattatgataatgtgatagtgcaaatatggtggctttcagaaactggattatgacgagccactataataatggttgatttcccaagttcacgtcttaggattcccatgacaaaggagaaaagaactgttggtctgcacagaaatttatcatctctggagaagatttgtttttactattgcatttgaataatgtctattcatatgcaatagtaagacagttgaaacagtttactctaccaagtttactaaaattgacaactcatgaagcaaatgtagtttttcttggtagaggttaaatttaattattaaagtatctaacacatacttgaatgtctccctttggattcagtgcccttgacttagaaaaatttgattcataacaggcattggatcctgtttctttcttgggcatattcataaggagtaatgagaagatatcagcaaaaatctttgagtattttggaatgagattaatcttatgaataaatgaatataaggcttagtaagctggtattacttttagaatgacattcccaagtttcagttttgaaactttatataaaacattatccaaacctttcatcgtctgcaaatctttctagtttgggtggtatgacctattgcatcatatacagaatcctacctagtggctcagattggagtatgaacacttgtacgtgcctctgaagacaaaccctctaatgtttgaatttggtagtgcagatttccaaggttaatacttaaatgtgaagcaataggccttaattggaggcccaaaggctgagcattagaaagttagagagaaagtgtgcttttttctgatatatcttattgtgctccctccctccacacaatacaagaattccttatcctgtctccattacagtattccacacacaaccttctttacctggaaatatttacttgcgtgattgactagagcagcagagatgtttctggcatgatataaagaataataggaacaggtagtgatacattttttaaaatagccattgttggccaggcacagtggctcacgcctgtaatcccagcactttgggaggccaaagtgggtggatcacctgaggtcaggagttcgagaccagcccggccaacatggtaaaaccccatctctatttaaaatacaaaaattagctgggtatggtggcaggcgcctgtaatcccagctgctcgagaggctgaggcaggagaattgcttgaacctgggaggcagaggttgcagtgagctgagatcacgccattgcactccagactgggcaatagagccagactctgtctcaaataaagtaaaataaaataaaatggccattgttatttctaactcaacttttatatgagatggtcttagctggatggtttcaggtgaaagagtcagaggggaatggaatgattgcaggtgagaaggtaactctcaagtaaaagctttggttcacttattgctcccattcatgacattcagaaacaagaataatcctaacaatcaatccaccattttgttactgaaccaaccttttacttctgggtctaatatctagtttaaattatttttctcaataaatgaacataaaattgtcttccaatgacaatcaagttgaaattatctctgtgtataaaataattacagattatgaaagaagccagacatatcattttttacctgattcggttgacttctatttttaatttgctaaattaaatgttgtaggaaaaaatgaagagctttgttctaattttgaaattccacagcaaaataattgagtcatgcatataaaatgtccgttaacaagaagacaattgtagtactggttatttttgtttgaaatagaaatatgaaattttaaattcagctatttaaaatgcccgaggctaccatggaatgtacaaggctctcagtgaggagcaacacaaagatttttacaaccaagtgaggtaacttcttggcctaggaatttatgatagagcttttactatgcttttaaaagtattttccctagatataacatcaagttcatatatgtaaagtcgtgaaaactatatagtggtctaattctctgacaaggcaagcttggtattgagatgtcataagttcattcaaggaagccttctgtcaatttccataggattgggaaggtggtgccttgtccatctttgcaggtgttggaaggggagcattattgcatagatctgttccagtttcacagcaacacatagactgtagtgtaaagaaagaaaaagtgataggacttatgtagatatgcactacaagcagttatgaccatgaccagctcttactgtcacttcctgatttaattatcccaacagtcttttgacataaacatcattcaaataaccacagatacgtggcctgaagccagatataacaagaatcagccagtaaagaaataggttgaatttaaccaagtaataagtaactggagttgttactgaacccaaaccaggtgattagaaagttagattcccaggggaattctcattacaagaaccatcttatcagataggtaattggaaaccctgttaaacccaccataacaaaggctcagcaagtgtacatctgcagtgccagtacaatcagtgagtcttcagttcttatgaacgttctgaaatcttttattattaaccattgaccctctaacctcaacttctttgagatgataaatttgtttcctttagtaaataagtaaattcctttttttcctccttcccaggaagtttgagattcatgtataaagatgaagaactaaataatactggctgagccaccctaatttgaaaatccaaaatccgaaatgctctaaaatccaaaactttttcagcactgacatgacgcgagaagaggaaaattccacacacaagtacttaacacaaactttgtttcatgcacaaaattattgaaaatattgcataaaattaccttcaagcttatgtgtataaggtgtatgtggaatgtaagtgaatttagtggtcagacttgggtcctatccccaagatatctcattatgtatgtgcaaatattccaaaatccaaaacacttctggttctaagcatttaggataagggatactcaacctgtagcataaaatcaatattttgggttatgactgggtgcagtgactcacacctgtaatctcagcactttgggaggccaaggtgggaggattgtttgaggccaagagtttagaaccaacctgggcaacatagcaagaccctgtctctactaaataattaattaattaaccaactgtgagtggaggttcttgcctgtagtcctagctactcaggagtctgaagcaggaggatcactagaacccagaagaagttggagattacagtgatctatgattgtaccactggactccagcctgagtgacagagacagagaccctgaacttaaaaatatatatatattacaacttgggactgaaatatttgtttgtatgttaatagttcatagcatttaagataatatgacatattacagaaatttgacagatttgctttgaaatgctaatttgaaacacgtaatttttttttttttttttgagatggagtcttgctctgtcacccaggctggagtgcactggtgtcatctcggctcactgcaacctctacctcctggggttcaagtgattctcctgtctcagcctcctgagtggctgggatcacaggcacccaccaccatgcccagctaatttttgtatctttagtagagatggggtttcaccatgttggccagcctggtcacgaactcctgacctcaagtgatctgcccgccttggcctcccaaagtgctgggattacaggcatgagcgaccacgcccagcctaacatgtaatttcttttagaactgttattttaagttggatctgtaagatagtttaggtttcaaagcaatattgcaatgttcaaaaaaccttaggtttcagcattttcttttttttttttttttttttttttgagacagagtcttgctctgttgccaggctggagtgcggtggcgtgatctcggctcactgcaacctctgcctcctgggttcaagcaattctcctgtctcagcctcccaagtagctgggattacaagtgtgcaccaccatgcccagctagtttttgtatttttagtagagaccgggatttcgccaagttggccaggatggtctcgatctcctgacctcgtgatctgcccaccttggcctcccaaagtgctgggattacaggcgtgagccaccacgcccggcctgggtttcagcatattttttaagtttagtttattagatttataagagctacttaaggacttgggaaggtataacgtgttaggattttaattttatcctgttagcatttgaagtgcttataaagtaaatcaaatgtgttaaattgataaatgcagtttaaagtgttacaggagtaatctgaacagtgattcctcataggggtgaggattgacctgaagagcggctcgagggtactttctagggtgatagaaatgttttatgtcttgattgagctgtcggttatcaaaatccattaaactgtcccttaagatctatgcatttccttgcatgtaaattttaccgcaatttaaaaatatgtgtgtaggaacttaatcagctaatgtatagacagaattgattgtttaatggagttgagtctattcaacttgagttaatcaaacattgattcaaggactcccgagagtgattattcttggtttcataaaatttattagatgtatgaatagaataatgagatcataatttgaacttaaaagcttaagggaaactacatagtgaattgttgacatagatgcagttcttgaacaaaaatcttgatggtctgtaagtctgtgtctattccttctcctagttggttggactcctgggtaaataggacagtcttcctagtatgctgcgtttagcatgcagcacttgactattgatgagtgaatggaacacctctagaggccaactacatcatccttctgtcctccttgtagcactagctcatttgcatagatcagcatgtccgataagctcacaccttgaagggcagaaaggacccttcttgagaagactgtacacagcactgtgtttttatgacagcaaacctcagtagccacaaatccctggaggatcagtaatgctagtgcacacaaggagctccctcccagcctgagggctctgccacccaggtagggctaagaggatggagttgacaaagggaagtcaaaaatgagagagctgtccatcaggagtgttgctgagccctgaatagagatcgatcgaggtgggtctttccttcccccttattataaacctgtacctttccttttattctctaggataccttctctatcttttctggtttgcaaaagaaaaaaatagttagatagtcactttgaatcaggcttgggaaaacacttataaataataattccacacatgtaagatggctaatcaacctaggtctgaaaatgacttaacaggaaaacattttcaatatcagtctctcatgattcccaaacacacacacacactcacaaactcaccacaacttcaaaattagcaaccaaaagacatctaaatgctgtgatctttccttttctcttccagatcagattagctttgctcttcactgtccttttgtcaaagcccctattgtacagctctccagtgtccttcctgcctgcccttctactgccattgtaacttttaccagccccactaccatttcagaagaaaactccaggaaagcaagtaagcatggatagctttaaagatcaatgctgaaggcccactaagaccaggatacaaagggagtcaattagaaaaaggtgggggtcaaggaagaactccccactcccaagttaaactcctcaatttgctgttttgttttagccagactctatggagctcagtcatggctagctctctgcaaatggcccccaaaaggcttttcacaaggggcagtaagatataactggcttcggtatttctgtctccccattcccagataaccaattcaagatgcatgcccactgtaccctgcatgttgttgaaacagaattttaatttcctctgtcttgcaaaaatgttcttttgcctctcttccctggtgccttttctcatcttcctcacccctgggtttcctaactctgtcttgcctactctgatctccaaagaccagtctctccttcatatttggcatgaaaccttcctcagctactcacacagtaattgcctcatttctcaaactctccagagtcacatcatccaatcaaagtactgtgtaatgtgagccacatatgtaattgaaaaattttcaagtaatcacattttttaagtaaaaataatcaggtaaaattaattgtactaatacattttatttgaccccgatatatttaaaatgttatcatgtcaacatgtaatcaatgtaaaaatgattaatgtatgcatttcatattcacagcacatctcaattcagactaaccatatttcaagtgctcaaaaccacaagtggctagtggtggccatattggaccacacagctctagaacttctgtagcccatggtttagcagttaattatgtgtgcacttggcatgttcgctgcttgttctctagtgaagtcattctttctagcaggccaagttctgtttctaccacaggtcctagcatggtgctttgcacattgtgggcactcaacaaatccctaagatttgcttcatagatgatccctgtacattgatagcatcttcctcattcatggaataacaagaatgacctcatctcctctcactttcattccttagctactaacactgttgcaaagatctctggaaaccggaaactttggtcacctatactttaaatggagagagaagtaaaacttgctgctgagaagcaaggactgcatagaaggtttagtttgctggtagaatcaaaataagcactgaatgaagatgtgtgtggttcccagttttataaataggttttgcaagaggagagtgtttgcttctttgtttttggtgcgaaacatttcttcttttagcatgttatctgaaagtattgctgccaaagggatgatttgccagagaaagatggtttctgtccagttccttcatatgtcaggcataacctccaattaatctgaatgaaagagtgggtgcccatgcagacaatgccaacaaatgcccctgtagagaggacacatacagatgccaacctgaaatcagacactggctactgaaacaaaggattgctttaatttttgcagaataaactatttttttcttctgcttttcacgaagtggccctaaagaattcctcttgtttgtggtctcgaaaaaattagaactatgccaatgaggcctgcctttaagggttctattaaacaataagaaggctttgttcttggcaataaaattaaagcaagcagtgtttccattacctggcaggctgccctctcccttcccacaaccctgaccccgatcctgacaaacctcaacagaccattctgtttcccaggtaggaaggttagatggtaacatctgtcaggtttgtttatagaaatatagttgaccttaatgataatgtataaagagggagagatgggggcggaggggggaggaaaaaaagggggtagggagagagagggacacttctccaaataatccttaactcaagctttaaaaaagtcaagtttactgcagaggcttcaagttctcaaaccattgttccagaaagacaataataatttcacaatgagttgaaatgatggaagttaggagtcactagatgaggaaatatacattttggtctgacacgctagatgtcacgtgttttctttttcagggaactttgcctaccattgctcaaacttagacccacttacagtcagttgcaaatgagtgcttgtaggtagattgtgaccctgaagtcaggaatgaccaaggccagtacagaaagcactgtccgatgcaaattctgtttagccccacagttagtcacaagtcattggaactgaaaaattggatgactgtgatgccagctctctctgtcctccatgagagctcaaaatggttatattgtagtctcctctagtgtaagagctcctgcctacagctgtcaaggccatacccatattgcactcacaggtcctatctccctggcctgggaactttttctgcccctcccaggaccaactaattccaaagggaagttaatgcctaccttcccccaacagctttcaaccagctcctgatgggagatgttacataaatactctgcttcttccctattagctggaatgttctgtactgtttcccagagttgcccaatggggttaatctccagttgcccaaggtggtcttggtaagtcacactttactggcttcgtagttgtccctgtttcacttcctacccagtactggtgttttctggcaacaatttgaccatccattcttgtctcatatccttcttggggaggatacaactgccaaccatgtctaaaatgaaatgatagcacaagtctctttttctagtcatggctatagctcacatgttcaatttctctaaactcaagtctctttcattgtgtttgaataaacgtacatgtgaatcactggacatcaaagatatttaaaaatcaatctactcacttctcctgatattctagaatgacaacaacagggcaagatatttcatagatatcacttgtgggtgcgtcatgaaggcagaacaaagcttaacattttccagttgtacctcccagttaagttctatcagtgacgtaatcacgtgtatttcactcactgtacggaataccaaagagcagaaacccaatgttcattttccagaactttgcagaagcagatggcttctatacctgagtaactgaaacccaaaaaggggtccaactcagtatttttccagtacatcacttttcaggaatcatggcacaacaactaaaaggaatgtcacttaatgagaaataacatgtaagattgaaagtgattaaggtaaagtcatagagtagaggtttcctctttccattagaaataacttcccttcccttaaacacgtcacctccatctttcctggcactccattaatggtcatctgctaaaagttattgtttaccctctgaccacaacatcaaatgccaaacacatttgttgaaaattatttaatagaaatcgctacttttcagaaactttatgaaaaagacgtgatagagacaaacacccatggcaggttaagtagatttcttttcattcagtgtgcccagcccaaacggaagggtgtgaagcatttgttttataaagtgtgtaattaataagagaaaggaagggaggagtttattgtttttcaatgaattatgagcaaccccttccattctgcttcttcattttggaactgcttctaacaaagttaccattaaacacaaaaagaaaaggctgtgatattgatgccaagaatataagattgaagtcagttgagtgtagcctaggaaaaacattacagaaggagtaacatttattataattgtgacagaagtcagcaggacatcatggggaaagtgaaaaccataccgcaagtatgttgtcattttcaaattgaaattccattaattcagtacttgtagctattcatgccttaaaagaagaaaactaatatttattgagcatctactatgtaccagattgtttacagatattttcatcaaaagtatgcaaatgaggaaacattctcacagaaattcaaatatttttcatacctgcagtcctctgaatataaagtccatgatttttcctttatgccagaggtcagcaaactgtgacgctcatgctaaatctgactgtttttgtaagtaaagttttatttgaacacagccacgtccatttgcatccgtattgtctatggctgctttcacactacaatagcagagttgagaagctgcagcagagaccgtctggcccacaatgctaaaataattactatctaggcctttacaaaaaaaaaaagtcccccaactcctgctctgtaccacggaagaatgttctctacccttcttcttcccccatccaaaattgcatcaggaggcagccttcaaggaacccagttaggatttaaaagtagcttcaaaaattctggagttaagcctcatgttatagcttccaaagctattattttgatgatgtagatgcatcaaagttttgattcatgctagaaagtcctcaggtaaccagcacaggctgactggtcctagaacctctagttttaattatctatggacattccagataaaaagagtttgttagcaatagtgatcgttcacatttatgtagtaattattacatgccaagcatttgtcaagggcttttcatgttttcactcatttagttctcaccacagtctaacccaggggttctcaatcttgacactagtgggatttggggatggacctttcactgttgtgggggctgtctaatgtgttgtaggatgtttagcagcatcgcacctggtctgccaggtaacaaatgttattttcctcattatgcaggtagggaacttgagatgtagatagttgaagtaaatgcccaataacatacaactagtaagcaataaaaacctggtgtttcaatcccgggaagacttcctcaagtccctgaaccccaaaccactgcctccattagcccttgctccctctaaattattttacctgtttgaagattttgctttactgaaaaactaacagcgacatcaacaacatcgtgaatggccatgttctgtatgctactattggaagtaaaactcctttatgtgaagtttcaaagttttaggcattagcaatggcattttttgctaggcagttttattgccttattacagttgtatttcattcataagaaagaatttaattgctctactcaccacagtgtgttgccatttttgatagtgtcttgcttccttgtccagcactcaagcttcataatcttagaaacctcaagaaaagaggatttatcatgaggttcctcggagctatttttttagtcccatagcaaattcccatctggataatcaatatgtagaattgatctcctctggtccaaataattttccactacgtcactatgctaaagcaggattacatgtagcttctagttgtatcactatatcactgctattacttcccaccaaaagcactttatgaaaggattccatttttaatttttctgaaaagcctttcttggagtttaaaaagatttgatcaaaaatgttaaatattaaattaacacattaaacattaaaaatattgtcccgtactctggtttgtcctccaaagacagagacctcaggagccaggccattctctctctctctcattcacttgagccaggtccacaagtatttgactttggtgtgaaagagtttcagagtgaagattacatataaacatatcagatgaattacggtaatattgtctgctgttcctcaattctccttggctcagttttatatacagactgaagtattagaatccctttcattgttcctctggcagctctgtctaacttttgccccagagtctggaatgttcatcacagctgtctttggcaataaaacccaaagcaccctcatatcatcatatttctttttgcacctggtcagtggtacacagcggggtgtagagcccacttgcatacagttttctccctgtaccctcatccacaggccaaatatcagcttatataaagctctgttttgtttcagttacttcagccttgggcaaattggaattaactcctccaatgtttttcctttggagtgagatgggatggttatgccacattatgtagtaccactaaccccttcgaatttggatgcagactcaaaattacatattcttagttatagagaaaagtccttttgagtctaaacaataacaagaacatcaacctagcatcatgtataaaaatgtttcagcctttctcaagatcaccttaatttgtgaccttggaatggaaggtcacatttattcaccgtggcatgaaacagcttttgtttttgccatgaggccgaatctaggcaaacttgtaaagtagacatttgtcttttaaactcccaactccttggtaatggtttcaaagatggcaaggttcagaatcttaaactaaagggttcacagtttgatggtgcaatttcaagagtgcagtaatggtgggccggggtgagagaggcacaactcaaggggtctaccattcttgcggaattcaaagtgaatagtagcctccggatttgtgcagtgcagcaaccctcttctcaacacccagaaatagaatatcctgtctccaacacgttggggttatcctgtcccaagcttacttcagtgtttccgtctgtgtacgaataagaagtgatatatcaagtcagtgtgtcattttcacaagaggaattataaggctgtattctgaaagtctatggatggctaacttatttcaataaagcactgcaaagtgagaaaatgagagtttctaaaatgcatgctagatcaatttcacctgtgaaaactggccagatattttttttccttcactcatgctccatcctaagagttccaaatatttctaaagattttaagcccacacatgtctgaaatctaatgatgtttatactctgcactgaacatctcattttgcagttgaatacaagtcaaattaaaagagccaggttttagaaataatacttaaaaaccacttacagactgctaaagaacatttcacagacacctagtccaatttctagtatatgtatgtaactaaatccctttaatgtttatacatatatgacaaggaaaaaatatttgtcctctttaccccacccattcctcaaaacactgtaacactattacaccataaaacttagcagggagactttgggcgttgctaaccaagtgccctcgagaaaatagctaatccatttatgtcatcattaactaatctggggaatgattacgcgtaactgcatttctagaaagggaaggtaaaccgtgcacccagtagcaacttacatgggactgcaactgattattggtggcagatatgagcattaatgaagccgagtgaccctcaatgctgaattccatctcaggactaggcaggccagatatgattgttgtgcttctacattcacatcattattcaattttgtaatatctctttcatcagactgtaaaggatcagaaagtcattggcagagagaagcagcagtattaccctaggaataggagaaagtgggtcagcaactccctacaggcaagactgatggggagaagatgcatttcaagacgcgaaagaaaactgactctagatgtagagaaggtatgtgctgagcagatgggtgaggtcaaaaatgagatgaggtgaaagtgactgagtttctcatactggtgggctaatgtgatatttgctcatgagtgtacttgaggtgagaaaaaaccatagtattgaggagcctagcctgagatctcggctcactgtaacctccgactcctgggttcaagcgattctcctgcctctgcctcccgattagctgggattataggcatgcgccaccacacccagctaatttctgtatttttagtagagacagggtttcatcatgttggccaggatggtttcaatctcctgacctcgtgacccgcctgcctcggcctcccaaagtgctgggattacaggcgtgagccaccgcgcccggccaggaaggcctaattttaagctgtatttcatcctgagaagtcaagtgccccatttccagtgtggtccaaaggcaggagacagtaattacccaccactggacatcattcctaattatcttcatctcactcttgccgttagtttaggggccaaggaggagactgatggcacaaaagtggaaagaagagtttgaacttgttttctgcatccttagattggccctcctcagagcacttccatcagccacaatgatttctgaatcaaaagatgtgaatcagaaatgaaagcaaaaatcataaccaggagctgctagcttccaaaccaaacctgggaactagaaacaccagaacataactgcaagtaaccaataaaccctgccatatttgaactaatagaaattaatgagaaagtccaatcaaatcgttaattctttgtttaagtgacacatgaaacagcaaaactgtggaaaacttctttgtagtagaaaaaattctgaaatatagaatagtatttaacttgttttattgtatcttttggaatataagaatactagagttacaagaatttggaaattcatcaaagtagaaaacaagattcaacttccctggtttcaaaaggaaagctaaatctgtattctctgaaagatctaggaaaaatacttggcctaaaatgaatagatcctgttcccaaatttctaggaatttacatattggggtgatggtgattgtgataccagttttctcaaaacacatttgcctcaacaaggaagatttcagcccacttttttggtaaagcaaacatatccattctgtaaatcaaatagtcaaaatttggattaaattgagccccatattacaatggcaactgggatactttttctaccatgcagtaactcaactcccaatgattgtgagagtgaatggaccctaaactaaatcataatctgtttacaaaatcccttctcaatgcagacaacagtacctcagatttgtcaatggcttcataagtttaggtgtttcttcatatattatttcatgtattcaccacaataattccacacggctaagagagcagatattattcagctcattttacaaaataggaaaactcataaatggagatagcctaagattttcctaatgtcaccatgtgggtatattacacaccacatttcatttcacagcccgtactctagaattagcagtgggttctcactggacttagtcaaagccagaagagcttgaagtgtggaatatgttagtgacaacattaaaacttgaggacctcacaatgtggtcaattgatttttgacaaaggttctcagacacttcagtgaaagaaagaatagtctttcaaaaaattgtgctgagacaactggctatccatataaagttagaagcctaccctcacaccatacacaaaactgacctcaaaatggctcatagacctaaatataaaatataaaacttatagaggaaaacagaacagtaagtctccatgaccttgggataggcaatggtttcttaggtacgacaacaaaagcacaagtaacaatagaaaagtagataaattaacttcattaaaatttaaaaatgttttgtgctttaaagggtatcataaagaaaatgcaaagataacccacaaaacaggaggcaatatttgcaaatcacatatttgataagggacttgtattctgaatatgtaaagaaataatacattctattaattaaaagacaatgacccaattacaaaaggagcaaaagatccgaatagtcatatctccaacatagatacacagatgtccagtaagttcacgaaaaagatggtcaacatcattagccatcaggaaaatgtaagtcaaaaccacaatgaaataccacttcacacccactaaaaataaaataaaattaaaaagacatacgataacaagcattaacaaggatgtggagaaattggaaccctcatgtatttctgatgggaatataaaataatgcagccactttgaacaatagcttggcagttccttaaaacattaaacacagttatgtgacccagcaattccacccctatatcaaagaaaaatgaatatatatgggcacacaaaaacttgtacatgaatgttcatatcaatattatttatagtgaacaaaaactagaaacatcagtgtgcatctattaaagaagagataaaaagtggcctgttcatacaatgaaatattatttggcatagaaaggaatgaagtactgataaatgctaccacacagatgaaccttgaaaacattatgctaagtgaaagaagccaaacaaaagattatgtattatttgattccatttatatgaaacgtccagaacaggcaaatccataaagagacagaaagtagactagtggttgcctcgggctggagctagggcaggtagggaaaatgtggagtgactgcacacattatgggtttcttttctgggcactgaaaatgttctaggcttagattgtgatgacgattgcacatgaaatcatctgtgaatacacgaaaacccacaaaactgcacattttaaatggacaaattttatgatatgtgaaatatattccaataaggcagttttaaaaaatcaattcctggccaggtgcagtggcacactcttgtaatcccagcagttttaagaggccaaggtaggaggaccacttgagcccgggagtttgagactagcctgggcaacatagcaagacctcgtctctacaaaaaaatacattttaaaaaaatttagccgggagtcatggcatatgcctgtagtcccagctactcaggagactgaagggggaggattgcttgagcctgagaggtcgaggatgcagtgagccgttatggcaccagtgcactccagcctgagtgatagagcaagagcaagaccctgtctcaaaaaaaatcaactcccttcctccctccccctcaaataaaacaatccttaggtcataattttgtgtctacacagtccttggaaaccaatccattacctgcatgttgagtgattactagtgataactacttgctccattacatttttgccctgtctcttcttggaaggtcattttccctatttatttattcaacaaatattttttgaatgcctattttgtgccagacatggcaccaggtgcttggaatagataccttatttaatacaacagctgaagatccctgcccatatggagcttacattctatcagatttaactcgtattctcaagtacaacttagctcttcgggtttattctagtagatacttttcaagtgtggggtctgtcaaagaaaaactagagctggacagtagttaaagctgtaaaaacattttattcaggactattgtaataaggggaaagagacctcagtatagaatgggactcaactcccaatgtcacgtggaccagtggggatttacagccaaggagcagggtgatgataagtggatggaaaattactaagaggaaacatcaggggtaagggagattctggttaaactgacctaaaaggattcttgctgaaggtaggccaagttgatcagacatcctctggggcatggtgaaggatgaagaacccaatcagatactgagagtgatcagatatggagatggaggattctggctaaaccaactcagcagggttcttgctaaaactggtttacaagaaagtgcgcagaagggcccaggagaaagttcaacactaaagtttggtcgagcaaagaagcttcgtcagtgctactttctagaaattttacttcctccatcataatgtgctcatgttatcaatatggtcccatccttttcataactcagttgtagtcagttattaaattcagtttgaggtcaaaaggaaacagaagaaatttactgagtgtaagtttcaagtaaatatgtcaatagctaaatttatttgagaaacctcaaggggagctagaaatgatgacataaaaataacaataagagaaatgaagcctaatgattatcctccttgaaatattagcctgagttccacatttgtacttctcagtcaatgcatttttaatttttctctttgttcattaaacaaatacttagcaaataactctgtctgctaaactgatgtaggacataatctcatggtttactgcaaatggccaatgactatcatcttctcaataagatgtcttgagtagtctctatgttatgtctgaacaatgatcaggaataaaattcaaggaatcctgggcctctggaaacaggacatggtttctgtgaacagccatcagtggatttttatcttgaactcatgaccctacttccagtttatctcattcatagagaatgaaattactccaattaaagccttccaaatcaaaaaggctagggactgggccatgtctcctccctgagatatgctagaataatcaatgccattgtcattctttgtaacattgcaacttctcctgtggctgtgttaaaataataaacctcatgcctgctatctccatctctcacagctgtggtttctgggtttctgtttgtgaataagcatttcagaattgccatgagatggaggaaatagcatgtgcagagtatttcccaggcctagttgccaagaatgagctaattgtaagcctcccttgaatgcaagtcacaaaaacttcaaatacaagccactctaatgatccacctttccacatgaatgttatgctttcgttgtagaaccttgatctttcagaagtatactaggagtataattttaaattatgtcataagattaataaactattgaaccatctttttgtgctttttatgttttatagtgattagatacaaaattgatgtttgtatttaagagaaatgtcaaatgtgatacaggcttgctacattgcttacggaaaatttgtctaaaagagattgatagtaatctgtcctccataaaagaataatattgattttttttaacttactttttttatgtttaacagggcaaatttgatactttttaaaaatataaaagtaggaattgcaaatatatttcacatgacacatcattttccaactaattggtaatggctatgtacatgttatgttaaagattctgcagctgagtctggcttagtagaaaagactgctgtcattggataataatgttttccaaggatgcaaattaggaagtggccatgtaagtcctatatttgcaatccttgcgtaatcggacaaagagttaacatttaaaatatcttttcagagattactagaaacatcctagtatacattaaaaatagcacttaactgaaaaacaaaggccaaattaacacttaccattgtacttatcctgtaggtcaatgcatcacgtcaagaagccaaattgacagaggagtgtgatcttctcattgagatcattcagcaaagacgacagattattggaaccaagatcaaagaagggaaggtatgatttctagggcagaagatttcatattctctacctggagaaaataaatcctaatacactccagggactttggaaatgttgagaaccctctttttctatacattctataattccctcttaagtctttaagacttagttaaaaggcctttgcttggcagttttttctccatccttttctttgtactatggtctcctgtgaagacctgtgatacaagggctgctccattgcccagcgccaggaggtagcataaaggtcttgtctatcatggccattgttttctatctcacttgtctatgagaaggtgggttctgtggaggcagagtttattttgtattcattgtgatatcctagaaactagcatagcattacataaattaaaaatgaatctgactttatttatagaaattatgaagtactttcccatgtttttgaggaaatgtatacaggtataacttcatggtcccaaaacccctggggtttcactatatcatatactcctttgtggatatagtaataatacttcttttctaatgttctaatgtttctatgttttaatttcctattgttttacagcaaactatatttttaagataaattgacatacattctttatagctgctttcttatttattcaaaattcattcacaaactgttggtcactttataatccatcagtttattctattttaaaattagtcatgtttttattgaaatacttatgatccttttaattttacccaattctctgccacattcagggataatttttctttcttttttcttcttctttttttttttttttttttttgagacagtctttatctgtcacccaggctggagtgcagtggcacgatcatggctcactgcaactgccgcctcccgggctcagacaatcctcctgccttagcctcctgagtagctgggactacaggcatgggccaccacacctggctaatttttatattttttgtagagacagggtttcaccatgttgtctaggctggtctcgaagtcctgggctcaagcaagtcacctgcctctgcctctgcctcctaaaatgctgggatgacaggcacgagctactatgcctggccaaggataatttttctatggatttttaaaaatagaagcgtttatttatgatccaataaattcatccatttctattattattgttcatagttgtactttaaaacaaaatatatataattaaaacatactagcaagttttaagtgaaacacagagataaccgtggctaatgtatgtggttttctgtgttttccacaaaatttaacaggtaccttctaatattgtacaatgttttagattactctgtctatatagattacaaaatatttatacacataaattattaaaatgatctaaaaaatagtgaaatcaaatagttattgatgctggtatagtagattaacagattaacatgaaattattccctggccaaggactcacatgtgccgaaaagctacttttccccacatacgaattgtccaatttagaagagcactgagtgtccatctggaatccttacaggatatatttcatcttccatcatcatcgtgcatcataggtgcacatctcttaattctggaagtattccaggttctcagacacatggccacctgaagtacagtcacaattaattattcatatgcatacagaaggtaatttgctatctttacatggttgcatgcagagattagctctcagtacacatattagtttattttcatttttaattttaaattgacaaacatttatatttatggagtgcaaagtgatgttataatttatggatgaaatatggaataactaaatcaagctaattaacatatccatcatctcaaagccttttcttgtggtgagaacatttgaaatttacttgcttagtgattttgaactgtataatacgttattatttatttgctgttttcaccatgccatgcaatagatctcaaagtaaaaaataaataaataaataatttttttgaaaaagcacttcctcttcctctctaattgaggttttgcaccttactcttactagtttcttattgctgcaataacaaattaccttaaacttggtggcttgagacaacatagatttattatctcagtgtgctgaaattcggaaatccaaaaatcgatctcactgggttaaacaaaatcgacagtcaaggttttggcagtgctgtttctttctggaagctttaggggaaaatccattttttcttgccttttctagctcttacaggtagcctgcattctttggctcatggtctctttgcatcaatctgacctctcttcccatcctcacgtcttctctgacacaggccttcctgcctttctcttataacgacccttgtgactacattgggattacctggataattcagggtaacatccccatctcgtgatccttaatcatgtctgtaaagtcccttttgccatgtgagtaacatattcaaagattcctgagattaggatgtgggcagcattgagagcccttattcagcctgcaagggcactccaccacaacttcctggctagcttgccttcccttctcttacttagcttggacttcccaccaccagggtttctctcatgagctagatcagagtagtgcaggtgtccccaagttccagccatagtgatgcatggagtttatgcttcggtgcactcgttctaccccaaatacatgtcagtaataaagaacttaataaaatgcaaaagcaaagacatatagctgaaccaaaaacaagataaacatctccacaggccagaaatgagacaaaactgaaaagccatgactgtggctgaggatacaggctactgggatttggtctggaagaggccaaagtagctttggctttagctcctgtggataaatagttcttgaagctttggggaaaggacctagaagtgctccagatgggatggggaatggaaatcaggctcattatttaatgccatgggctatagaaggcttcatgcttcagtcaaaaattattgccaacctttccctcatatcatagcttttagcaaagtcacattgttagcttgaagcctgtgttcacactgtttctgatacccacacagaacaggagcacagagataaggatgggattcctgaataatgacctcaagggccaggtgaaggcaactggaaaactatcagagcagggtaggctgagcaaggagggtgagagaggaaagaattataaattacttccctttaaaactgaaactctaagtttaatttcaaagtatataaagaaatcttaaatttctaaacatacagccagcaaaatcagcagacaacattatcttaccccagataaaattaattttataggaaaataagaaaaagactttaaaagaagtagtcttaagatgttcaaagaaagaaatgaaggaataacttctctttcaaaagagcaaaaaaagtgaagccacaaaagaaggaaatgaaataaaaaaatagataggaaagcaacaaattagcagttttggagggaaaaatatagatattgaaattagaaagaaaactcagctgcagtggaaatttggaaactgagttttggtcaccaccttgggaatgccataaaacgcattcttttacgtctgagtgacattaaagtttgacaaatgccgactgagtttgaactcaaaagataggaaagtatataggaaaacctacacatggggcatttttaaaataataatcatgcacttggttgaaagcaagtatttcagcaaatttcaaaaactgaataccatagaaccctgcctctaagaccacacactgtatctcattagatattatcaacaataaaataatagtttctatagttttttgacactaaaatctattcatatataaatatatcttcacagtaatattttttaaatgtagaagtaaaccacagtaaaagaactataatatatcataagtagtaagcagcaaaaaagtatctgaaggcaaacttacaggctttaattcttttgaaaaagaggctgggcatggtagctcacacctgtagtcccaacgctttgggaggccgaggcaggaggattgcttgagtccaggagttcaagaccagcctgggcaacacggcaagaccctgtccccccacccccaaaaaaggtaatactaaaagtaaaaaattagctttcaaataaagctagaaaaagcacaacaggataaacccagtgaaagcagaggaaagaaataaaggaagaaaagtaaatgaaagaaaaacaggaaacaaacaagaacagctgtcagcaaagaacaactcgcagcctaattttgaaacatctgtgaataaaaaaagtgccttttcccccatttttaaaaggttgttaaaaaaaataaagaaaaacaatatatgtgtgacagagacagtatgtggtcttcaaagcctaaaatattgactatctggtcctctacaggaaaagtttgccagcccttaatcaggaggagttttacttgtaaaaaataatttaaaagaccaatctgtagttaaggttgatgaaggaaaaaagagtgtggggccccataaacaaatataccataaatacagtagagacttttttaaacataagaaaattgtgtaaatgtcttcatgccaataatttgaaaacttacataaagaagtagcggaaaacctgaataaaccaaaaatttaaaagcagaagacatttaataagtcattgaaaatgtccatcaacttgcatttctgccccaaaatggcaccagcctcccacagttctatagcttactttaacagaagttccaggaactaataatctcattctcatataaactacttcagaaaatagaaaaaagacattttatgtagagtgtatgatcttgataccaaatacatacaacattaaaaaatctagagtgagagaatatcacccatgaatatagacacaaaaattttttttaatatgagaaaatgtaatccatcagtgttttattaaacacatcaaaatagcctttattcttataatacaaggatggctcaactacagaatatctgttaacagaaccacattaacagaaaacatacatatgatcccagagtaggagggatttttctttttagaccaaacaattttaaaaaaacaaccataaagcaaagactgaaacatctgacatagaataagatcacaatacaaaagccaatttcatttcaatatattagtaacaattgaaaattgaaatttaaaaaaagaaattccatttaaaacagcctcacaaatatgaaatacttagtgataaatctaacaaaagatgggtgagacttgaaagaccttgaaaactacaaaatattgctgagagaaattaaagacgactaaaaaatgaagccatgtatcatgttatggggtaaagactcagaaaagttatgatttctgttctttccacatcaacctgtagattcaacataatctcaatgaaaattccagcaggttattttgcagaaattgacaagccgattctaaagttcatattagaatgcaaaggatatagcataatcatttaaaactttgaaaaatagaccgggtgcggtggctcacacctataatcccagcactttgggaagccgaggcgggcggatcacgaggtcaggagatcgagaccatcctggctaacacggtgaaaccccgtctctactaaaaatacaaaaaataagccagacatggtggcaggagcctgtagtcccagctactcaggaggctgaggcaggagaatggcgtgaatccgggaggcggagtttgcagtgagccgagattgcgccactgcactccggcccgggcgacagagagagactctgtctcaaaaaaaaaaaaaaaaactttgaaaataataacaaagttggagaactaacatcagctgatttcaagatttattataaggcttcagaaatcaatataaggtggtatttgtataaagatagacaaatagatcaaaggatcagcaaaaagacttgagaagtagattcatacatatatggacaagtgattttcaacaaagatgcaaaggcaatttcagtggagaaaggattgtctttttagtaactggtgctggagcaattggatatctgtatgtaagaatatgaagtttgatccatacttcacattatatacaagactttactcaaaattgattatatatctaaatgtaaaaggtaaaagctgtaaaactcctagaagaaaacgtggaggagatcttgaccttgggttaggcaaagattctttacatacagatgacaaaagcattatccataaaagaaaatatttatatgttgggtttcatcaaaattaaaaacctcttcagaatgcactgttaagagactgaaaagaccaaccacaaactaggcgaaaatatttacaaattatttattttaataaaggattgtatccagaatatataacaaattctcaaaactcattaataagaaaacaagcctttcaccaaaatgcataaaagatttgaaaactttaccaaagaagaggtgtggatgatgtattacttagggttctctagagcgacagaactaataggatatatatatatagagagagaggagtttattaagtattaacttacacaatcacaaagtcccacaataggccgtctgcaagctagcagggagagccagtccgactctcaaaactgaagaacttggagtccgatgttcgagggcaggaagcatccagcatgggagaaagatgtagacggggaggctaagccagtcttgccttttcatgtttttctgcctgcttatattcgctggcagctgattagatggtgcccacccaattaagggtgggtctgccttccccagcccactgactcaagtgttaatgtcctttggcaacaccctcacagacacacccaggatcaatacttgcatccttcaatccaatcaagttggcactcagtattaaccatcacagatggtaaataagcacgtgaaaagatggttcagtatcattagtcattaatgaaatgcaaaataaatttcaatgagatactgcttcctacctactagaataattaaaattcaaaagatggcgcataccaagtgttggcaaaaatgtgaaggaaccagagcctctcacaaactgctggaggtgggaattaaagtagtacatgctggaaagctggcagtttcttaagtaagcatacacttaccatatgatccagccatttaggtatttaccaagagaaaggaaagctatgtccatacaaaacttgtaggtgagactggtcacggtggctcacacctgtaatcccagcactttgggaggccgaggcaggtggattgctttgagctcaggagtttgagaccagcctaggcaacatggtgaaaccctgtctctacaaaaaacacaaaaattagccaggtgttggtggctcactcctgtaatcccagctacacaggaggctgaggctggagaatcgcttgagcccaagaagcagaggttgcagtgagctgaaatgatgccactacactccagcccgggtgatagagtgagaccctatccaaaaaaaaaaaaaaaaaagacttgtaggtgaaatttcatgttaattttacttgtaatagccccaaactagaaatggcccaaagtccatcaacagatgaatgggtaaacaatttgtgtcataatcacacaatgaaatactctttggcaataaaaaggaataaactagttacactagttataatgcaacaacatggatggatctcagtataattaaggtgcgtgaaaggagtcagacagaaagtagtatattctgtatgagtagattcatatgaaattcgagaaacggcactttctactaatctacagtgacaaaaagcaaatcaatgattgcttttagggatgggatgacaggaaaggatgggcacagttaattacaaaggggcaggagtaaattgtggggcatgatatatatgtttattatcttgactgtggtgactgtttcatgggtgcatacatatttgaaaaagtgtcaaatttgcactttaagtatgtactgtttatgatatgtaaattctatctcaattcagctgtttattagacatataaattgtgtattatataatgaaaaagtcttcagaaattaaaattaatgaactagggtgatatgtattagcacggacaaatcacaaaaacagaagaaagttatataattatttgtacaagcattatataaaatttaataaactaccaaaaaatcccatacattgtttaggtatgtgtacataaacatgtttgggagtgatcagctctaaatttgagagggtcttttcttctggagagagacatgagtgagattataaagtgccacacagaggctttaatgctatcaataatattttaccaccaggtgtggtggctcatgcctataatcccagcactttgggaggccaaggcgagaggatcacttgagcccaggagtttgagaccagcctgggcaacatagtggttccccatcactacaaaaaataaaaataaaaataaaaattagccgggtgtagtggcatgtgcctgtgatctcagctagtcaggtggctgaggcaggaggattgcttgagcctggaaggtcaaagctgcagtgatccgtaatcatgctactacactccagcctgggtgacagagcaagaccctgtctcaaaaaaaaatcttttttacttccttttgaaaactctgaagctcatatgatgaaaatactgagatttagtaaacctggtactatgtacaggacagttcattatattcttaaattttttgtatgtatggaatgcttcactttttaaaaagtatacatttgctcagcaacattatctcagaaggcaatcttagaaagcagatgttacttgggaaagatgagggccgcactccttttctcttgagctagtactttggcacatgaccaaggactagttcattccaaaccctgaaactcacagtgactcaagtccctagccagggcatattgtgtcagaggcctgtttttaagaggaagggtgtgaatgccaacccgtggaaatctgaggtgccagacagggagggcaagtgtggacttggggttcactgggggacttgggtccctgcaccccaggatggcagtggcaactgagggcattgagtctaaagaacggatggtggggccttctgacaagcaattggaagtgggcaggtggagcaagaaccaggcagaattgtggagatcacaaaagtgagtttcatcaactgccttattttgcccctgtctatctctgacactagtcactcagctgtcaaactcacctcaaattctgcaattgacgaggtcaccaagcaggtgatattattacacgttagtacctactgatgattcctgctcttggaccattgtacattctctgaaacaaattaactcgacagcctttataggtgggcggactggagagtcttaagccatgaggctccctggaaaagaattttcttctttttttcagtagtcggggataagtttcatgtcaacacacaaagagctaaattcagattgagttcattcatttaatgttcagacacagagatctatggtagacttctgaaggccaaagctcaacaaaataagggtcccttttcttcactgccttttatgtacactaaatcttaaaagtttaagaaaattaacttggactaaatgttgagctctccatggccttaaagagatggtgagaacaggcctcattttcagttcagatacttgtgtgaattgaggatgcattgtttggacctaattgttttgggttgtgtatcctacatacatataaaaagatttatataaaaataagtgtttaaaacgcatttcaagcaaaataaagcggcttttaaaagaatgtgtaaggtataataaacagcaaataaaatgatataaacagccctgtgtccctgctaaaaggagattccagcaggcaaactatttccatgactagtagagagtaaattccaaaagttgcaatgtggtaatctcacttcccaaaggaaaaatgaagagttgactggaaaatatttcccttgcagcattaaggcagacacatacagaatctttttatgtgtcagtatctaatttttttaaacatcaaattttattcaccttgtcaacttttaaaaataatacattaaaaagtgttgtctaatagaaaactaagtacttcgctccatgctgggtgtctgagtttgaagtgctgtgacaagtaggacagtgtttcagagtgtgctgcaaatcagggccatctgactgtaatcatttaagccaggggttagccgacttttctgtcaagggccagataacaaatattttaggctttgccatacggtctctgttgcagcaactcacttctgcacaacattgtagcaagaaagcagccatagattatgtgtaaccaatgagtgtggtagtatgccaataaagctttatttacacaaacaggctgtatgctgatttggcccacagatcacagcctaggaacacctaacttagagcagtgtttttcttttttctttttttttttactgtaacccgcagtaagaaatatatatgacatcacaatacagcgtgcacgcatgcacacacacaaaaggttttacaaaacccaacttgccttttctaccaggaatgcactctgctatttgcttttctcctcttctatttggttttttaaaggctagtcctgactgtcctaatgattcatcacctgcaggcttaaaaacatttgttgcttgttgaaatggaaattcctcctgctctgcgaattacaactccttaactcaaatattggagcgtagacccaaacatctactgtttttctttcaaaatgatgcccagctgattcttttacactaggtttgcaaagctcaaatcagatgtatcagatgaaattgtacactaacctataactaaaattatgcccaaaattgttctctgtagaacattccgatattttcacaggcgactctcattttgtcttgctttaatttttgcatgatttagggctcttttattctttttcctgttatgtcacttttaatgttcaatatcatgatagaaaaagaaaagaagaaactggagttcaagcatcatcgcatttgaaatgtgtgtggtctttaataggcatatctaaaggataagtagttgtcatgaagttattctaaaggaatattttgaccttattttcttttgctggaattgtattaaacatctgcaattcggccatgtaatttaaatgattctttatgctgtgtgattaaatattccattcacttggtttgtcctgtggactgtaaattagttttccttctggaattttccttcctctgacagtttcttatgaacatgttctaatatcctgcgcgtactggatgccttccttagctttgcctccagatagaatgatgccagaggctaaattctatttggtgtaaaataagtgttattttattccactaatgaatacaattaatccactggggacagtaactataattataatgcattaagtcttttaccaggctcacgatcctatattatttgccctaaagttttgacacttcattctctgactctttcaggaatttttttcacccttgcctgaaatcttgtgcctgctgcttctaattcagtatgaatttcctttgtttgcttatagtacatacttggaattggatgttccttagaggcctcaagttctgacatctctttccttccttttcttagattagagttatacagggatggtaatgacgacttggagaaagaaagaatttcttggaattagcaggaattctggagagagccttgggccagccttgtctgtaagacagattgactggtctcctccgtaccctttcacccagggctattttccattccagaattatcataaagccggttgaaacctgtccctgggtgtgtggttgggggcagtaggcacacagcaattccaattagctgtctaattttaacttggcttctggctagaggacttcatctcacagcacatttcaaacacaagagcgaacggtcaagtgggttaccttggacttatcttggcctgccccggaggttatggtcaattatgtttgagggacattttcaagcgagacagaatcaggaattggaatggaggttgtgaagcaatcatgcgtttttatcccaactgggaaatgcttatcaaaatagttcctagttatcaagtaagcacaaagtgcctggaaatgacgttcccagtgaggggaaatggcccagctgtgctttttttggctttctctcatctgctcaacaggaaaaatattaatcaatgggaaaaatgctccctttctgttaatttaacacatgagttttaggtagtgtgggaaatagtaacacttaatgctttccattctcgattttattacatgaattacaaaaaacactttttagaaaatggttttcatttaaaccatagattcaccacctataaagatgttttatcttcttgatgaaaagaagataaacctgagatagagaaagttccagggttccctacagtcttgcagtcattgtgtggaatagtccagggaagacgtctggtgaccctttgtaagttgccactgggcaacacctttttttcccatcaacagggaagcaattcacaattcagtgtttcctcgtaaaacgaattagcaatgcttctccaatgagataaggaatatctaaaccagagtcccataacggagctttccatattttgatatatctctatgcctactttttgaacttttatggaaggataacacaacaaaatgaaggatccagcctgatgccttttcattaagcaagaccacccatgtaaccatctctctccatgcctcttttgttcaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagaggtgagtgcaggggcccctgggaatttctcggctgctgggctcttgtatctgcgctgtgattggttggtcttgccctcgccttgcttttattttcattttcaaggctcagtaccagagagaatagaggctttgagctgttttgttccagctaaagatgcttccttttgacatgtgaaagccctttcagtaacagcctggagtctggagttcaaggcctttgaaacaagagtccaccagttagaaagaataaaatcaacctgcttttggacgaggggggagcttatgatggcacaaaaacagcatttattgtgactctcagatgtgatgttatcgtacacttgataacaaagagtcaaaatgaaggcaaaaacattaaagggaatattttcttccatcacagggctcatctatttttttttaaaatcacacaggtgttgttctctgttaggcccattttcatttggttgaggagcttggcctcacctgaaaaggtcaaggccaactcacgcaggagagaaaggaccaaactgtcaacctcatacgggcttcttttaaaatactctttattctcaggtagggagctttaatgtgatgttatctgaatggttggctcagcagtaaaactggcaaagataagtattttttcggcacacatacttggttggtataaaaattgctcatcttcactgacacaaacacctatagcaattctagtggatccaaagaaaagcactagccgggcacggtggctcacgcctgtaatcccagcactttgggaggccaaggcgggtggatcacctgaggtcaggagttcgagaccagcctgactaacatggtgaaacctggtccctgctaaaaaaaaaaatacaaaaattagctaggcgtggtggcaggcgcctgtaatcccagctacttgggaggctgaggcaggagaattgcttgaacctgggaggcggaggttgcagtgagccgagatcgtgccactgcacttcagcctgggcaacagagcgagactctttctccaaaaaaaataaataaatgaaaaaacaaagagaagcactaggctgggccaggtacagccaatgccacataaatgacatctctaactcaggctaatggccttgacttcattcattctaattttcagagtcaactgccctttatccaaagcaataatagaatcctatctctagaagaccccagagagctcatgcatgctgatcttcatcctagagcagagatcagcagactttttctataaaggatcatcaagtaaatatttttccgctttgcaggttgtaaggtcttggtcacagctactcaactctgccattgtagctagctctaaagcggccatagataatatagaaacaaatgggtgtggctgtgtgccaataaaaccattacaaaaacaggcagtagaccatactttgccaacccctggcctaggaaaaaaaatactcgccatcttatgactcaaatttattcaaagaaagagaaaggaaactaacatttattgagtgcttgcttgtttcggaaacttgtgctaattctcaaaatatcgcatagaggaggagtgattgacatctccattttcactcttcttaaagagtaatgtatcgtgtttttacaactctggtctactgtccaatcggcttgactgtattatttcttatatttgaggaaaattccttttgtagctgattagatacttatctcttctaaaaggcatggataacagctggctatcatccctgttatgtacttaagatgctctcctccttactctgagaggcccatttctttcctcctgattccttggttccaaatgtttattttccctgggccatatccagttgctcaatattcaccctaaagttaaaaactgcaaatagcactaatactccagtgtacctaggacactaatagatagcgtttacacttaggtcacggtttccaaccggaatccaggagtacttttctccatctatgaactttgagatgtccagatgaaatggctattatgaactgcattcctcatcaatccctgaagattcaaccaagtgtcacatgaataaattcttacctagtgaccagggatgatgtgaccccataacagttattgctgaaagaagatatgcatctgaagtatagcacaggtgtgggaatgcccacatacaatctccctcagttccagtgggacgtatctgctcccattcagctctctctataacaagcccaactcatcaagagcaggaacatgactttgatttctctttctacaaagaatgtgcttctgtcaagtttgaattcacagagcctgtaaaaatttgccaagagccttgtctctgtttctgcagtcccctctcctcccatcactatttgtcaatcctcttggctaattcctgagcctttctatccttccagcagctaggatatagaaaaaggacactgggcttagactagaagttggcagacctgggttccagtcctagcactgccactttttaactatgggtctttgagctattttctacttagaaaattgggttcaggaacagtttggaggttcctcaaaaatccaaaaattaagctatcatataatccagcaatcctactgctaggtacatacccaaaagaaacgaaatcagtatatagaagagatatcctcactcctgtgtttgctgcagcacttttacaatagctaagatttggaagcaacctaagtgtccatcaacagatgaatgaataaagaaaatgtggtacatatatacaatggagtactagtcaaccataaaaaaggatgagatctagttatttgcaacaacatggatggaactgcagatcattaagtgaactaagccaggcacagaaagacaaacattgcatgctgtcacttatttgtggaatctaaaaatcaaaacgattgaactcacggacatagagagtagaaggatggttaccagaggctgggaagtatagtagggagttgtgggagtgggggtgggtagggatggttaatgggaaaaaagaaagaatgaataagacctactatttggtagcacaatagggtgactatagtcaataataacttaatcgtatgtttaaaaaaaaacttaaaaatgtaactggattgtttgtaacccaaaggataaatgcttgaggggattgataacttattctctgtgatgtgcttatttcacattgcatgcctgtatcaaaatatctcatgtactccataaatataaacacctactatatacccacaaaagaattgtttttactaataaaaaaattatttaaaaaaattggtttcagaatagctgtcactgttgtgatgacattgctttaagttcctaagaacaggtcattagcattatagctactccatgagtgttagttggatctctgttttcacgtttcaacatgtcagtctagcccgccttgtgtgtcttttttccaatgctactctctgtctacctgcccctattcatcaacctgtcacttaacattcttctctaggacatgacttcttttttctgtctcctattgtgcctgccttgggctttggctcctgtatacttccaaacaatctttattcttcaattcaggtgtggagcccagaacaaacttttaatcccgcaggcattcttgaagtgagacttagatgagattttctgcatcgttaagcgacttaaagtggatatgtcctcctacaagctgaatcaaaactgtaaatttttctttcatttcagaaacatcaaacaactccaaaaggggagagagcctcaagctttacattgtaggagatgcttttgctttggaaccggttgtttggctctgtgctaattgcttagtaattatagatagcattgaggctgctcattaacattggctaattttgctcatatactccaagtaggcaggtaccctagccaccttgtttttaccattatagccccagcacattgcgagctgcctgacatgagtgaatgagtgaatgaatgaatggatccataaatctgtaagacgggactaattattcctacctaagatggttattgtggggataaaatgcaataatgtagtaaaaacattagcctagtttctgtcacaagatgaacatgcaacaaatactagttctcttccttcccactcactagatgaatgcaaatgtataatgtactatattctcaagctacactagtagataggtctttggtgtgattgtatatgcacctttatagcattattttaaataagcaaagctattcactaagtccaggcataagaaagttggtctgcttatgaagaatctagaattaaaatcccttatagcagtaacttatctgtatcaagaaggtgataaaaagaaacttccctctgaatagtacctattgttcaaagcacctaggaggttctcagactcctcaaggtgatccttctgttcctcactacaataggcagttcaaggatcttttccagaatacaaagccaagaactccagttgtcaattctgaaaagatgttgcttggttcaaagaattagagcatatctgatcagtggttttggaagtgtgtctgcagggtgttcataggcattaagataactgcacgttttcaaggccaaatgtgtttgggaattcctgggctgaccaaagtaaacctatcttgttactgtgaggcctcactgggttttactttggtgatgcacattgtttggcagaagccttgtgagcagcatagctccagacacgtccaccttctggaaaactggccccatgtgtcccagacatggctgtaaagcaagaagttgagaaagtggcatagcgctaacagccctagtggatttggcaacttatccaaaaggccagaagatgggcaataaggatttgggaaataaaaacatggcctaaaatgttgaatttggcagatttccccttgcctgtcactccaattaggaatttgaagttgtagccaaagataagtatctttccttccatcaaaaaacaaatgtgtaggtgttaaaagctgcagtaatctccactgattcttgctgtcagcctttacctcccaggctaggaactttgatccttttggttcccatgtaacaaagttcctaccatcaagatggtagacattattaacagtgtcactcaatttaaaatgttttatttaattgtttgtagaccatggaaccaggagaaacttgggaacaaaatctattttggatgagactgaataaagaggtttctgccagtgggcagggaaactgctaaagccagggaaatgcaattgcaagtttggtgcttgtttcccagtagctcagaacagttctccctgccagacattatgatggagaattaattggcgtttcactttgcgatatcttttaagggttcaaatggcaccttagcatttcttttaacttttctgcatcgaatgcatatattctgggctctttggtgtgtagcatagtttaagggcttcataaatatttgttgagaataatcctaggacctctatgaagtttaaggactttttgtgttcatgggtcataaggaaagcatttttaaagtataacttgaccatcaatcaaaaatgcctagcaaccatctccgtatccatcagtctaaattagcagctgttggtaacaataattagcccaattccccagggtgcaatatttagtcaacaaaagcactcaactctgctattcactacttcttggtgaaagggtcaggagatgcagttagattctctaccctcattcagacacttgaaactcgtttccagagcttagacctcttcacttgcatctctcaatcccagtatcattacatttatgacattgttgattaggctctctccttccctcctgtacaacactgaaaatctgccagaaatacaactatagaaactgtatttctatgaattttgagcattttacaggtatattcttttttagatgggtgaaatttacacaacataaaattaaccattttaaggctgggtgtggtggctcatacctgtaatcccagcactttgggaggccaaggcctcccaaagggtgatcgcttgggcccaggagttcaagaccaacctgggcaacatagtgagactctgcttctgaatgcacgattcagtggcatttaggacattcacattgttgtgtagccaccacctctatcaagttccaaaacacttccatcataccaaaagtaagccttatactcattaagcagttactccccatctcccctcccctcttagcccctagcaaccaccaatctactccctgtctttatgaatttttgccttttttggacatttcatacaaatggatcatacaatatgtggcctttttgatggcttctttcacagagcataatgtttttaggctttatccacatcgtagcgtgtgtcagtgtttcatccctttttatggctgaataatatcctgttgtatagatatatacccacagatgtaatttttagagccaagatatattacatttgtaaatccaaagctttaagagccattaagagactcaaaaggacatataacccttggagtaactggcctgaaatttttctagatgaaacagaagagtacagatctgaaattctcctccttgctgctgccagctagctttgtggccttgtataaatgagcatcaattttcttaattagaaaataagtaactagatttagtactaaattgtttcaaggttgtttctttgctcaaaaattcccagcatcctacgcaatactccgcatataatagctcttaagagtgttgtttatggaacttaacaaaataccaaactcaacaagattactagtccagcatcatttgatatgctcagaaatggtatgcttcatgccacaattctcttgtttttaagagaagcacttgcatttttgaatcaaagtgttcattattaataactgaaccttccaaatgaacctgagagtacatagaaggagattgagacacaccagtgccttgctttttagtttatacatgagaactctaaccagaaaacctaaatgaagaagagaaatagtgcatccactggggggatttgtgagaaagctcatgaatattttccacagcatctgctgggaatatggtgcaagaaaatgaatacaaagagaaagaaaatgagccagacaaaaaactccctttttaatgtttattttagagagaggctagtaattgattaaactaatccaatatctggaaacattcttttttaatattcactttgccttttatgcagtttgaaattttggagactctcctttgaagtggatcagggttgcgtctgaaaggaacaaacagtttcccagacagatgtgtgaagaaatgcctagagctacgcgcttcttgctggggttagacgtgaccgggccagactgttaaatacacagcaacatgaaatatgaatattcttttgctttcgcagggaattttttttcctgatagtaaaaaggaagagggcaagccattttgttgttttctccaattccttcacttttttttaaagcttgcattcatttgttttatgttactgtgttgtgacattttgagatgcctcttaaaactcatgtgtaaaaaagcactttttaagagatatttattttccttttctttttcatttctatgcagtgatgttgaaagtcatcttgacatttctgaaacattgttttgtttgcattacagagtctccatggcaactgcatcctcccaggttctaattcctgaaatcaacctcaatgacacatttgacacctttgccttagatttttcccgagagaagaaactgctagaatgtctggattaccttacaggtattgtcttttatgttctctttaatattgtgcacacttagtgatataaacactttgccaccagatcagttattccccaataaccagaggaatgggcttttgacctaggaatggcactgatatttccataaacaatttctgtgcattgccctttgttttttcatcaaaacaacacagcccattactaaactggggacaggagaaaaaggagaatctcaaccattaaaagcatacttaccactgtttccctcactctcaaggtgtgggtgctaaaaatagtatctctctgtggtatttttcatatcatagtagtaagcaactcacaatacattggcagagaaaaaattggcagctaactgattggttgtctgtactgcttcatctccttgtatttgtgatcttgttttaatttgcacaacatcgagttgaggtaaagcattataatccccattttgcaaatgacagagatcagccgtcttgctggaaatcaggtaactagggaatgacagaattagaatttggctgggacctgtacaaactccaaaaacttctgctctttctagtaaaagactgaattttatcttggcaaatgtcaccatggcaaaggtcacaaatttacattggaattcctagtgctgtgtttcagtgtgcttcctggttggtgttttgttttgttttgtttctcccttggttgagcttaaaaaacaaaaacaacaacaaaacaacaaaaacctcaggccactcctattcctaagcatgcttctaaacttttctttgctgtcaacttctaaagtaggaactgagaatattcactggtagaacctggactgtttagacaaccttattcgtgttagccaaagccaccagtgcctgcgacttcaggaaagcacaatgtacacagtgaagccagatgtgcgctgcacttaagacatacagccttcaagagaccacgtctctaacttagcgtgacatgagcttctcaattccaattctgtgtgtacatgtttgtgagaaagcgattgaacaaggtggagcaggagaaagggaacattgtgtgatgtttgtttttacagtctgtggatagaaggccaggggttctatattcagggagcattgtacccagaagatgagcattttttctttgcgaggacccaatgtgccgtttttagcctttctgcattgtcaagcaaggcaggcaggcattccacaaacttcttatcttatgtaactctctctttcaaacataccactcctattaaggaagaaagaaattgactaaaaaagcatttaccgtatggaactaaacttggtttcaaatatttgtgtacataatgccctcctatttaagcttttaactctgagatttatttaaactgacactatccaataaaactttctatgatgatagatatgttctatatctgtactatccagcgttagctgcctcccacatggggctattgaaaacttgaaatgtggctagtgaatttttacttttatttaacttcaactaaatttaattgaaatttaaaccaccacatgtagctcgtggctattgtattgaacagtgcaggtctagactttctccagctaagctgtttttcacagtggcatcctgttaaaaatctcctttttcttatatcatttgcgaatgagtttagttgcaagcaacaaaaaatccaactagcagtgaataaaaccatcaaggagtgtttgtattacagtcacagaagagaagcctgtgttccagggctgggcagtggttcagtgacgacctcagaccccaggctctttcttttttcctcctctgccgccttcattgtgttgcctttttgccacatgatcacaacatgactactccacctccaagtgttgtgctcaagctctaggcaaaaagaaaggggtggaggggaaacgatggacaaaatgctctgccagtgaagtttgtttatcagaaaaacaaaaagcttgatcagaagacccgcctagcaaacttccacttatgtctggtgggctgtatctgtgttacaaggtcatgtccagggacagaaaagactggaaaattaagtatttgcctaggcacatggccattctgcccagaatcagtcttattgacaagaatgtgcccttgccatttcccaataattatttcatagtatttcaacaacatatacccattttaatctctataggaatgcaaaagtattgattaaaggggaaattgtgaaagtagtttagactgaattgtaacatacaccatatttcatcccgatggctgtttatttcaaactaaaggccatatggggtacctgctattatgtcttctgagctgtcaaccccaaatacaaattcagtccatttctagacataacatcgatcctgaccataacatatgatgcttggctgatactgccaagtccaaatagtttatgacatttgtaagcaggaaatgaagtctttgtggagtattagcccaccattccttgggtggtgtttgtgacagagacaagaaaataacacttctggtactgattccatgagtattgaaattggcagcatgctgctgttctcatttacactaaattgagtattgacttctcaggacaaactcattgggtttacagtcaaaataaggttagcctgtctcattgtaaaaacaagattttttttttcctatgacatgcctctaagtggtatatcaagttaataacccatagaggtgacatttccttcctgattatggctactaccatgtgtctcacagctacttgcctattttgaacatacgttttctttctatttaattgtatattgcaatacagaacaaaatttttctacaatggttgatggagaaataattcaatgaactgtttaaattgtgagagagtaagtatttcttcactggtccatgcaggagtgatcccacaccaacagggaccacacagacaataataagcacattttacgatgcagctggacctcctccgtggaatgcatatcctgattggtgtcactgattcatgcacatccaagtcataccacatgacactaaatctcacatgtgaatacttcaggagacagatgtacaaatacatattccagaaagaatgctttaaaggttatgtagaacccttctgtcttaatgcacaatttaatgccatgcctgtcacgttggaggtgctcaacaatgtttctggaattcagaaccaatagataaagctaagctaattgacttaataccgtagacttgcttctgtgatacttgtcctagaggtatattcaaaaagcaaagtgaagactactaacgcagagtttaaatttacagtttttataaacttttcttcctctttgggtttgcttaggactcatcaattctaatcataatttagagcaggaaataactctgaaatagtacaagcaaaggttgctcctagtttgtagagtgcaggtatgtttctccttttgaagtgagattctagtgggtagaagagtggaagtaaaggccctggatcaattctctaaaccagaggtcagcaaactttgactgcaaaccaccagatagtagacactttaggctttgcagtccatatggccacaactactcaactttgctgttgctccaaagcagccatagacaatacataaatgaatgaatctggctgtgttccaataaaactttatttacaaaaacaggcagtgggccagacttggcccacagtcacagtttgccaacccctccctctaaaatattatttacaatgcaaagcactcattttctcatattttccttgctcacatactcttctcataaaaccagttactgaaatcaattcagtagaagtcattttaaactcattattttggtaggacttagacttctctgctccagaatgtgttaaagaaataaaacagcagccttctacaatgataaattaaccaaatgccaaaaaaaagttttttccttggggaaggaaaatgtaccttttagatatgattgactatgaatcatggtcttctgaatttgaaatatcgcatgagttgagaaatgagaagaaaatagggctggactagtaagttcttttttttatgtaagtcatcgaaacatctaatgaaagaaaaattcaaacaattatgtggctgattttttgtaggataacaaacataagtattttttcaattgggtgcctaaagatataagtatctggcaccacgtattaataggtcaggggttggtgaactttgggttacagcccaaatctgaccctctacctatatttgtaaataaagttttattggaacctggccatgcccacatgtataagttgtgactgttttcatgctacaatggcagagttgactagttgcaacagagactgtatggcccacaaagctggaaacatttaccatcaaggcctttactgaaaaagttagccaacctcccaaagtgaatgcagctatgaaactttatcttgtttactttttatttgacaagttttccttcatgcacaagaaagtattatttgtttaacctcccaaacatattctcatgatctcatgataaacacagaaagtccatactggctgactctagtcacactccttattaaaaacaaaagcaataaccagccaatcagatattctttagattggggtcaccatctctaggatagtagtcctgatggacctattgagaaggacctgcttaactgtcaaacatctcctctgaaatggtatcccagttgtgtgtgcttttccactgataagcattcttgacccccacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtgagtatctcatggcctatttatttctgtctttggtggctttcttcagattgattgcattcctgaatttaaacttcaaaggaagacaaggaaggaaagaacacacaatatttattgacttgtctttcttgaacaaaaaagtgatagcactcacttgtactacattagtaaaaacagctggctaaatattgatgaaaattaatgacctctagcaaaccacatggatgttaagggaaagaagccagaaacaaatatatagagagaaacaaatatatagagagatacatagagagagaaacaaatatatatatatagtattaatccacatataggttcataacttaaagatcaaaataaactattttgcttaaagaaacattcataggtgttaaaactataaaccctgggcaacctggtgaaaccccatctctacaaaaaatacaaaaaaaatacaaaaattagcggggtgtggtgacacacacctgtagtcccaactactcaggaggctgaggcaggaggatggcttgagcccaagaagcagaggttgcagtgggcagagatcacactacagtactccagccggggcaacagtgagaatgctgtctcaaaaaaataaaaataaaaagtcaggatgatggctacctccaggattaaagggcaagtggcaccactggaaagaaatatacaggggttcttggggttaatggcaatttctaggtgaaagttacatgctttagtcattttatcatacatttagttttatgtactttcctgagtgttacttcacatattttaaaagaaaggatttaataaaataaatagccaaagaaagttaaatacctggtcccattcagaggagagagctgggcccatcacttaaaatgttagtaactggccccacccgggaagaatttccaaccttacctgaaacattagaggtgccccctctcactgaggcctatttgatatctggcatcagagataacttggtgatttcaaatagcagtagtagcaggccacagagatgataacagaggaagcagtcctccaacccacagagttatttaaattgaactgggcaaatggcaatggaccagaagacatggcttttcacgggagcaagcttgaaacttctttaacaaagaaaaatacaatatgtcaaaatagaacagaatagaatagcagtcatgtttcaacaaagagatgttttgaataaattcatatcaatttaatgtgcttttattatataaaccttttctctcttaactacaaactgctctttcctagcacaagtaattctgagtcatacgatgcttaacatagaaatttgatttaggattaattaaaagagtgatgcagaaatacaccaagttctaagggactaaagtataaatgacccataccaacaaatggctccccctaccttccttatatccactctccccaacttctccaacttcctctcctcaactccctcaccttctaccctataattggcctgccgtggaagcttttattaaaatcttgccatttaccaagaatgtgtaatttttaaatgaaagtggagaaagtcatgcaatgtcaagaacagctctggcaagctgcctgagtcagtagggaatatagaaaggtcagaaatggtgagtgggacaaaaatgtcttgggggaagttgtggttaaactaagtcttgaaaaaaagcgggtgcattttagcaagttaaggctgtaccggacagctatgtcatcataagcaaatctatcaagatgtaacgtagcagggcatagtgggaggtcttgcctaattaagcctggctggtaagtgaggaaagggagacagtgagaaatgaagatagagaaatagaaccagggctcaaacctatattggcctagctccaaaaagcacatgttcttaatccttaatcctcagtcacctaatcctaattcacaggcaagagctagattgcagagggctacccaggccataccatgtttggattttaccctgtgggcttgagagtcatgcaggacagtaatgtaatcagaggtataactagaaggtgactcaggagcactgtggagagtggagaggaacagggcaggaccagaagcagagacatcagctgggaagtttcgtagtaattcactgaggcagaaatagccaggacctgcaaatggcaccagcatcagagatggaaaggaaaagataattccaggaagacttctctgcgtctggcccattttcctgggaaaaaatcatcagtgtcctcagatatttgaagtgctttttggggcaagtcgcagaaggcctgtatagcaatggtttagtaacattttgctcaccttctaggattttgaattcttctggtatcattcctcatttctgactctatatgccctactgcaaatcataaagaaatactaattctctaaaatatttttctacatgtgcatatcatacacaatgctttaccttgtttttttcaataaatattatgtctgagatatcattccatttcagcacaaataaagaactgcctcattcctttttgaggcagtatcatatcctattttaaagatatgctctaatttatttatcccatcttctatagatgtttatttagcttgtttccaatctttggcccttacaaacaatgccccagtatccccaaggatgttcaagatatccttgaatatctctccttccacacacggggaattatatctgtagtataatctcttgaggtgcaatttctaggaaaagattatttgcatttaattttacttgacattgccaaattgcccttcagagagatgacatgatttttaaatgcatttttccagctgtatgagcttattgtatttcactgatcttggctacatataccataaacttaacgtggaattaaagtctagtaaaattttaaaccttgattgtgcttcaccataaacctgaaacacaagttaatctatgatcactaatatcatactaaatagtcactccttcatataagcagtgattctcaacaagggcagttttgccccctaagggacatttgacaatgtctctagagacttttggttctcaaaacctaggaggagggtgctattggcatctagtgggtagaagtgaggaaagatgggaaatctcccacaatgcacaagaaatcccccaacaacagagaactatctggcccaaaatgtcagtaatgtcgaagttgagaaaccctaatttaaaacaaggtaaatgtataatatctacatgattacatgctaaatactgagaccataacacactgatccacacacactactatactatgtagcatggaaggaaaaacacaacaaaaaggggggaatataattaatgtattttgtcttcacttaaggaattgttttctcaatattttgtgattaatatcactagcatatttgggataaactgaaccagggattgtatcaaacttgaagaagatgaaattcaaaagatgatcagaaattccaaggtaagagaaaagaagcacgtgaaggtctgagaagagcaggtagaaaatggagagatgattcattgtaaaacaccaaggaaggttctctgaaaatacatagaggactgatagaaccaacgtctgttgatgagtgaatagtctaaccggaaaaagaaaacatttggagtcattttataccaaaagagtggttcttggcccatgtgagaaatgctatatttctctcaaatcattttcgtctgattcaggaaaagtgctaacagttttctattgctgtgaaacaaatttccaaaaacttagcagtttaaaacaatacccacttattatttcagtttccatgggttaggattctggcatagttgagctgggtcttcttcttagggtgtcacagtctgaaattaaggtgttggctgggctgcattcatctggagactcaactaaggaagaatctacttcttagctccctccatttgttgacaaatttgtttcattgtggttgtggaattcatggcagcttgcttcgtcaaggccagcaagggagagagtctgctacttcaaatctgtcacctccaaacctgtctttaaaggactcacttgactaggtcagactcacccagaataatctgccatttgattagctccaaatcaaataattagggaccttaattatatctgtaaactcccttcgccttcgcctttgtcatataatgtaatataaaaacaggagtaataaaagtgatagacctttgtcctttgccatattctgttggttagaagcagatgacaggtcctgtttacactaaggagataatattacacagttatgaataccagggagttggaatcctggggaccatcctagggcatgtcttcctcagatggttatgtctctcctgaaatttcttttggttttcttttattctttcatatatgtatgtgtgtgtgtgtgtgtgtgtgtgtgtgtgtgtgtgtgtgtgtgtgtatatatatatatatatatatatatataaaatttcagacagtcttgctctgctgcccaggctggagtgcagtgtcatgatctcggctcactacaacctccacccccagagttcaaatgattctcctgcctcagcctcctgagtagctgggattacaaacatgtgctaccacgcctggctaatttttgtatttttagtagagatgggatttcgccatgttggccaggctggtctcaactcctggcctcaagtgatccacccaccttggcctcccaaagtgttgggattacaggcatgagccactgcacccagccctctcctgaaatttcttaaatcaaatcgtcatggacactttgggagtacatgtagccttggccttgactgatgggctctgtatccgttggcttttgctgaatagccaacaaccacagggcctaagtagaattcatattgcttatgcatctggagtcaactgagtgtcaactaggaagccctgctgatcttggctccctcacatggcagactgataactgtggcaacccgactgctgcacatctgtctcatcctcctacaatccagctcaagtctgctctcaccctgattgcagagatgaaggagtaaaggcaggaccaattacacacattctttttaagcccctgtctgtgtcacattagctaacatgaggtttgtcaaagacgtcccctgggtgagcccagagtgagaatgcaaagacctgcaaaattacaaggaaggagcaaggaattggggccaaaaggccctaactcaataccagagcttcacctcatccccaaaatgaaaggaagatatttattgcttgaaacttagggtttctcacttggctaaactgtgaccaacttgatttctgtgctatttgcatcgaaaataataccaaacatgatgcattaatagaatagatgatgcaaaaaggtcatgcataaaaaaactcaacaagagcaaaaccactcagtataatgaactcagaactttatgttgggtgattccagagatgttttgttcccagaaaccagttgccataagaaaagaaatgcaaatggcttagtgaagattatcagcctttaacgcatagatgccagaaaggcccattctcccaggatggaagaaaaacagtgaaactgctggtgctgaccaaactgggatactctcaccgggttgtttgtatcaggatgtgttcctcccttgatgcccattaaaccagaatagtgaagtcctaatgcctacaggatccatttgcgacaaagaaagaattcattcagataaaaagctaaccgataggcaaagattttcaaattattttcttcttaaatatttttcacatttgtagtgaccaaaggagacctggatttcaatcttgactttggacctcactagctctgcagtcttgagcaaattatttaatgtcctccgaatccgtttcctcatctgtaagaagggatagtgttttaacttcacatggttgagataataatagtaaacaccttagtcttgtgtttgccacagtggtagcacatagatattcaaagttattattcctacaaaaatacggactgtactcaccccataattgcattttaaaagaaagaccagttttgcaattttccaggattatctacatgatagctttttacacaatcagtatgtgaaaggctttccttgaatgatgttaaataatctgtcctattatttggagaagtatcctttgcagatgttgtattgcgtgacaaggtctaatggtaaaactctactgaaaatgagaagatataatgctcaaaacctggctgtagctccttatatcactagaaaatcttttactgtctctaggtcatggttccttcactcatcctaataaattgtagttaattgccttcaactggcgttagtgaaggagacttagataatatctatggagctttttcaatcttacgaaaaggccctcactaatgaaatacatacattcaaatgcaaaagtaatgacattaatttttattttttatttttgttaatagagttatgactatagatgttaatgaattgcttatcaataactagatatttatttaattttacaacgtttgccacgttttctctaaaactacttttgatgcttcattttaagtcttaaattgggtcctttccccagcagcctattcttattcttagcagaaatcaaaagctgcatttttttcaagccttaatggctaagtagttatctgtttttaatttattgtagtcacttagaaaacattcatgaaaattattaaacatatactatttttacagaggagaaggaaaggaatgttcacttctgtccagtctgttggaagagacaaaggatgttagaaaccagtgtgcagcctctcctaagactgtccacatcatgtgacatttttacacataattttttgtggcaagatgacagttgccatacaaggctctgaaatcccagatgtaattaagatcttataatgagccacattatgtagggaaatgcttctaacccattgtgaatgaaaaaaaaaatgtataaaatcaaaaaactcaattaattaggtttcattgtggacaaattattttccaagctccgttgttattttaaactgagtcggaggaggtgaatgttggaacaccctcaaagatgactgaaaatgagtttggagaaaagtgaagtttcaatcaggatggttgtgtgggtgtttcataaagagatgaataaagcctggtcaagagtcctaacacagtggggtgtcaaggcagagaagtcttgcttaagcaaactcagtgccatatgcaagaagttaggtggtgctggcgtaagaccaacaccggtaatggtgcactccaagtcaccccacttactccagcccccagaagaaaattgtcaatgttgctttcctggcatttttaatcaacttctcaattattatcttggcaataataataacataaaggtaaacctaaacagtaatagtgtttgttagtattcatgaaagtagattgtcccagtataaagctaaccaatgaaattttactacttcataaacattttgttcttttaattttcaaggaaaaaatagggacctcttcaaaataatcaggatagtcagagtccctttttgtttggaaaaggtttctgaaacataaaatctttgttgggttaagactttggattttaggccaagttacagttttcagcaatttcagacatctgctttatgatgttactgaaagcgttcccccaccacattaaacccagcttttgggttgtacagtgatgtaaagtttattgaaacatttttacacttgctttctttgaccacaatagtcatttttttgtaacatattcaattaaacaggaacagtataaaggcagtgaaattgatacgattctcatttgaatctactgaatgccttaattgttctcattcgtggctgactgccattgacaaagatctaggaatatgagtacactatcctacataatagaaaagctaattttttgttttattactactgtaataatattaagtacctaaagagagttataggcctcttggggcccagaactcagagttcaaaatgacccttctttgattggatcaaaatctaatatttggctgtggcattatccagaagtatggagtttattatagctatgttcaaggaaaaggtaaggtgaaggaagatcagaagggatatatagtaaggagattcccatgttactaaactatttgtggatgttttcctgcatcatatgcaaatgagaattggtaggaaaacagagggctaagaattagagaaaataaatttggggaggagggatggattgtgcctcttattgctctgctgaatctccaaatataaacacacacacactcaaacccttctatgagtcctaaattacattcttgcttcaagctggctttttcaaatctggcagtccactggcgaaaatgtttgcaggttagagaaaaaaaaaaaaaaaggcaacagaaaattcacaagaccaaatatgtgtgtgtgtgtgtgtgtgtgtgtgtgtatctttagatatctttagatgatatatacatacatacatatatatatatatatatttaattcactgatgtgtacttgaaaatattatgcacccaagatggaaatcatataaggtgaatttttcaactgtgacaataccatgaataatttttaactcaaaagatggagtaagtaagtattcagtaagattcaaagacaggcttcgggagcctgtgactaccttgaaattctatgcatatatttgtggtttggtgtgtatatgcatttgtgaatttcttactacagaaaggttttattagattatcaaagaggtgagaccaaaaaaagattaagggactgcttcttgagaatctggtaaagtataagttgcctcaagatcaaaggaactaaccctttgacttgcaaatcaattgaaagaggagtggggtggtggctttggagtcctctggaagtggagggggcccagccctctcccagggatcagtgaaggaaattcaacagagtcaggaaacttcttgacagcctggtcaccaagggtttggaaaaaggttctattggagtggagattgatgggtggaaaaaggagagaggggagttggacctgataccaaagagatgttttcagccatcaaccagctgcaaaacaagatgggcttccttttcctacatattcttccaagcatcataaatactcggtctgctccccaacccacatcctgcaggatgcagccagagcaacagccccactccactctgaaaccagtcatcctagggatgatgatcatttcttagcttccctgttggaggtcggttggggttggctgatcgctgcttggttcactcctgcactggctgggcgttggctgcatggtaaagctgttccctgtctcatcctgttgggataaacagagtatcctaggcatattttctccagagcagtggcagacacaaagggtcaacagaaaccctcaaggttttgtcatgcctactcttgcaactagcacattgtcatttcagcctcatgctattgaccaaagcaagtcacttgaccaaattcaaagccacatgacagggaaatatattgcacctctttagaaggagcacctgcaaagttatttgggcctggatatacagggcagggagaattttggaggcaaaaatgcaatctgccacatctacgttagtgaagtcagtttttcgtacatgactaccaagacaaagcacttcacttaccaactctattcaaataaatggaaattattcaacctaaaattatgcaaacattgctccccttgtgccaaagaactgcaccatgtctgattggctttgcaggtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagtaagtgctgtgaactcaacagagctgtcatgtcttatctgctcttctttcagctgactctgtccccctttcttttccttttctctgtcttgggtatcattgacagccccccaaaacaagtaaaaagccagtgtggaataatggaatttgcatcagatacctctaggttccaaaactgattctattccttcacagccgtgaggccattactctctctgcattactcaattttaaaaaattgagtcttctcattttttaaataaatattcctggaggcattcttgtgagaagtagatgatgtatatgtaagacctgacacacagtaggggctctgtaaatggtggatagtgttatttttcatagcagagtagccaactaatcactcttcagaaattcttttattctagaaaacagtcggagtctgtggttctcaatcagggacacttcttcctccccctccaccccaccctaccaggacatttagtaatatctggaagaggtttttagttgtcacatctgaggtggatgctaccggcatgtagtgagtagaggccagggatgatgggaaacatccccaatccacaggacagtgcgcatcacagagaatggtctggcctatatgtgtgtctcatgatactgtcatctccctctctctgtccacatgtgttttgttttatcctctcttctttctttacatccttttgatctaggaatattatgttatgtaacatggtgtttatttgcataagacctcccaagagaaagcaaattggagtgtgtcggtatggcgccatgttgtgaggttgccaggcagtcaacaggaacaattaagtgcttttcaaggggaaccctcatttaacctatatccttgtttctcagtacaagtgttgtatcctagaggaatgtgttggatcctagaggaagaacaagggatgtaaagagagcactgaattacgaatgagaagactgtggctttcccacttggtacccatatagctatatggctagtttcttcatatttttaaatagattttttattttggaatagctgtagatttacaggaaatccatagataatacagagagttctgtacacccttaacccagtttgcccaaatattaacatcttatgtaaccttggtacagttatcataactaagaaattaacattgatgaattactcataactaaactccagactttattcagattttaccagctttccactaatgttcctttcctattccgggacccaatccaggatcccacaatgcatttagtgttccttcagttttaaaatgggaatattttaacaacttgagggttgttatgagttgtcaaaaagaccctctcaaagtaattctaaaagtacataagagaatataacatgatgatatatttctttacagtcatacaacaaatggcacaatacctatgcacacttagatcagcattatttgatttgcatttgaacatgtaaatatttgttccttcaaaagatatgtttgagcaccaagtgtgtttgggatgctgtgcaagatgctaaggatattatgagtatcttcaactccctaaggtgtgcttctctctcaaaaaggtcctagactattggggaataaagcacattaatcctaattaacattcaatatgtgaaatctctgactggaataaccatgagaggttctaagttgacaaagccagggtgccccagcacaaccttgagaggctttccaaggtaggttaggagcaggggatgtgaggacacagtgttccatgcagaaggaacagcatgggcaaaagcccagagacaaggagaatatatttatggaacagaaaattgatccatgtggttaaagtgtgtcttaggttgggaggataggtgagccaggaggctggagacaagaacagatcgcgaaagcctcctgggccacaccagggagtttctttgtataccaatgattggtggagagattgaagagtttaaatcaaacaggcaggatgaaaatttccatgaaataaagctctcttgcactatgatgtggtgagtggattacaaggaaggaagactggctgctgggcacagtatcaaaagattattgaaagagttgtccatgtaagtaaacaacggcctgaataagagtcgtgtcccatacaaatattataatgaattgaattatttagtaaagtaagctattaatctctttcttgaactaatttgtcttcactgaagcaaaagccttgaatttgggcagagtaggtagtggtttatttgggaaacatatctgaggcatgggcagaatttgctcaccaagattgcatgattctgctccacacatgcgtgggtgagggtgtgagccaaggcaggcaggatgtttgaggcagtatgtcaccatcacaaggccggtctttccaatggctctgacattctgatatatctcaccggaaggaggccgagcagaacttggccttcattgtaaatgatgggcgccattaaggaatttcttcctgctctgcccattagtatcctatcaatcatttttaatccatattctaccttccacctttaaaaattgaaatattttaagcaaaactgtcttcatactcttcttgtcttagttcatagtttatctctgatagttgctagcatgatcattcctaaggacttctttttacaagtcaaaatttaaactacacatgtaatccaatagatcttacggcctctgagaatgtccaatccctgctcagcccttgagggttttctctgctccccctttaaagcttttcttttcttttttattgttatttttttgagacagtgcctcactctgttgcccaggctggagcgcagcggcatggtcttggctcattgcaacctccgcctcccgggttcaagtgatactcgtggctcagcctcccaagtagctggaattacaggtgtccgccaccacacccagctaatttttgtatttttagtagagatggggttttaccatgttggccaagctggtcttgaactcctgacctcaggcaatcgagctgccttggcctctcaaagtgcaggcattacaggcatgagccaccagcccagcctaagcttttctttgatatgtacagaaatagatttctaaaacaaaagccagctaactatagctcaagggccaaatctggctgcctgattttgtaaataaagttttattagcatatagccacacccattcatttacctattgtcctgtccgtggctgccccctcactatagcagaagagttgaatagtcacaaaagagaccacatggcctggcctgcatagccaaaaatatttactgtcaggccctttgcagaaaaagtatgctggtccgtgacctaaaaagaaaggattttagaggtgctggtgttgtgttgtgtttgtatccaaaaggcaactggaaatcctttggcctacccacatgtgacaacacacactgtcctatactcactgggtcagtttctcgcccagcatcgtgtattgccacagttgaatttactagaccttttcctgtgattgagagctgtatactgggcagaaggaacctgccaactgcaacagtgactgtggagtttggacaccatggcatttgtatcaggttgcaatgcatttcctgcctttaaacgccttgtacccaatgcagtgttgaatgacaggcagtactccaaaccaatattgaattgtcaaagaagaagtaacaactatgacaaaatgtccaggtgtgactctgccaagatttttttaatacttaaatctttaagacacaaatgtgagtaatgaaatagagaaggccttattatatataaataatttcatgagtagaaaacccaggcattgctatcacattttttcctaattttgtggcctgaaaattgtattctcatcctaaattcctaagagtaatgctttaatttttaataatctcagaataatataaacctctagaatattctatatgttaagacccaagatcttgatttgtttggtttctggtctgaagtctattgagcatgaatgcatcttatgctggatagaacactgcagtggttgaaaatggagtcttcattcattcctccttttcaggatgctatccagccagtatgtacctgtgctgcttgtatacacctggaatccgtgaagctagctcaccctatgttttctggctaagccttatccatgctgttgttgaatagttggcatgccaccactggatccctatcttagaactggtagactgaaagcttatgaagacaggaacatgttctttttcactcttactgtgtactgtactatacacagagttgctgctctctattgtcttttgaatattatgaaaactttgcaagcaaatgtctttgaaagttgcttataatgtttaaattactattaaaatataagataccactttgtgataggaggcatgactcagggagggctggcttgttcctgtcttttaaacctgattttgaaaatatgctattggttatgataaaataaacaatcctcttcctcttcctttttctgttttgtgaatttgttttcaggccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtaagcaacttatttctattgtcctgcagttataaaaaggcacatctcattctgtacttagagagtcaacccatactgtaatgcatcttaaagaataaaatgcagaaaagttgtattagtcagctcttgctaggataatactgcataacaaacacccccaaactcagcagattcaaacaacaaccatatattactaatacccacacctgtgggttctctgttcaagattatagagctctgatcattggatgagctataccatgttaacactgctctttcatgccatgaaacatgggttggcaaaccacagcccatgagccaaacctggcctgctacctggttttgtaaataaagttttatgggaatacagccaggtccatttttttacatatagtccatggctgcctttcagccacaacagcagaatcgagtagttaagagagaatcatatggtctacgaagccaaaaatatttacttactttctggtcctttccagaaaaagtttgccattccctacttttaaacatcactcttcatcattacacaaaactaatttctgttgccttgtatgttttatggttctagactggaccaattagtgcaaatagctaagggttgaatggtgggggtgaagcagtgatcataggctgggaataatttcaaaaggcctgttagatccagcccagtgactttagcccactgagttctctaagaataagggcaaaggtcaggacacaattacattggaattagttaacctcacaaagttaaccttgcctaatccacagccacaactgcacccctttgaccgtctgtctcacaaatgcctgcttgctattgatcaaaaagggagctattttatttttatttaacaagccctcatatggtacaagtatgtgccaggcactggtctaagcattttacagatgtcaactcatttattcagccttacagccctacaaaggtaggtgctaatattatccactttactgatgaggtgactgaggtatatgctgaagatcacagggttacaaagctcacaggtggcagagtcagtaagtctgcagtcaagggtcaggctcttaaccagcagtccacaaacattatctgtaaagggccagagattcaatatttctggttttgcatgccaaatgatttttgtcactaatactcgactcttctgttgtagtgggaaagcagccacagacaacacctacacaaatggacatggctgcgttccaataaaacttcatttataaaaacaggcagagggccagagttggcccctgggtagtagtttgctgttccccgctcttaaccaccatggtatgctgctattcacaaaagggtggtatatttttgaaatgctataattactctctagggtttatgacagtgtacgtaatgagtgatagctgaatccttgctttaaaaaataaaatcaacattcaaaattgcatagcctgaagatggtgagtataacagtgtttctttcaatataagcatgataaaacacttatttatatataaaaaaacctttcaattcaaacctatgcaaataatgtgacatggctgagtcctttatattgtaggtagaaattagccaaaaatctaagaagtgaattgtaagcttcccatctctcccaataatggtacatactatattggctgagcgagtaggttttcctttgttgctatcctcataattctctttgcctagaagagttttctgttccaacatcctgccagaggatggaggacaaatccttcaccccactaggctctgggctagattggcatttgcaatttttagctgcagtggggcaaaattaaagcacaaaggaaaacacaatggatgcaggtacaaaaaaagcaaatgtttctagttaattaatgtgctgtattaatctgggatagaatccagggtctaaatgattattactctattaataattaattatgataaatgaaacctgatcattatgatctcattgccattgatgaatagtttgcaaaattccatcagaccacttcagttatataaacacacatcagcattaccttgaaaacaccctccagatgtcaaaactaactcatgagggggaaaagaaattctaaaattaattgctacacaattaatctttacaaacctgacggtgtcaatttcagaaaaatcttcatgtagaaagtcactttacatttccttggggggtattagcaaggaaggggcaccccctacgattaaatgcctgtgacatcttgacttgcaacagctaatgacatatttgcttatgaaatatagtcctgactttaaattgatgtgtacattatgatctgtgcaatggggcacgttaacattgctccgagagacataatttttatactttgaattctccgtgtctcactgcgtaacttaatggaacattacattctgcctgcacatttcaagctcaatggaaatatgtacctagtttcacagattaatgatactataatggtattttcctttgcttaatggactatacacttagtattttcttactctctaatgctaatgtgcacttggtgttttatgaaatggtgttaactaaatgagtaataacgggttcatgcaaagattattagaccagaaggggtgggggcagcatacaactctggattttgctcccaattttaatcttctgtttctacttgctacatgtagtcagccatacctgccacagctatttcatagggttcagttaaggttcaaatgggaaataaacatcaaagtaataaaaaataaaaatgctgtgccacaacaagaaggaaacaatacagatgtggtgattttgtgatgcaggttccaaattgtctgaaaagcggaaatagtattcactggggtatacagaacatttttggggggtgggagatactgacaattgcaaaatgaaaacctttccaaaatgtatgtattagtctgttttcatgctgctggtaaagacataaccaagaccaggcaatttgcaaaagaggtttataatggacttacttacttacagttctatgtggctgggaaagcccacaatcatggcagaaggcaaggaggaacaagtcccgtcttacatggatggcagcaggcaaaaagagagcttgtgcagggaaactcccccgttttaaaaccatcagatctcatgagacttattcactatcacgagaacaacactgaaaggacctgcccccatgattcaatttccttccaccgggtccctcccacaacatgtgggaattcaagatgagatttgggtggggacacagccaaaccatatcagtgtatcaaataaacagatgacatttgagaccctcgatgcatgccacagaagggagccagaagcttacaggaccctggaagggctggggcatgaagtcagggagtctgctgctctagttcatggagtcatgatgagctgtagctgctgcaaagttgcccacagcacaaggcaggtgtactcaggcgctcatctagaagcttccaccaaccgcacgtctactgtctgccatcaggaaagcgtgtttcccctcctctaagcacttctggatcttgtgcaaaggcatcacaatagcagagcctgacccagactcctacaggaaaggggattctgggaaatgcaacttggattctcctcataagcaggagaggatggacgggagggaagagaggatgcaacattgatgacagacaggcctgcacactgggcttggcagattatcaattccatccttcttttggatttagtgatggcatgttgtgttaattttctttttaaacaaacacaccactcttaaagtgattgtattttaagtccagtgtgattttttttaaagaatgtcattttattaaagacccatgaaatttttctctctgcattgggtaaggtaccatatgttaatatccaattagactggtttctgctataacatattaaaagttcaactgtgagtcatttactctttataaagagtgatgggttttgtttatcttaataactgaaatacgatgaatattacagaggcatgactcagaggggtaaaaagagattaagatgcttagaacattgtagaaagcattctttggatttttttgagcagcaagagaacatttagaataaccagaagatccgtctgctcaaacacgttcagaattttttttccagtataatcagaaaggctcttggcagtgatgaactgcacaatttctggttacggatggcattgtagaatgtagttcgtgtttgtgggttttgagtcatcctgagttcaaattctgattctggtacttattgttaatatgtgccatcaggcaataataataaaataaatagcagttactgaatattacatgccaggtcctgtgcctgggacttaacatgtattctctcctttactccttaaaataacactgtatatttctcaatatacatgagaaaattggggctgagtaatgacaaaggatttatccctgcaaatgggaatcatcttctgtgcttgcccttggcaaagtgcattcagaatcagaaaatgacagacatggtgttaaatgaaaaattataagaaggtcaaaaggagaagtctagggttgtgctgtccagtatggtagctatgagccacaggcagctatttaaatcatttaacttaatgaaaattaaataaatttaaagttcagttcctcagtctcaccagccgcagctaaagtgcccagtagccatatgtggcttgtggttaccatatcgaggagagcagaacatttcagtcattgaagaaagttcttttggtcagcactggtctagcgaattcattgtgtagatttttataagagtgaaaaaaagcagcaaaactcaaagttcaaattctccgtagtgtttgagctgaaaacagaaatgtgggtaaatacgacgcttctttccacccactactttccacccactttccatgtttgggagggaaggagatgaggaacacagatgttggggttcttgccaagctttcacttaaagaaaatgaacagggacaacaaatgatcatgtttttataacccctgaggaccacagaacggatttaacgtgcatgtgcaacatggctcattgtttttgttgttgctgttttgtttccgcaggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaag

SEQ ID NO: 2999 - DNA, 53630 bp, human; identical to SEQ ID NO: 2991

SEQ ID NO: 3000 - DNA, 232429 bp, human; identical to SEQ ID NO: 2992

SEQ ID NO: 3001 - DNA, 174863 bp, human; identical to SEQ ID NO: 2993

SEQ ID NO: 3002 - DNA, 438177 bp, human; identical to SEQ ID NO: 2994
  misc_feature (63100)..(113099): n is a, c, g, or t

SEQ ID NO: 3003 - DNA, 438166 bp, human; identical to SEQ ID NO: 2995
  misc_feature (63089)..(113088): n is a, c, g, or t

SEQ ID NO: 3004 - DNA, 175324 bp, human; identical to SEQ ID NO: 2996

SEQ ID NO: 3005 - DNA, 222612 bp, human; identical to SEQ ID NO: 2997

SEQ ID NO: 3006 - DNA, 53630 bp, human; identical to SEQ ID NO: 2991

SEQ ID NO: 3007 - DNA, 232429 bp, human; identical to SEQ ID NO: 2992

SEQ ID NO: 3008 - DNA, 174863 bp, human; identical to SEQ ID NO: 2993

SEQ ID NO: 3009 - DNA, 438177 bp, human; identical to SEQ ID NO: 2994
  misc_feature (63100)..(113099): n is a, c, g, or t

SEQ ID NO: 3010 - DNA, 438166 bp, human; identical to SEQ ID NO: 2995
  misc_feature (63089)..(113088): n is a, c, g, or t

SEQ ID NO: 3011 - DNA, 175324 bp, human; identical to SEQ ID NO: 2996

SEQ ID NO: 3012 - DNA, 222612 bp, human; identical to SEQ ID NO: 2997

SEQ ID NO: 3013 - DNA, 53630 bp, human; identical to SEQ ID NO: 2991

SEQ ID NO: 3014 - DNA, 232429 bp, human; identical to SEQ ID NO: 2992

SEQ ID NO: 3015 - DNA, 174863 bp, human; identical to SEQ ID NO: 2993

SEQ ID NO: 3016 - DNA, 438177 bp, human; identical to SEQ ID NO: 2994
  misc_feature (63100)..(113099): n is a, c, g, or t

SEQ ID NO: 3017 - DNA, 438166 bp, human; identical to SEQ ID NO: 2995
  misc_feature (63089)..(113088): n is a, c, g, or t

SEQ ID NO: 3018 - DNA, 175324 bp, human; identical to SEQ ID NO: 2996

SEQ ID NO: 3019 - DNA, 222612 bp, human; identical to SEQ ID NO: 2997

SEQ ID NO: 3020 - DNA, 438177 bp, human; identical to SEQ ID NO: 2994
  misc_feature (63100)..(113099): n is a, c, g, or t

SEQ ID NO: 3021 - DNA, 438166 bp, human; identical to SEQ ID NO: 2995
  misc_feature (63089)..(113088): n is a, c, g, or t

SEQ ID NO: 3022 - DNA, 290230 bp, human
ccggctccgcagcggcagcgggacgctgtgccaggggcgctttgcacagcactcggcacgcacggagcagggctcgcgcccaggggctgccccaggatggcagtgaagtgcggggaactcagagagacaccgtgaccccaggctgagcccaaggcgcgccactcctcccggaggcgacatggggcacccggtgtaccgcggcgagaagccccagctgcactacgcggtgagtgtcctgacgcgtgcagaggacacagggggcgccactgggccgctccgggtggggactgcgaggggcgatggtagtcggggctccccacaggtccacggctgagggggtggcgggtggccgggtacgtcaccccgaagtgccacctgctcactaactcagtggcgcttcccgaaatcttttagaaggtacaggggagccccaaccctgaattcagtgtttctttgccccaacgctgtggtcactgcatctgggacggggctggactccgccaccacctcgctgacaaaggctgacaaatggggttcctggggttaggcctaggtcgctcattcagccttcagtcagatatgttgaaaggacgagaataagactggacaggaggcagggccgcttcatgatctcagtgtgcggcgagtggatttgctgaagaaatgctgccgggagcgttggggtgcagccgtttcactccttagaaagggagtgcatttccctcctactttgtggcgggacagaatgttgcacattatcattaatgttgcacgctaatacaagagaataccaggggctcttctgtcgtaccttccccctcccttatggtggcttctgttctccctgttgatacaaagatttactggggacctactgtgtgccagggactgcgctaggtgctgcaggtactgcaggaaacacaacagagagaaagctcatgggatttgccttctttgaagaaggagtcaagattttaaggttaacgaccgaccaaatccagatactagatgagtatattctttgagagagagaaaagaaaggaaagaaggaaaaaaggaaagttgtttctgaggaatgactactacttctgaagatttcaaatgccccctccaggaagggggcagggagaaggtttaccttattccagtcttcagacattgattttccacgtgtgagatgtgtcgttttgagatgagacactgcagttgttctgtcatctgctaatttactgagttttccttgaattgatttgcactgttgagactggacgttctgactgccaactttaaaaattggagagaagcaggcagagagttgacaagaatcattaatatttataatcaggcaaagacagttaactgtctggaattcgtgtcttccaaaatccagtccccaacataaaaaaaaaaaaaattgtttttttgaagaaaggagtagaggtggacaggggtggtggactcaggcatcccggagctgctccagttggttcctggtgtcacctcggggctcctggattaattgcagggccattgggcaaattgcacacctcgtacacttcgctttcctccactggaaaaatgaagacctgaattaggaaattgttaagataccttcccaggcaaacgttccaggaacctgtaacagctctttctctggtttttctatagttacttgtcttgaaacaccaaatgagatacttgtaagttactaatgctcgttcatctgtcttggagacaccggtggctcagtgatttgccttttaaagtagtttaaagggtaaccacttttcaacagaggttgctttacactgaaggaagtagagtctgtgctcattgtgcccattcaacatctccaccccaccacctttttgaactgtgtgctggtaccctttgattcatgatctgaggtctttgccatttgcaagagtgcgggtgggggaggaaaggtgagaacgggctccttaattttaaaaaaatctattcattcaatgaatggttattgcctcaattatgtaaatatattacaaaaatattttaaaattgtcatttaattaggctgtctgattcttctaaaatcataaactgaagagtcaagccgatgctaatgtcccctcttggggctctgaagactgctgatgaaatagccctttattctagtacagattatcatgtatgtatattctggtttaagactataaaaaggaagattccagagggaatttgttgggattccaggttggaataagtcacccgggctctctgaagtttcctatgcatactttaggatgagaaagcagcagctctgaatcagtcacgtgtccagagaatgttctttattaagtgcgacccattgtttttcatattagtataacccttggtggtataatatctattctaacgctgcacttttgtttacttccctcatttgggttttgataattccagagcttgttttgccgtttagcacaaatattccacttactttgctcaacagggttttgtcccactgtgcattttcctgtgatcttgggttttttttgggtctgtcttccttgacatgaatgaccctccatgtgtccttaatacctcctgcctcctctgaaatataattcggggataagtatgtaatgctcttccttcagtgctttttcgtttgtccaaggtgagactgcatataagaggtcagtggctcacatttgattcattcaataaacatttgttgaatgcctgttgtgttccaggtatttggtcaattttccaaagagacagttagatagtgaaaatgttaggagttgctatggacatctcactcatctttttaaatggtcataatggtcacagagagcaaaatgcaattaactagacaagaacatcctccatttacataaacagacattttcaaagtataatacaactgtcttcttgctttatcatcacacacagaaaataatgtgtgttagcagctaatgttctcctcaaaaaatttcctcctacagttttcccacgttcagattatggtgactccgtccttccagctgggtgttgtccttgatgccttttggtgactgaatcagatttacattttgaaatgatcccagtatggagtgaggatgaggaggagctagagtgcatcctggtatttgggcctgggagagattcgagaagatgactgatgctagggtggcagctgggtaggaggttgagagcagttggcatattggagagatgcttagaacatagaacctgtcagacttagtttggatgggataaagaggtgatagagtatgaaggatgaggatgacatgaatgaatcaatgattttctggcagcatttctagagaagctcttgaagtttatataataagcaaatagtcataatgatatttccctccttgttactgtcttatacagattgcaaaatatttgaacacagtctaggtcaatttcagtctgaaatccaattgctgccttatgcaggttttctgtttcctgattgaagaaatctaagctcagaacagtagaattcaaggcagcacatgtgtcgctgctgacagaactgagagctttatccaggtgccctgatcctgcagtgctcttctgagtcatttagacaatgaggatagtcgaacctaatcatccctctgcgatccactttgccacagtaataaaccaacaaccaaatgttggaccttcagtgacttaatgtgactatctgtattgtcaaattgcatggccaaatagcttttaaatttgactagtgtagacaaaaactaaaaatttaagtatccattaagttcaatgcaatatctttatgtctttctgaaagacactaaaaaaaatctggattaaaagcttggccttgtgacttactggggaccttaggaggctcaagctcttctctcctggtgccccaacctgtctttaccctcaagtggggcagagaaaagcaaatcagtgtccattatacagtcaccatcaggaatccctggactgacatcattcatttctctctcgctggcaggttgaaaacttgctgggagtagtactatgtgtgtcttgtccctgctgtcacctggacacctagcagagtgctggaagcacagtaggtgctcagtagaaatgtgttgaatgacttcatgaatctagtagttgagacctagtttttgaggtcctaagctgctcattctccttccttgtactggtctagtctgagctcctctgctgctgatgtcacttcctgtttggtgtggtcactgcaccatctgtgcttttgaccacagccttgtaatcagatgctgactctgcccttgctccagttaaccccttcctaaggaactcaccagaagtgccaagctgcttaccctgacagagaacctgttttcacatagaatggaaactatgaaagtttccacgtttgttctctatgaacattcaattttcaaagactttgaagtcattaagtttgcttaataattgagtggtattgaatacaggatactctctggtaattctgaagatgcccagaactgggcgccgttgcaggcctatgctgatatgaatcagttatcatccatcggtgctaacagtgtagacatcttaggaaactcagcagaacttatactgacctgtggcatggcccagaacttacttttataaaaccatttttatattactctggttgtcatttgtctcctcataaaagcaaaattttttcaacttacaaatatgtgagagattattgaatcctcttaattgacacctctactaattgtagataccttttctactcccacccccaacctggcatgcttacttttctgctgcatgcagaaattttcctggatgaggcctctttggtgtggaagccccatcatcttaggaagctacatctcccctccttcaaaccactcattaagtaccactactaattgataaaaaatcagattcctgttggatgttgcatagcagacatctctgccaatcatttgaaaacaattaccaccctttgcctagtcctttctggtgatgaacttttattatttacttttcctgttcccacattgtgataaccctggaccacacacacatgactctcaacttggttgtgaaattattgtccagtcatacaaagtcttcattgggttcttgattcctcacttccctgtcacctgtttcattctcagactttcccatctcagtgagtggttggctgtccctatggccagtgcaatctttttaaaaggtaatgaaatagtgacatttcagtgcttaagctctttggttggtttccattccacttagaataatagcttcatccatgaccttgaccttccaagtgctccttacatggtcttctctgcctcataccacaccccactccacaagcttatcattgcctggccacatctgtgccctttctgttcctcaaatgcgaccagttcttttctgccccaagcctttgtacttgctgtcccttctgcctggaatgtcctctgtgtgataggctttttttttttacatccttcaaattgcaggaaaaatgtcgcctttcctgactgctttctctgaagtgtttctgagcccactcagttaccctggatcatatcacactagccacttccctcattgttcacatcaccacttggtattatattatatattcattgtttgtctgtctcctctgactagtgtgtaagtttattcagggcaaggacccaatgatcctttcccactgtctttccactgccttagagcaggtcctggcacagggtaggcatacaataaatatttatgagaacatgaatctggctgcctgtgtatttttccctaggttacgctaggactttccaaacttaaccctttattagttgatgattgaggtcagagggagagacgagactaaaaattagctttccagtttcactgaattcttactaaacgagaatctctaaggaccagacttggaatcaatcctttgaaaaagctttgggggtggttccaatatcagctgggtttggcaaacactgattaatttacacggtgaaccacttactactcaagcagcccctacaaaatgtaggattcagcagcaaagtagattcagaaagtgcaatacaatacttcacctcagctgactctgaggtaatctagtacaagttttcagagcagtcctttgttttaccacccagtgttcatttcagccaaactctctaatgatacaaaaggtataggaatacttcctctatataatgtcatctggcaatatgtccctcggtatccatattctaggtaaaatcgaccagtggttctgaaccagaggaccctgggcaatgtctggaggcacttttggttatcataactggcaggggttgccacaggcatctattaagtagagacctgacatgttgctgaacatcctacaaagcacaacacaacccaacaaggagttgtccagcctcaaatgtcaatagtgctgagacagagaaaccctgacttaattgtatctcagtagatatcaaaatcttaaatgtttttgagaacaattttgtatggcactttctaaaatacattattcgtagtttcttgggttttcagagatagaggtgagaaaatgtgagtgagcttccctggctgtgagtcacagttatgaacagtgtgtttcatactgtgtggggattactctggagagggtgttggtggtccttccagaagcctcagcatcttgggctttttgtttcttcactcctcaatgccaaagcccttcctaatcttgggttaaaaaaatgtttactgtcttctctctcatgtcagacattagctaacttcttcctttatgaccgtctaacagccttgcctaatttgccacctctcttctgatttagccagaatacccgtttaacaaatgtgttaatcgtgggcctaaaattagaagttataatctccaaatgaggatgtgtggagtgctcagcagccttggtgtgtggatgtgggatctgcatctgtatgaaagtgagaaactagagtgcctgcttctgtccctactccttgaggataatgacacagaccggcctgctctggggaaaagggaagagttgctgaaagaaaagccaaaggaaagagggagggaaacagtggctcccagcgtttctctctcaatcacatcagggttcaaaatctcctgagcagcccagggtggcaggcgggtttgtggcctacctgttctcccattgaattgcagagcccgttcttaactcctggccatgtcactgcatgtccattagcatggtctgttttagattgtgagttacgagatgatggggagggtggggatagatttaacggtcttgggtgcttgccacattttggactgagaccactgtttacaaacacaattaattaatttaatatcttttaatgtactttctgttctcaggttttctcattctaaccttattttcaaaagaccaatttttctgatttattttattcttaaatataccctgaatacttaaaaacgtaaaggtagatccagtgatgcaacaaggactcccaccagtcattatgtggtactgctttcactatctttgtggtgactacttggatgtgaatatgggatacttttcaatacaagaaacatatacaaaatataagccaaattttttcattcaaatacagttactgttactgaagactcttccacttccaatttccttgaaagatgccatgactctttcaaatgaaaacctgtcaggcttgttctcctcttctcttcggatacttgtcattttcttagaacttttctaacataaaaaaaaatcttatagtaaaatttgagtgtttgggatgtcagctaaattagatttctgaaataacaattttagaagaatttggagttgtggctttagagaaaagttgccatggcaacagcaacagaagtagtttagatgaataaacttttaacatatttttgaatgacccctttctgcagttgactgaaatatctggtaaagaaatgtataagccagtccaagtgcaatacagaggctaaaagcatctcagcactttgtggagcacgtgggctccatatttgccaagcatctctgtgccaggtgggtgcctctccacatgggcacaaatccctggacattgctctaggttcctagcttggtgatgccatgttaattagacccacagatgaataatagattagcaagggtatggaacattgagtttgctagaatgatttgaaaatggtaacataacacatagtattatttctgtgggtatctatgcacatgactttcaacagttccattcatgttaagatgccatttcgatggtctgagcaaaatgcaaaacacggtcttaacttttatctcaaaagttaaggcatcctcccacattagctactgattcacagtcaagggctttgtgtcgatcaggatccaaacaggaaacagataaatcactcaaaaggcttaatttgaggaatgaactacgccaatgtgttgacaggtttaaaggaaccaacggtgagtggtgaagcacccagcaattagcaacactgagaagctgttaccagggagggaccagcgttaccagagcccactgacttgcagccttggctggaagggaccctggcaatgtgtccagagaagactccagcaagggcaaaatacagagaagcagggatagactggaacagtaaatactctgacttcttggtctccctgttctccatctccttctgggcccaagcccagccaatccagtgagaccagcacagagaagggcagaacattttatttcctatttttgttgagggctggcgggagggggggtcggtgttgacaaacataaaatatcattacaagcattttcagtcttgtttggggtttgcttacatttatgaaagaccttaaattcctaagtatatagaagtctcccaaattgcttcaaatgtctctttcttccacactgtagattattttgactaccacatttaaagtactcaggtgctatgccagctccatccatacgtggtgtgcttgcttttaaggatttttatatcacaaacctattaaagcatttagtagagagtgatatattctacgtatattttgtcattaatctaatattggaaagttcattactttaaagtgccctggtctaaatttattagtatttattaatataattcaaaatatgtaaatgtattaatatagactacaattagattttttttccctctaagcccattaggatagtctaatgtaatttccttgccaaacaaagaaaaaggaagatttggtttggctttttttctggttgatgggtaaagggttttaactcttaaaattgcacatcaacacaaatggtctaacctgtgcttgactgaaaggcaattttcatttatctctgctggtcaaggaatggttgcagctaagtattgcagttaaaccgccctgtaccccagtaaattttagcagagagaaaactctcatttcaacctggactgcagaaagtacctcttattcttaagttagttcctccttgagtcttctgtgcacccactttcataaatattcatcctgcttctttggagaccatattcacaacagaaccagaaaatccaaaaggacgcagaccagaaccagggactatattgtgtgtgactcaatgcttggccatttatagcatgtgcctgatgcttagtatgtacttgagtgtcaatgaaattaatcagtgatttaaagctctcagaaatatttagtctgacttagagtaataataatagccaatatttattgaatgctctctatgagtcctgcttattctacatatattatctcacttaatccttaaaataaccctgtgagataggtcctattatcctcatttaaaagatgaggaaaccaaagctctgaccttatgtctgtttcagggccacacagctagtacgtagtggggctgggactcaaatccttgtctcttaatttgattgccaagtctgcatgcttgaatcactgtgcagtgggtgattgttgacatgccattggcttaaggtgatacctttgaggtaatactttttaaagcctttcattttgtaataattgaagacttataagaacttgcaaaaatagtactgagaggtcccatgtaccccttatctagcttctctcaatggtagcatcttatttacacaatatcaaaaccatgaagctgacattgggacaatcctattaactagactacagattctcattttaccaggtttttacatgcattcttttatgtatgtatatatgcgtgcagttctgtgcaattttattacctgtacagactggcatatccactaccgcattcaaaatacacagctggtccatcaccgcaaaagcactccccccatgctacccctttgtattcacatccaccctactcctgccctcatcctgaatctgggctaccactgaactgtctccataagatgacacattttaaattcttcctcctgttcttgctgcacggtggaaacattcctgtctccattgattatttacacccaaagcatccataaacataacagaagaaagtatggtgaattgatagggagatcagagaggattttggtgtgtccttgttgtcagcaatgcatatatatgtatgtgtatatatatatatatatatatatatatatatatatatatatatatatgtacacacccatataaagaacatcctgtttgttatttttagttgagggtttgagggttgtggtaattttataattccaacacctgtgttttcactagcaaactgcttttgattgaaacacggcagagtttatctcctgcgtaaatgcggcacactccctctttgcatggctgttctaacggcacatccatttctggaccgacaaccgcgtgactgaacttgcagcagcctggaaaaggtacatgagagctggcactctgcccttgtcagggttttccaaaagtatttacgaacaaggataaacacgagtcctgcatggatttgaggtagccatgaccgagctgggctctgggcagcacaacagttacgtaaaccttggcattcatggcacacatgcatttttattcatccatttcaaagggagtggccgttcgtagacctctcttggggaaaggtttgaaccttatcatgatgaactggttcaaaaaatccttaatagctgtttttattcaggattgctgaagagtgaaaccttatcatcgggacacagttagaaagacttcctgcatttatttggtgctcactattttaaaaaaggtgtccaaactgctgatgctgtctgattctgcaaacataggcaaacttactagatacttcacatatttcagttttaccatatgattatgacttgatatttattagaaaggaagaacattttttaaatgtagtcatactgagcccaactcttgcttttaatgcaatttaattgcattaaaattagacaggtaatgtcaccattaccacgcagatactttgtatcacccattgcaaacatctgtaaaggatcaaaggctcatgtagtgagtctaagaggaaacttggtttgagaatgaggccttccatgatatttctgtgctgccgcaggtgggggagggcacatttttatttaaggcgtcattagaaaggaatgaaatatagaactcctagcatgcatacatatatgcacatagacacacaaaatcgtactttaccttatagctgtgttgtctaaaatgtagaagtgtgtttgtatcagttagctatcaccacactaatgctgtgtgacaagctactctgacattcagtggcataaaaaaaccatcacggatcctagtggatctgtgggtcggttagggttggcttagctagacagagctcagctgtttgaccagaggccaaagtgtcaaggctcttctgtcaattctgtcccatgtgtatctatcctggggcccaggctggcagcatctacccaaagaagttcagcaatgacaaaggcacaagatggcaagtgggatcaactgaagactcttgagacgtaggcaggaatttgacacactattgtctccacccacctgctactggccacagcaagtcacatgtaaaagcctaacttcagtgtgtggggaaatgcactccttccatgatggggctgtggtaaggatgtgaagcaacgagggatgaagagatgggggaattgattcactttacctcagtgtttaatcagtttatcctgagaatgccaatacttttaagaaggtacaaatctatcctgattttctttttctgtttcgtcagtgagttctttctgtcatggatgtcaatatctatgtcatcatgacccaattaaatgacaaaagcagggttttgaggttctctcactgatatcagttcccataaatccacagtgattggagaaagactgagtagacattaagggaatatagaaatagactgaatgatattaacatttaaacagaattgcgacactcgtccctgtttccttgtgtgtagcagctctggttcctcaaactatcaaaaagaaaccattcagaatcacctccctggatactttttaaaatttatttttaattgacaattaaaaattaaatatatttatgatgtacaatatgttttgaaatatgtatgcattgtggaatggctaaattgagataatcaacatatgcattacttcacatacttattttttgtggtgagaacacttaaaatctattgtcttagcagttttgaagtatataatacattgttattaactatagtcaccatgttgaacaaggaatatgaacttactcctcctgcctaactaaaattttgtatccttgaccaacatctccctggagattttttatctgcttctttttactagtatcacttttaaaagatttctgaatttagctactgtttcaaaacctagaagaaattaaggatgaggtgatttatgaatgaaagaaaaatatattaatcctttaggccaaacacaccagaggcaacgtttggcaattaaattattaatttgatcaattttgacatgtaaatggataagctacattaaaagcaatgcacttaaagtacacacacagaatcttgtctcattgaagtttgaacaccttcaccatatcttcctctattatatcaacttgattgaacagttgccaaggcctgtttttttttccagtttgctctgtacgtgatcatatctagtagactgtctgccatattacggtagctcagttcttaaatcaggggtcaacaaactatgacccacaggccaaatccagacaactgcctgcttttgtgtctcctatgagctaagaatcagttttacatttttagatggttgaaaaaaataccaaaagaagaatatcttatgccatgtgaacattttatgaaatacagattttagtgttcataaataaagttttattagaacacagccatgtgcatttattgacatattgtctttggctgctttcacactatgatagcagagttcagtggttggttgcaatgaactgcatggcttgcaaagcctaaaatgtttactctttggccatttacagaaaaagtttgcctatctctagtctaatgctatgtctcaaattaccacagacactgtagataggtctacgttacatcagtatgaaggcaaaagaaagggacacatattgttggtatggaggggagtggtgggtatatttcagataagggcaaaatgtcagtgaacattcattgattcaccagtatatgtgcagaactgggtatgtgtatagcgctaagggaaacatttttttaaaaggttagtctccaatttttactctaaggcttcctcttgaataagaagatgcatctgcaagtatagtgtctgaaaactatttgccttgtccaatctctacatcactggaaaatgctttaaaaattttaagttaaaaatagtatatgtttcatggtttattttgcaattattctaggcagaataattttcataaacattgccattcttaccagtgcgaaagggagacttaaactcagaaaagtgtcatttactcatgggtttaaaatgctagttcttcttgtggatgtatctgagatttttatgttactgtatccagaactccctcagaggcaagaacataaagggcctccaggagctgactctaaaaacaccagtctcctgttctttaaactccgtgtggcttgctgagcgctcagccacaagagctgggggtgagccatctctgggtcctgccaatgcagccagtgttgtgccaaaggaagtagccctgtcttacactttgtgatgtttcttttggctgactcttccacattcttgtgaccctttgaatgaagacgtcttaacagctttagctctacaccatggcctcccgctatcatttcctgcaggtcttgtcttagagctcagcagcttcctgagtaaatgtcaccttggtgtcttctaagagggtctcactgaggttcaaaaaaccatggcttccaccagattgaaagcataatgtccacgagtctttgtctcactggactgtgcaggaggatgaacctggaattctttttggttttgaagcaacgagtaggtcggggcacagaacagagaaccaggaaaatgtctctgagggtggaaatcaaatgaccccagaggaggaaattccagttgaaaatagaaaccgggtcagcacccttgtgagagccacagcatcctagacttggaaagtggcaacctgtggcctgtgaaggctgctatcagaagtccatggactggcctgaaaagagtgttgtgttttatggcaatccaaattgaaacaggatttatctagcttcacagatgtggtctgctggagagttatgtggaaatgactcaatgtcatatatttgtcacattgaccaagggttatttctttagtaggaaaagacaattcgggaacaatattttcttgagaactatgatatatgcatacatgatggtggtagcttccaaattaccatggtacgaattctctccattgatggttaaggggaaaagggttattttgttgcagctgtacaatatcccttcattaattcaatgaaaagatctcaattaatgattattccttaaaatgacagatctataattaacttggaaatgcccacaatataatcatgttgctatgaaaagtgatggtttttaaactagtctaacataattccggattatctttaaagagaatttaatgtctagaaaagtttctgtagctctaaaaagctgcagaataggatgtcattttgggaagtttcccttgcttaattcagcttatgatccaaatttgaaggagaccagtagtccaggagttttgtctgcaaataaaatgaacaatatgtgttctaaagtgttttggatttttgtttttggtgggaggctggttagtcatggagcagggtagaattagtagcttttggctttaatcaggaaaatatcacatggtgttaaagtgctgtctattaattggttattataaactttaaaatgtatattatggtggagaaacttctcatttgggggactgtttttcatagcatttgtggcaacttttatttattacttaaaaattttaaacatcacaaacactgaaattctggggtagagataggattttcttaaaggagagatatatttttgatatatctttttctatctgtgtgtgaaagtgtaatgccttccagaaatccataggaacagaaaatagattagtggtttcctggggctgtggttgggaaaggagagtgactgtcagtgagccccagggatgttattgaagtgacaaaaatgttctcaaattggattgtggtgatggttatccaacgcagtaagtttacaggtgaagtttatagaatgtaaattacatctcaatgaagttgttttagagtatgagttaataagagaatcaaaaagtacttatttacaaatgaaggattaaaatcaatattatacaatcaaacttgaaatacgttagtaatggtatatatatattttttcctttctaggccacctcttagaaagttcaaaatctaataaatgaggggaaacacctttttattttttgctagttgttcaggattcagtgatctgaccaagcacccatttgtagttaagacataaacatcccactgaactagacaccagacttctaagaaactcgactttctaaaatcaaaagcaaaaacatatctgagcagccaccaggactgtctatataatttgataaaaatgttgcaaaactgaattaatagttatggttacacaatttggtacatttactaaaatatcattgaattgtacacataaaatgcataaattttatgctgtatcaattataccaaaataaagttatcttcctataaatatatgttcatttgtttatatatttatgtttattatatatgcatatataaatctaacgtaaacatataaataaatgtttatatatttcatatatatttgtatattttatatatatatatatatatatatatatatatatatatataaataatgtctgccagtgacacaggcccaatatctatattccacataatgaagtcatagcaacagggccataatcttatcttattcatcttattttgggatattttggccttaaccatgtgacactgaaatttgcttgggactgttgaaagcattccccttgtttaaagaggttctactaaaaacaacttttcacccatttttttgtttgtttgtttctctctttttattttttctagcacagtggtaacaccctattcccactttaacttcttttccttccttcttttttgaaaattttctaacttgtatttataattctcttgctcatcaaggtcatccagacactatggttctgttcatgtggaattttagtctcatagcaatcagtaagactgtcttgcgagagccggaaatgtgttcattaacttgagaggccttcctgctaagtggtcaaacatggaaacacaaagttatgtagggacattttgctctgtaaactcaaggtatagcatcatttgtttaaaccctctctattgagatgtaattcacatgtgatacaattcacccatttaaagtgtacagttcagtgggttttagtacattcacggagttgtacaaccatcaccactagctaattttagaatatttttgtttccccaaaagaaactccatgccactggcagtcactctctttttatctcctccaccaatgctactctgagcccctgacaaccattaatttgctttttgtctctagatttgcctgttcttgagattttccataaatggaatcatacaatacgtggtcctttgtgactgtctcctttcactgagtgtgttgtcgaggttcacccatgttgcagcatgtattagtacttcattcctttttatcaccatataatatttcatcatatggaaacatgatactttgcttattcattcatcaagtgatggacatttgtggtgttttcagtttttctgcttttatgaataatgctgctatggacttctgtgtatatgttttgtatggatgtatgctttcacttctcgtgggtatataactaggagtagaattgcttggtcattataggaactctatgtttaactatttgaggagccgccagagtgttctccaaagtgattgcatcattttacattcccacaatggtgtttgagggttccagtttctccacatccttaccagtacttgttgttgttattattattagtagtaatgtttagagacagcatcttgctatgttgcccagactggtcttgaactcctgggtttgaggaatcctccaacctcaatcttttgagcatctgggagtatgggcatgtgccaccacatccagctttgtctatttgatagtagccatcctagccagtgtgaagtgttttattttagttataacttttatttgtataacaaacaagaggcacattagatggtgatcatttgcttcacaacagtattttttgtagtcctccttttaaaatcacaaaaccacatatgaatttaaaaccagatccttttctttaaaaatagtccactgcagtctgcccatattccagcagtatccattatcaaagtaaagtgtacacaaaaggctccctccacctctccttgcttgagaatctgtgtcccctgagtatggatgtcctgctccaccttcacagtgtcaccttggaggaagtggcagggggtcatccacttcaaccattttccagccctggcacttggcagcaagacttggagaggccagaggacatgtggccacaggcccctgcttgtgctcctgagtgaacacttgacatagatatccagtgaatcatggggtgcaagccagagacaaccccccaccccatttcttgcaggctgtggatctacgtgtcggtggccctagttattatatctgttatgctttaaaagtgaagactaggccaagacctacaggctgatgattattaggtggattaacatacggaaaacactatagaaaagaaggaatagtttgtgcaaagatgctgaggagcaaagtggcatagcaagttcaagcaaatgagtgaagaaagtagcagactgagtgaaggagtaaggggaacagtagcagaacagagctttggagagatgggtgcggtggtcaagaaaaatggcagggacttacaggccacagagtaaggatattggagtaaggggaagttatagaaacagttaagcagtgtgagggttggaggatgcgtgtgtgtgtgtgcgtgtgtgtgtgtgtgtgtatgtgtgtgtgtgtgtgatgatcaatttcctcaattagaaaaaagagatgtgatgaaattgtgttacagccttttggacactcagaataggaggtcttttattgccaggatacccatagcattgccaccctcagatatcttgtaaactctggtaggaagaactcatggatgactactttgtcgtcctactgcctttaaatctgcttctgtctgttcccggcacccactgaacggcaatttctacaactctcaatttgggcagcagcgtccatactgggaaaactcttccatcatgcttcctcatagacccctattgactgggtaactgctgcatcggtcacctcctctccctgggcctattatagctatggctaagggtgcttccgttgtacctggatagagttttatgcttataagctgcttgtggctattaaacagagcaagaggaaactgtgtacatggaaggaactttgttgcccttctctgttacagacaagcaaaccaccaatgagagcaacaactttttaagaaatcctggcagacttgtggcaagaataaccaatattgtagttcacccgtgaggcttatacaacgtttgccacactgtatgcattgagaatctggttgcgatttttgttataaactcttccattccgcttccccctccctgcctccttacacacgtttacttcagtgaactctgcttgacagactaaccaggctgaggtctcaatctgtgacctaggagccagtgataacacctttgactaatggacagaagacttatagttctatttttgttgttttgattttttttaagttatagtgttgaagtcatacgttgtctttagttattaatcttactgcttccttcagcattttgttgaatagcatttcatcatgctttggttaagtgatttatagttagctcacaaatcccaggcttaagattaaaaagctactcataaattccttagaacattcattgtgccagcagaaagaaaaaaatactggactataggatatcattcctgtatctgattcctacactattcctttgaatatcatcccacacctcctccccgttcaactccaaatggccaatgaacacatggaacatacatacagttagccaataagaacatgaaaacatgctcaaaatctttagcagtcagggatatggaaatcaaaaccacaaggaaataccactttacacccaccaggatagtaatgatgaaaaaaatacaaagaataagtgttggtgaggatgtagggaaattagaaccctcataaactactggtgggaatgtaaaatgctgcagccactttgaaaaacagcctgtcagttcctcaaaaagttaagcatagagttaccatatgactcagcaattccactcctagttatctacccaagagaaatgaaatgtgtgtacacaaaaaacttatacatgaatgcacatgcattattcataacaacaaaaaagtggaaaaaacccaagaatccatcctaactgattaacagataaacaaaatatggtcaaccatacaagagaatattattcaataggaaaaagaatgaagtactgacacacgctcccacatggatgaaccttgaaaacatggtgctaagtctctcttgagctggacacaagagatcacatattctcttgtgattccacttacatgaaatatccagaataggcaaatccatggagatggaatatagattggtggttccctagggctgggggtgggataaaatgcagagagactaataatgggtatggggtttctttttgaggtgataaaaatattctaaaattggttgtggtgatggttgcacaactctgtgaatatactgaaaaccatttaatcaaacacctgaaatgtgtgagttgtaaagtatgtgaattatatctcaataatgtagttataaaaaatgaaccaagaaagccaagcaatgctagacatgcatggtctattccactgtaaggtaatagtctgtctaggcacatttacttattaaaaaaaaaaaaactccccatttatctatttagatgtttctttgttatatatgtgcttaacaatcttctcagtttacttgcagtttgtaggtgacagtttattttatgtcatgggaaactgaaacagaatatgtcaggactgtttacgtgaacacggtctggcctttcgctggacactgggatacagtatatttcaataccccctacgcacacatcccacacacattaatcagggccaacatgctgggagtaaccacgatggccaaccacaggatactaggatgctttttatatggacatttgtgggtgaatgtaccataatctgtttaactggctgatagtcatggtggcagtggcatatgtgtgtgtgtttacattgtgtgtgagtgtgtgtgtggggtgtgtgtgtgtatagtttacagcaagctcaggcggaatgctgtaagccaaacagtaccatgaatctctaaaaaggaaaaaagatcattatctttaaaagtgcattcttacatgctgtcaagtatttgaggattgcttttcctagctgaggctcagtatagtcttctttagtctgttgccaggggatcagcaatgggcaaaatctccgcccccatcccagtacccactctgtgtcatacattttccttgatgacttatgcgagtactttataatctttacaattctcggctgggcatggtagctcatgcctgtaatcccagcactttgggagagaaaggaggatcatttaagcccaggagttagagaccagcctgggcaatatggcaagaccctgtctctaaaaataaaataaaatattagctgggcatggtggcacacttacagtcccagctactcaggaagctgaggcgggaggatcacttgagcgagggaggctgtggctgcagtgatgatcatgccactgcactccagcctgagcaacagagtgagatcctatctaaaaaaaaattccttacaactctctaataggtttctttatatcattttatagatgaggaaactggggcttgtagaggctaagtaacttttccaaagtcacaaaaataagtggtgaagttgggttgtaaactcaagtccactgattacaaagaccatatttagggtcccttaagttaagctgtcttacatcttcccgaggagaaataacatgcttttttgctactgacttaatcataattattaatgaaactgaagtagaaattgattatttgactagaaattgattacacaacaattcaatgtttagactaagaaccaaggatttccaattaatatgccagagcttgccattaaaattttttaaattgtcatttttttcttatggatatgtaataatcatacagtaaacccttgatttgtaggataccaacctgcaggaatgactagtaatttttttaaaaagaaagaaaaaagaaattctccttaaaagtagaattgggatccagatgtgtttttacccagcagtgtcttccgtcatggatttgtcttatagaaggaaaaagacattccaccccagtggtgataggtgcatgaaaagctcattttgagaactaaggatggagaaagcaaagaggagcagagtggtagagatcacagtggcaacagtactggggtcacctgggacctcaaggtgggcacccatggccatgtggtggtagaagtgagaatcaacagagggacagcagtttgcccttcctgttgacagtggaaaagagagcagcaatgaagaagtagagtcaggaactgctctaacgtttgctggaggggcagccagcagccccttatattaggcctaccaggacgctgggtgccatattgaaaagatataacagtcataatggattgtcagtgtggatgcctgcagacatttgcttcatgtggtaatatcatgacagattcaatcagctctttatttaatctgtattttcacctataattatgcttataagacaaactgttcaatggttttaaaagacatgaaaatgtctccattagagaaatagaagctcttacaataagatagttagaatgttaaccctgagctatccaggatgtgtgcttatctagaattactcgttcctacatgatccaggctcgctgaggatttagcatactgggccttaagagctatgatctgcttttttatttttaatatttttggagatattcttccttcctgaggttacccaaagcagtatcctttggccacattttctttgagctctagattagaaaaacatttataaccacccacaaacacaaaactttttaagatgaggttttggagggtaaaaaacttatgaactgaaaagaaaatttggttcctgttggcagacagtgatactttctttgagttctaattatatggaataatttgtaaatgaattaaacaaatgcaaaacaaagggattatttttatgttttaatgtaaatgttgcattaaaaagactgaggattgacttgaatagattggaagactacttcattattaatgattctcgtgcttgcctttggaatctcttgcttggctggattatgtagaatcggattttaaggctttgatgcaaggatgacctcgatcctgggctgcctgctactctcataggttcttaagccaaaagttgagatgatttgcaatggtagggggacaagacagattagcaatgggagatgcaaagagtggagaggctcatcagagagatgaggaagacggctttgcctctgacccaggtgtgaatcagttaagtggtggaaattaaagaggagatgccaaaaagcaagaagtatcagtaaggcatagactggtgaacttggatatctgtaacatatttgcattcataaatgcaacgttttctctcttgccttgtgcagacctggcctttctgcatctgtgtctttttgaaacattacaggatattcaacattagcacctaattatgagcccatttcaatgttagagcctgttttatctctgctttaacgtggtttaagtatgtctgcaaaggaagaaagtttagttacattgttaaccatcctttttcatgtctcaaagagtagaagatttgtttatctaacagattttgccaagaaggcagtgaatgaaatttcagttttgaagtatatttgaagttaacattttgagatagggagccaagctcagtcaagcaacactttcctatggaagcgccttcctttgagctcagcataaatcatgccttaaagtaactttcagcctgattagtgttgtccaatagaaatgaaatccaagccacatatgcaattttaaattttataatagccacatttagataagtttaaaaataaaaagaaacagtaatatattttatttaacctaatatatctgaaatattattttaatatgcaaacaatagaaaagttcctaacgagatatacacatttgtcatgccaagtctttgcactattatttatttcatacttacagcacattttaattctgactagccacatttccagtactcattggtcacttggggctagtggctgtcgtatttgacaccagggctttagagaactgaatgagcaaccaaaagatgactgatttgactcagtttcctactggggaagttttcacatcaactatctctaactctcccccatacctacacccagccctgagcaccccaagattgctgaacttttctcacactgaaatagtcaggatgtcttatcttcacaggtggggaggatacagagctgtgttttcacatttcgtagtaaaattcagctgctgttctctgcccgtattctactcagctttgaatttcaaccccttggctttcccatactgagcagccaacgcaaactattgttttcaatgacacctgttcctttcgaagaagatgaaggcagtaagcagatttgtgcttagtacaaggtgttcaagtgaaattacctatttattttggtgatcaccctcccaaattgctagggtgtatcttcatctggagttacataaataggatttgcccacctcctaaatagagtgtgtgataatggaggtaacctaggcatcctcctacgctctgccacaactgatgctcaattattccccagaacacctaatgctttatgtaacagagctctgagagaataggggagtggcaggcaaaaatgaaatagatatttcaaacatcactcctatgtgaaacatatagatttggcatttaggtggaaggctcttttttccttccacttacagagtttgttaaattgcaagcatgccttggtgttgccagagcaatgtcttgtagctgatactcacagagagctagtgacttgtagacttctctatacaagcatagttgtggataaagccattctagaagggaggtgacccctgtacaataaagcctgggttgttgcaatgtgagatcaagagagcagaacaatcttctattttgttaattaatctagtatataaagtcttgcttaaattaggcataggctcaaagtctgactcacagtcttttatgttttgaaaatgttcaaagaaggtggaaccaaaatgggtgaaaaaaacttgacacatatttgaattgttctcatttgttcatatttgtaattctttaaaacgagacagacaaacgtacagcatacttttgtggccaagaacttgggaatcagatcctaaatctcaatgcaatgttgtactttgggtttgtgtttggaatcaggcatggtttcaaatcccaactcttgtatctactaattggatgacttccagcaagttatttgtgagccttagtattatatcataattgagtcagcagacctatctttcagagatggagtcagaattaagcagaatgatgtacataaagttattggacagtgatgggacaaagtctgactaaataataacaccactgaattttaaaatttaacatgttatcagatctccttcaattatttatatgtatatatgtatgcaatgaaaacataatgcactagcctttttactgaattattcttattctaaaacaggaaatatatacaatcatatggttttatttaagctaacaaacatttgctgagttttggtaatgtcaaataacttactgttggatactgaagggtatatttttgttcaggtcgtaagtatcctaatatcctgtacatatgaatggccgttaggtcacagcttccctcctgtagctcttaacatgtaatgcctctagccctgtggctctcaactgggggcaattttgccctcccccacccctactcccccaccaagggacatttggcaatgtctggagacatttttgtgtatttgcttgccacatcttggggagggtgctattggcgtataagcaagtagaggtcagagatgctactaaatatcctacagggcacagaacagcccctacagcaaagaattatccagacccaaatgtctacagtgcctaggttaagaaacatggtcttgatattatgtatttttctagagtttattatgtctttcatcatttgtgactttggccatgctatgaggactgtctagataaaaattgtccagtcatgagctggttggacataaagctgtgactacttgaactcaaggtgatacttacctaatagcatcgtcggagggaatttgttcattgggcgggaggctggattagctgcttttggatgctcttccaatcccaggaatcccgtgcttttcctcttttgtcacacaaagctatatttcagcaagaatctctcccaaactttgtgttcaccatgaccagcttcttctcagatcctgccatcaaggccaagcagagtatttttggaatgtggatgaatgtgacaagaatgttattcttaaatagcaattctgctatgcaacaccatgatacagtctcctgaatggatctgattccaagtggaggcttgaactctaatatttaatagtaaactatagaaaccttatcaagataaacagcactaggagtttttaattctatttacatgactagaagttgacattcatgtccttcttgaaactcagacccccaaatattgggaaagtcaaatacaatacggcacagtcacagcatgagtatcatacagtgatagttcatgctaggttaatgtcaaacattaagagtataatgctgaaatatttctggatgaaagataggatatctaggatttctttcaatgtaattgagtgggacagaaatctaaaagttggtgttttaaagagaaattggtaagccacagctgtgaaaatggaggcttaggtggtttgcatattggctgccttgaactgtaaattccacctgaagcagaggtaaacgacagtgcttttagccagggggggacggggtgcgggggggcacgttcattgacaatattattgcaaggtatgttggttcttttttttttcatgactggaacaatgaccagcttcacttcgtcaccttctttctcttctatgaaatgccttccctccttaaacctaaatccaatgcatccctgaagacctagctcaattatcccctccccctggaagcctctaaggtcttccaaattttattaatacttctccactgaactcctgcagtgatgcatcttttgcatgttttaagaaattgaggtctagttcacataccataaaattcccctttttaaaagtgtacaatttagtagtttttagtatattcacagaattgtgcatttatcaccacatgttctagaacatcctgatcacctcataaagaattgctgcattcattagcagccaaccacccctccctttccctttaacacctctggcaactactaattactttctgtccccatagatttgccttttatggatatttcataaaaatagaatcatataatatatggccttttgtaactgtctcctttcacttagcataatgttttcaaggctcatctatgttgtacatgtatcaggatttcattttgtggctgaataatctttcgttgtatgggtacgccacattttgtttattcattcatcagctgatggacatttgggttatttccactttttagctattatgaataatgctgtgaacatttatgtgcaagtttttgtgtgtacatgtgtttttgtttctcttgaaatgaaatatagctaggagtggaattgctgggtcacatagtagctctatgtttaaacttttgaagagctgccagacagttttccaaagtggctgctccattttacattcccaccagtgatgtaacagtgatgattaaaagcaatggcaaaaactgcaattacttttgcaccaatcttaatacagggattcagatttctccatatcctctttgacattttaccctgcacaagtctgttgatgtcactatttgtcctcaggattgattatcccacatcccaaattagtctcacctcccaaattagactgtaagctacttaggacaatgatccatttatttggtctttatttaagccagtggtttttttttttttttttttttttgattgcttattgtgtggcaggaactggtaagtgctaaggctttaattaagaagctctattttgtgggggaggcacataaaatcacactggcctgttttggggtgatgggtgcagtaataacagcctattcaaggtatagcctttgcttcatatagtttccctcccacaatgtcatacttacaaacaccactcaagtctactatttaatacattctattagagaggaacagatctctgtgtgtgtcctctttttagtccaaatgtagaagctctgatttttctgttgggcttttgtgtttaaatgtgcttaaagaaatcaatgccagcaatatttctagcagtaactttggatgtaccatgtaagttattttgaaacagtgaatcatcacgaatgttaatctgttgacttgtatgtataaaagcttcttgagactctaggctaaggagagacaaagcatcaaaaatgtaattcctctggattcagaaataaattatccacatgccattttcacctgcagttaatctggttttatgtttgtctttctgcaactctcattcagtgttttggagaaattaggacatttagaattcctaaatgacatcaaggataaaaggaatcaaactgcaaactgtagaaaagaatgcattgttatactatatataaaggtataattatataattatgactataataattaaaacatattgtgcttaacaatagtatcaaattgttttcatctgagttcttaattacctaatataaatatgtctatgccagccatgccaaagcaggtacctaaaggaatttcttatatctaggaaaaaacgtattgatcacctcatgcatttaagggacaagaatggcactttcattccagcttataaatcatgtcaattttaacaatgacttaaaaattcttttgtgatttgtttaaactctgaaaagaggcttgtttgtgttaaggaaaaatcaaactgagaatgagttatgtgctcatattatatatagatgagtaaaactcttactccctctgcaaacattagaaaacaataagatactcccacggtttctttttttttttttttttttttatagcacttacgcagtccttactatttaacaggcactggtttagaatttttacaaatacttctttaatcttcataacaaccctaggaaacatatacaattattatccccattttacagataaggaacctgagagtttcagtaacttgtgtaaggtcaccaggtagtgtaagcccatgagatttggcaccttttccaaagtggagtaggcctgccccagagtaaagagtgcctgttctagtctttatctcaaagaaagcagtgatttaattagttactatcaatgtggggaatctgttggtctgacatcattctaggtttcagaggcaacttggctgcaggttttgtttttgttttcgtttttgttttcatttttgttttgagacagagtcttgctctgttgcccaggctggagtgcagtggtgtgaccttggctcactgcagcttcgacctccctgggctcagttgatcctcccacctcagcctcctgagtgcctagaactacatgtgtgtgccactacacctggctaattttttgtgtttgtattttttgtagagatggggtctcaccatgttgcctgggttggtctcatcctgggcgcaagtgatccgcccactttggcctcccaaagttctaggaaaacaggcgtgagtcaccatgttcagcttgcaggatattttcatacagcttaggagagcaatgaaattaaatgtgagagataaaatatacattgtcacctacctgtttgatggtatatataatggattatctataccatacattatacattatagataatatatattatattacatcttcatattatgtatagtcatgctgtctttgatatacatacacatatatatgcatatgttatacacacacataaatgcttagccccttgcaggctaccctttcccatgtgcttccatgtcttgggtaataattcttctcagactttcaggaagtacagtgctactaatattcttggaggttattattctttcttcttggtgaagaggatgttgaaagatcaataatttccatctatctccagatagtaaggatgccttgtaggagagagatctgaagaccctgacatgtccacagctttgcagcctgattctgacctttctgctttgggggcaacttccatcaaaaggagtttcttgtcgcagttcttacaggcaggggcatctcacaacagttgctagtaatgataccatctactcccaagaatgggaaacctatactcatctacttggcctcccaaagatggatcccatttagggtgtgtgtgcacatgtgtgtgtttgtgtgtgtatatgttttaaccaaaataattagtgttaccaaatctctaggcctccatgcctagaggatctctcattaagtaggatattctatgcgctcatactagaaagttataaaggcaaaaaagacactagattaaaactgataatgtccatataggttctgagatttttttaaaaaaaagtctgagcttatgttaaacagaggtaatgaggataatcagttgtataggcttccctaatgtaagtcagcgtctctcatcttggcattcattccagaactgtttttaaacaggcttgcatgtgcacagtatgttaccttgccttctaagtactgtcagaattggactggtacctagcaaaaatatcaaaattatgagtcctagaacagtgcttggatgtaataagcactccgtaaatacttttggaaaaaatatgttgatcaactacggttttattagataatttaaaaaagataactttaacccctgccctctctggaggagagagttgctacagtaagagggagcagtcatccccagacctctctttgatgcttctgggtgtaagaagggcaattgaaaagggatttaggaaacaccaggcatgctgggtgagtaatatggctgccacctaagagaccatcagggaagtgtcttctgtggtatcatgccctgagccagaatgccgttgactgcttgactctgaagaaattttaaagtgttcctgagggtgagagaggtcttttgaatcagggattctcaaggtagcctatggtgatttgaaatgtttacattttaatatcacatatactctcctttctattggaagcaactaaaactgatagtgaagacttatgcttttgctgtaaagagtaagagttgcctatctgtggtatgatagtactcctagagggtgattcataggttaaaccattggaacagaaaagagaaaatatttttacttggccatgctctcttttttaaaaacaaatattactatttttttaaaagccatatcactggcatagttttcagttgtttttacagtcggttgctctttaggcttacaatctttaaccttgaaattattcagagataattatttttggaaggaaagtgacaagggaaatagttatgtagtcaatttttgattatccaagatgattttgccattagaattagtatcttattttagcaaatagcaacagtcaccttctctctttgctaacccttggaacaaaatgttttataagggaacagaactgaattttatttctcctcctgtgccccgggcctgtcttatattttcactgccggtagtacctaatgttttccccatttcagcagtatgctggagccagcttgcgttggctggagaaccagttgtgtgcatctcttcctaactgcatgtcctgtgtcctcaccttggtaccctggaatccgccacaatgagtatttatattatggaaattaacaaatggcgcaaatcagagctttcctccagagaaccagttgttaaatgttttatcagcacactgctgccccattgagtccttcctttttgttttttgatgaatattttctaaaatgtattagatgttgctgtctttgcaaacagggtgtaatagaaaaatttactatttcctggtcccattattatacttcatattgctgggttagcttcttagtgtttcttcacttttcccttcagaagagggcttcttccttctgaaatcttccactcagttcttatgtgttgattttgattgcccttagtccatcaaatgagataaccaagtccataaatgtgcatgtagaataaaatgagagttagaggacttctgttacagaataaacctcttgaataaaatgcatggccttagtccagaatttttgtgacaactagtttgattgccaacaccagctttatgagtatcctacctgtgtggtcgcacagggcccatgctcagaaggacaacatgactaatgttctgctgtcatcattttaaaattattaatctgagcaagaggtcctgcattttcattttgatcagggctccataaattatgtagccaatcctgatagttgttcagatgccttttttgcttctgattttagaaagctgaatttcttagaagtctggtgtgtagatcagtgggctgtttctatattaaccacagatggatgcttggtcagatcactataaatactaaataagtagtaacaaaaaaatgatgtttattttcattcattatattgtgatttttctaaatgggtgtcctaggaaggaaaatgatacattataatgttactcacttattttgaatgtataagattaattttaatccttcacttgcaagtaatttctggttctcttattgagatatatttttaaaataactttattgaagtaattttacatcataaaatttactcagtttaagtgtgcaattcagtggtttcttaataaatttacagagttgtgcaacattcccacaatctgtttagaatatttccatcatcccaatgaaattgttcatccccatttgcagtcattccctgttcccacccccagccccaggtacccactaatctactttctattggaacagctttgccttctatggacatttcatatgaatggaaccatacaacatgacatgtggtcttttgtgattgacttctttcactcagtattatgtctttgaggctcattcatgttgcagcaggtcaatgcacaactttacgctaagatttataggatatgtgaggttggtgtaggacaaataatgcttatctacttatctgtgagtgcacatttatttttgctgaaattttcattgagaatggaaaggtagccccattgcattctacaggaagtccatttttggcttataacgcttatcattttggcaccttctggatcaactactcaccctaccttctgagaaactttaagctatttatgagggtgtaagtgaacttaatatttgagttcaattactaccaagcacactttctggaattactactaaattgcaaacatattgtagcagttctaaagacgcttttttgagttaatgttcatcaatatttaaaaaatatttttctcagtattaaaacaagttaaaaataccattgataagaattcaggctctgggctgagacagctctcagtggaaatcctagctctgcctctcaaagccatgtcctaaaataagctattaaatctctccaatacttgatttcctagattatgaaataatactacacactacctcagagaatcattgacagaattaaataagtcaggtaatgcattgaacacagtgcttagtacaacaaatgttactaaatgtaaacatttctacaatgatgagtgatgattctgttatgtacagatatgtactaccatttgctagtgtatcacaacagaatagaacacatcatataatatgatgcaagttatattaataacataatgtctatgcatatattttgttatatccatagaaaattttaacaaattaatagcacagtgtgtggcctttactacactcaacaaatgttagttatattattattatcattattacttacaatggctttcttcagggggaggaactataggagatttcttcttttcacagtatatttctgctgtttttggtttttgcttttgtttgttttctttaaaaaagtattacttttttaaataggaaaaattaaagactaaaaaacttaaattgctcttgaatagatttgtaatcattatcatatactctcttaaatcacttattattcaccttttataatctttggaataaataataattaaaacttccattttctttaaataagaaaataatactgctttataaatactcagtaatacaaactaactgactatttcctgaatttgatagtgtctttttcaggatatccttcttgtaattcagtaaatagaaagggcccccattaaaaatcacatggagaaagtagggtgtagggttgggacaaacacaccaacgtgacttgccttgtatctcttatttcccattttagatactggtgggttaaatttacttaatatcaagttcaaatgtatgtacagtcttaggacttggttgttgattcttaagagtgtgttgaaaaaataaagaagtcagctaggagaagttgaaagaacttagactttgaattcagatgcctgcctttgattcttccttctgtgattttgtgctctttggcatctcaaaaactcagttttcctaccttgagaatggggaaaatccccaccctatgagtttttcataggcatcaaatgagacaatcaatttgagattaagctataaatgtaaagcctcctccaaaatgctagccagtgtgattttttaataaggtcattatttttcttccttttaggatttctctctcccaagaccaatagtactaaccaatattcaggcttcattcatgtttcagcagggcatgggaatggttgtgggtttctttgagctcactggccatttattgttattgattaattaactcgtgataaacagctggtgaaaaacccaggataaggaaatgagagtgatggggtggggttgggaatggtacataggaggaggctggaatgatgaacaggaaacagccatgcagaactctgctgaaagagccttccagaaaaggaaacgcaaaagctaaggctggggcaagttacctgtattaatataagataacatcaaatgggctgtccttccagaggagtaactgagcttcctttggtctacaatggaatttcttcccattagaaaatttgacccttttttcttgcaaaagataagccaaagatatgtgaattgcatgacagtgatttaggatggaacaattccttatttgaggaatgcttctttttctattttacttctgtgcccacatagcacccagcttacaactaggagcttagtcatagacagttctcaatgctggctgcacattagaatcaaacaggaagcttttgacacctcactattccaagtgtgttccttagaacaccactgttgacattgcaaaatgcagaatctcaggcacaccccagacccactcaattagaatctgcattttacgaagatccctaggcaatctacatgaaagttaaagtttgagatgtgctgtacaatactgtgccaaagatcaagcttcactcctagagcttctgatttatttggtctgggaagaagcctgccttggcatcattttaaaaaagaaaaagaaagcttgtaatctccaactgatgagaacgtacagcaaaacttgaagaccactgacttgattgttctcactcacaggccctcaatcactgatgactatcaagcacgtggaaatgggattcatcaattatttaaattgcttgtttgagagtaccagttatgttttaaagttttctggcttttttttttcttttcttttctttttttaatcatactttaagttctagggtacatgtgcacaacgtgcaggtttgttacatatgtatacatgtgccatgtttctgtgctgaccccattaactagttatttacattaggtatatatcctaatgctatccctccctcctctgcccaccccacaacaggccccggtgtgtgatgttccccttcctgtgtccatgtgttctcattgttcaattcccacctatgagtgagaacatgtggtgtttggttttttgtccttgcaatagtttgctcacaatgatggtttccggcttcatccatgtccctacaaaggacatgaactcatcgtttttcatggctgcatagtatttcatggtgtatatgtgccacattttcttaatccagtctatcattgttggacatttgggttggttccaagtctttgctattgtgaatagtgccacaataaacatacgtgtgcatgtgtcttcatagcagcatgatttagaatcctttgggtatatacccagtaatgcgatgtctgggtcaaatggtatttctagttctagatccctgaggaatcaccacactgtcttccacaatggttgaactagtttacagtcccaccaacagtgtaaaagtgttcctatttctccacagcctctccagcacctgttgtttcctgacatttgaatgatcgccattgtaactggtgtgagatggtatctcactgtggttttgatttgcatttctctgatggccagtgatgatgagcattttgtcatgtgtgtattggctgcataaatgtcttcttttgagaagtgcctgttcatatcctttgcccactttttgatggggttgtttgtttttttcttgtaaatttgtttgagttcattgtagattctggatattagccctttgtcagatgagtagattgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctacctggaggcatcatgctacctgacttcaaactatactacaaggctacagtaaccaaaacagcatggtactggtaccaaaacagagatatagaccaatggaacagaacagagccctcagaaataataccacacatctacaaccatctgatctttgacaaacctgacaaaaacaagaaatggggaaagtattccctatttaataaatggtgctgggaaaattggctagccatatgtagaaagctgaaactggtttccttccttataccttatacaaaaattaattcaagatggattaaagacttaaatgttagacctaaaaccataaaaaccctagaagaaaagctaggcaataccattcaggacataggcatgttttgtggcttttaatgaatactcttaataatttgtaaatctttctctagaatagacttctagttcccattagaactagactagtggttaacattactgttatcacagatcagagactgggatgcatgataagttttccttgtcttccttcagctctaaccacaccgactttctcatgtttgggggtgatattatttctcactgtatttgcattgcaattctgaaaaatatcttcctatcccacctctgttttgttttccatgaagtgagcaaatttaccaagtgatttggaagaaatttatataattgtatagcttgaaaagcctttttttcccctacaaatgtattatttaggacatgtaaaatttagcaaacacagatattttaagcataatttactaaatattgatgataacgcatgctcagaagtcttcatttagaggactctcaatttgtctgagtgtaaactcaattccaacaatcaaaataatttgatatctggtttttgctttagcaacttcacttggttggccaatgttttaattctccagtccttgatctctcattgtggtaaacccacaggataattttattagtgctttgattttctgtaagaggcttttttgtttttctttaattcagcatataattggtgcatgtttaaacttatttgtgtttcggttgaaaggcagttattagtagagagtatcaatagagagttattatagagagtattagttattatttgcagaaatgttaaccttactatctagagcaggatctttctgcctcagcacattgatattttggactggataattctttactttaagggatttgtcatgcgttgtagagtgtttagcagtgtccctggtcgatccccggtagattccaataacaagctgccaatcatgacaataaaaaatgtctgaaatattgccaaatgtcccctaagggtgcaaaactgcccccagttgagaatcactgatcagtagagatgaaaacagaaaaagaatctgtaggcattttgtgacctaaataagacattcttatctccgtgttgctagcttttattttgtggctgagtgaattgttttcagtgtgaagaccaatggtacactggatttctatttaaagatggtttcaaatatgtaaaataattgatagtttacaagccacccaaacatatttccccacttccttttctgagtttagttgagaaaattttatatgtagaaagctgaaactggatcctttccttacaccttatacaaaaatcaattcaagatgggttaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaagagaaaataccatcagagtgaacaggcaacctacaaaacgggagaaaatttttgcaatctactcatctgacaaagggctaatatccagaatctacaatgaacacaaacaaatttacaagaaaaaaacaaacaaccccatcaacaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttagaacggtgatcattaaaaagtcaggaaacaacaggtgctggagaggctgtggagaaataggaacacttttacactgttggtgggactgtaaactagttcaaccattgtggaagtcagtgtgttgattcctcagggatctagaacttgaaataccatttgacccagccattgcattactgggtatatacccaaaggattataaatcatgctgttataaagacacatgcacacgtatgtttattgcagcactattcacaatagcaaagacttggaaccaacccaaatgtccaacaatgatagactggattaagaaaatgtggcacatatacaccatgaaatactatgcagccataaaaaacaatgagttcatgtcctttgtagggacatggatgaagctggaaaccatcattctgagcaaactatcgcaaggacaaaaaaccaaacaccgcatgttctcactcataggtgggaattgaacaataagaacacatggacacaggaaggggaacatcacacaccggggcctgttgtggggtgggggaagcggggagggatagcattaggagatatacctaatgttaaatgactagttaatgggggcagcacaccaacatggcacatgtatacatatgtaacaaacttgcacgttgcgcacatgtactctaaaacttaaaggataataaaaaaatttcttcctttcttccttctgaattttaaagctccttaagtcaagtgaaaaatctagtcatttacctgcgaagttcaaataaggaaatgactttggctacaattattggagtgcttcaggtgcaagtggctgtttgggcctgataatttagagatatgggacctcacatttactctctctgcatgcaaagcagtgggtctcagccctagctgcaaattgagatcacctgggagctttagaaacttcatacccaatccccaagccccagagattccagctcagtggtcgagggtggtgcataggtattttgtagagctccccaggtaattctagagtgcagtcagggttgacacccactgatgtaggtagatagggctttgctgcctttctccttcattgatcactttcccacatttccctgtagcctgctttcttcctgtctgcaacatcctggtcaaactcttctgcctatcccttgttattatttttaaccaaatgattttttccaagtgtttttcctttgttcagacttggacttggcgtggaaactgctggatcagtctacttaatccatgaccttctttcagctgctgccttcctttcaactgctgcctttatttcaactgttaacctcagtccaccttaaaaaatatatatggtttttaagcgggtatttcttcctttgccagcaaatcattatacgcagttcctgtctatgtttaccaccatcacttgcctctatttctttttccttactgctatttatagtttaattttctttcttttctttgtgctcttttttattcatgtttccatccttagatgacatgctcacgttttgtgaattaggtgtgtttcaagatgctgggaaagtaagttttctgtgctttataacttcagacccgtgtatttggtttgtgtcttatttaaaaatgtatgttcttatggccctgtttgccccacctaagcgtttaaatgtgacacctcatgtctgttgggctcccaggttcctattatggccggtggatctgggccaggcaaaccatcctaggcctcaggcatctcgtcacgtctagattcacctctccccttcccacaagacaggctcacctgccttccagccctgtagctgctggcctctccctgaactccgtggtctctagcaacctttggacttctaagtaatattgcaaagatctttatccttggcttgcttgagagcatttctgctaagccctaccagcaactttcatcttgtttcctcagttagttcttctaaaataaatcataaattgccccattgctaaaacttacgtcacattctttcaattctagtatctgagtcattgcaaaaaggcatctcaggttcgttccagagatttggcaggggagcttcccacaactcagcaaagtgtttggcccctttgggccttttcactgagacttgaggctagatttgctgtgcctgctctgtcctttcccttctaatttctcaggaattgtctttgctgtcttcttgtgttctctgagatcacacttccacagctgttccagaaacatcacaccacttgtatttttttaaagccttagcttttgcttgtgggttcacttgtacaagaatattaacgttgactctcactttgtgtaatactagtatatcaagctagtcttttaaaaacaccttttttaagcctttaagcccaatttatatatctcatttttttatcatttttgcattaatgtttaaaaacaaaacaaaacacaacacctttcttttgatcccttaaataccagctagtgagactttcaaatctagcacttaattttttactgagcatctaaatattccttacaaaatttaaacttctagatttaactcatcagatttcctcaaacacttaaacagagattgcaaacttaaatcattaagtcccaagtattttagttaaaatcataagttcgatatgtcagattctccaaaacaattcaaacacctcaaagaacaaataaaacttgcatatcctaacatgttgattccagaagttatttttacactcaactcaattgtattaataccaaagtttgattaatttcttcatttgccccatgtattttatcaatattactactagtacctgattagtattaatactggtagcagcattatcattagtattcataatagtgttaatgctagagctatcatcattattagtaccagcaccagcactattagcatagaattagccttggtcttagaattatattagtattagtatacttctcagagttgcaaggttactgacccaaataaggaaaacagaaatgatagatacagttattggttgagaatgtgacttcaaatttataaattgggggttttcagtcagagattttggaccaagacaccaagaactagggtttgccattctgattcctcaatcccactgggcctttattgtgctatagtcatttatacagtagtaagaatttctaagcttcaaccttttcttgtagtctggtgaatcatggtcatttatacttaattttcttacagtgttttcttatgtaatttttattgaaaatttctgtgacaactttttattgcctgattggagagggtgaccaatcatccttgtttttccaggactggagggtttgctgggacatgggaacttttcagcgctaaaaccaggaaagtgtccaggatgactggttatcctagattctaggccagtggttctccacccccactagaatggtctggggaacttttcaaacataccaggccccaagccccacctccagagattctgatttaatttgtctggggatagtgcccagtcattgatattttttaaattttctcaagtgattttcctgtgtagccaaggttgagaaccatcattctgcattctctacccaatttgaaacaccctatgcaacattgtattgtctactttgacctcctggaacttagcaaaacttgaatttgacaagcatgtgtttgggttcatcaatgtgaagtatttccagtaaatattcctgggggaagtcatgcacatctttcttgagcagattatgttatttgttgtttttgagtatatgtgttctcatgacttttcacagagttttttgttgttgattaaactgtcatgctttcattagtgacaactgcattaagctggtccatttgtccagttagcaccacccttgaaagtattcaagcttcttggtaacaacaaagtgttccagactcatcctggtttttcctgccacaagacatggaatcaactacttttcaaggatccctgtgtctttcactttttagttgaaagttttagagaccaaaatcttggctacccgggggcacatcgtgttgttttacaagagcattcatagtaggtagatcttggatccatgatcttatctgaaattgaaattcttaattctctcacatggtttttgtgcatccccattgtccatcctgtagatacttttttatccttattctttttttctataaatcaatatggtgttctttgtgtttttttcaagcattaaaattctgtcactcttttatttactttcctttcaaatttcaactgagaatcaggaaaactgtgtgtatagacttcatttattttctagtttattctgagaggcaaggggaagcaccctgttgtcttttccaggcacaaactctatttccttttatagtttgataatttcttcgttctccagtactcatattttctgaagagtcatcactccttagcttatttcttcataagttatagccaactgagttttatacatgaagtggaaagtggattttcctctgaaatgagaggaagtaggtattttgttgccttttaaaaagaggtagaaatgtacgagcaggtcaccctctcagtcctcatatgggctgataatttgtacctgagactatagatttaggatatggggcagaaattgagtcagaacagtacagccaccaatggcagagaccacaggccaaggctcaaaaataaaacccacataaatgttattttagtgagttttgccctcatcctgggttgttttgtagggaaagtgatgggagagagaagggggcatatcttaagaaggcagtcccttttgcagtgttttctgacttaatcttagacctaactcttaattttagaattcactctgagaagatattaggcaaactcttactatcaaaggatttccctcatttgggatcctgagtttcgtcaagtcacttcagatcagcaataaaatccccttgagagtttccagatttttctccacaatgaaccatgaagcatgctgtttatttgtggaactcccactcctggttcttcagaactccttcatttgccgatctaaagatagcaaaaaaggctcttaaaaatacacgccttattgattttggaatgttctggtaaatgccaatctgattgatgtcatttatgtagggaaggctttggcttaagccccaaagtgattttagccaagaggaagtaacgtatctaataaataatgtggagtttgtgtattcatccaccaaataataattatcatcactaaaaatgtgactagagatgccacatccacttctccattgaggtaaatttctaacagacaaagccaagtgaaatttgatgtccgtataagctgctttgacctcgttgtttctgactttcattacagatgaattttcatttgtaattttgttgttgttttttggtttccttggtactttgatttgtttgggcaaaaactcagtgaatctgtagtgatttaggagacagtttaatcaacacaagtgcccatgtttcagactcagacatgcaggtgatatttattctgggtaattttgggggatctacaccttttgtttattctaagatgacgaagctgcattattattttatatgtaacatgcactcattgtaaaaaagttgcaacgatagacaaaattataaagagtggattgtaataagaaaaaattctgagtacatggcaggatccatatactatgtgtattcttgccttattttattgggacaacaatgaaaataggccaatagtttatcacatgaagagccagccttcacaaatacagctctgtggaattgtatctgagcataaaaacactctttatttaattattattaatataacaattaccaataacctttatatctatctatttacttatttatcttttcctgtggtggggggttcaaaggtttctgggagtgatcaggatgcccaaacttcctctaactttaaaattttaataagtaaatgaagaaagctccatgttttcctcctagagtttaattagctactaatataagttgcttagcccaggatctatcctatggtggtaggtgttcattatgtttagctaaaatttccatcaccattatcatctttgtcatcattactgccatcactaccacaaccaacaacattacaatcaccaccactgtcatcatcaccattgtcatcatcctttaatactaggcttgaggaagctaaagggagccaaatgtacatttatgtcttatgtaacattaatgttacttgtcttattcctaatgcctcatcttaaatgtaaagaaagtaagaagacccagagatagttaactttgtcgtctcttgactcccaggatcaaaaatagttgttgctgcagtgtttggaataaaaaagcttaaaagaccttgtatacaaaagtggttcgtactgccttctctcgtgaattcatgccagcagatatttttattctggtaggaagtaactaaaagctttgttcaaccctggtctgccagcctctgtaacgcacgtctgacaaatatgtgtgactctgtgagaaagtttggttctccccctggtggcaaaaggaaaaactaacactagtgctccttatgggagtgtattgatagggtacgagatatgtaaatacagctttacccttttcaccagtgttgcctgagatttttatctcagcccccttggttacttttgttctttggacaacaactggtttatatcttctatggtcgttgggatgaaagggatttgacaaactgacaaagcattttgcttcagaaaccacttgaaaaacacatctatgtttcaaataaagattatttcaggatcataaaaatatgctcggtgtattagccatggaactagattttaagcttcatgatcatagagatagatattgggtttattttattgttattgcctctgaactgagaaaagactctagaattctaaatataacgcacacacttgaactaagtagacggaaacttacccttctaggtaggtaactctgcttaccttccaaacagagtttggatgatattgcctcatagaaagattttttgatacaatactcaggaaccgctatggactgctgctttggggccaggccccatgccacttgattaaatacatcctcacttaacctgtccctacaacaactctgtgagggaggcatactcataccgaagctttagccatgtggacactgctcccctgaaccacatgcgtagtcaaatggttagggcagatttcagctcatgtctcttttattcagaacccatcctttaagccagtagttctcaatgggggtgatttgactcccagaggacacttggcaatgtctggaaacatttttggttgtcatacctggagaggtgctactagtcggtagaggccaaggatgctcctcaacatcctgtaatgcacagtgcagcccccacaacagagaattacttggtccagatgtcagtagtgccaaagctgagaaactgtactcctaaccagtgctactcaaaatgtattccacggaacagcagcatctgcaacacgtgggagcttgttagaaatgcagaatcacgagccctgtcccagacccagtgaaccagaaactccatggttggagctcaggaacgtgtgtttctacaagcccccaagttcttcttgcacactcaagggagagaagctctgctctaaaacaacagatcattctgtgtctattgagctagacacaatcgtatggtttcctcaccactttcagtgttccgttgtcgcatagaagtatctcctcaagcatctaaaaggggaaagtctggcgtacactaggaacaaatgtgactcatggggaaatcagtgcaattacaaatccaggaaccacacccagctgaaaatctaggaaggttctttttctcttattttctctacttaagaagggaagtctcggagacttagtctaggttcaaaagatgtcaacatatacacaggcttggtttggggtttgattatctaaaattaaaccttaaattgaattaggtaaaacccattttggagagccacagaattctaaattagaaattacattgagtttcgtatttactggcccaaataagtaatcttctctatttgtgcatttttctaatcacaaattgtcttctgagagccagtgaaataattatttttatatgggtctctcttcaataattgctcatcacttggtattttatgtgatttttgtggggcatacattataggcaaggatgtattgtaaaggataaaaatgtcagataaaacatctgtgtttaggtagtttgtacgtcactgtcctccatcccacctcatagattcctactgcttggctataactaagagtagaatttaaggctgacacaggaaaccaggcaatcaagttcattaagtaccttaatcaactctggccagaggatgatctcagagctcccctatctcaagaagaaatttcatgagaaagctttggggttacttccagattaaagattatgttctggacagttcaagccctaaacaacagacacatgaataagtggagccatttctatcatactttttcagggactgaagatataaatattgctatttgttattaaaggattttgtttgttaaacctgatgatacttatttttatgtgagttcatagtattccagctcttcaaaacctaatttgtttgtagatccctcattgtcatctttgaaaggttccagtagtttctggaatactttcttttcctatgccaaatacaacagtgaccaagaaatccatctgaaggatttggatagtgtggtagcatgtattgatggacccagtgttccactcatccctgtatacatgctctttaggtaacatgacagtgccctctaactctgactctggagtcagccttttgactggctttggccaatagggacatggagaagtgatagcatacctgttgtaatcctagacctcaagagacctttcttgttcacacttgtccacttgtgcttctgccatggccatgagaaggacatgtctgagccggattgctggagaggaatgagagacatgtggcgtagagctgcatagctaagcaactccacccaagcccagcctagagcacagccccctgcagatgcatgagctagtccattcaggatcaaccactctccagcttccgagtaggttattacacagcaatagctgactgatacacatgagtagagaagaaaagaattttccaagtaaagataatagtattgataaaaccgtgaagagaagggtctatcaacatgttggatcacgagaaagttggcttgagtgaagtagaacacgcttattgagaaataatcaaaaataaaactggatagagagtgctgactcaaattatagaggagtttaaaagccagccaaaagaatcatagtattgtgtgaaagtgccatagaaataatctggtgccaggtcttcaactaagacaaagtgattagtggccaaacaataatggtacccaagtcttaagtgtttgtaagtgatgcaataggaagagataatggaatgatggaacagggattttaggaaggtaaatacaaccatgagttagaaggaatggtttggctgtccctagacatattacctgtgagacttttgtagtattatggaactggagtcatgaagctctgaagcagaggatggtcttcgggaatggaaaggatagttatggaagaatttttgagaaagaaaaaatattccagttatctattgatgaaacccatgtttctctcctgatcacacttgatatttaatgagagagttcttattaaaagtaaccatgtccatgaaggatcttattgggatgaagaaagtgttctaaaactggtttatggtgatggtagcaccacttggtaaattttctaaatgtcattgaattgcatgcttgaaattgttgaattttatgatatgtgaaatatatatcaataaagctgttaaacaaagaaacaatgaaaatccccaccagttatgttccatagtccctggagggggctgttttcatttgaatacccaaactcatcctgtcaagtacaggtagcatcctcctcttctttctcagatgacactatacgcagcgaaccattggggtgcccacatgtgccacacagcctagagccaccactgtgtccatgccagtggtactccatgtagatgcagggaagagcccttcttccccatcctggcccagactgtcagtgagtaacaatgacgtgctgcttgtatccatcatgaaaacagtccctttcatcttggccagaaaccctcttttcctagatctgagatctatgtcctgtgtttgggcccacagatcagttccttggctccacttctcaactgtcccttccagttgccatccttcttactttttctgtcctggacctatctctctcactgtcgtaaaccctcagcctcatttgaatgttggcaacgaatgaatggtagcaaattctactactaaaatcccgctcacgaggggactaatcaaaggtgacattgaaataagtcttctggattttaagcacaatatggggcaaatgaggaaattgatataatctttttaaaaaatttaatagcattattgagctctgattcacataccatacaattaactgatttaaagtgtacaactcaacggcttttagtacattcctctagttgtgcatccattaccacaataaattttaaaatattttcatcactccaaaggaaactccatacccattagcagtcacaccctattttccccatcacccaccagcccttgcaaacactaatctgctttctgcctctatagatttgcctattctaggcatttcataggaatgaaatcatacaagatgtggtcctttgtgactggcttctttcatttagcatcacgtttctgtgttcttgattcaattaaattaacacaaaactttgggatccattttgtgccaagcactatgctgggcactggttggaaaaagagcttacctttctgggaaagcagaacaacaaggaaacaatgaatcccattccatttaacagagggattgatcatttggagtgtgcaagttgaagcatgaggtatgggactcacactggaagaattttgctctgcaggccatcaaagcaccagagtattgaaccaggcaaattactttaattgtgctcttgagtttattagatgtgaatgtcttgctggcaatcatggttttactatggaagcaaactgaggtcttggagagctcattctgtccttaattgtaacatttagtaccaagaccttggacatggtacctctctgggccccccttgtctcatcaggaggggtagaattgatggtctttgcttatattccacaggtcttagaatgatcagacctgacaatatatgggaaagggctttgtatgctgtaaaatgacaaccaagcatgattttaacaattgtgctgcacaaaataagcattttgctgtaataatttgtgatctcataagcattagtcttctattgatgcaataataaatgaccacaaacttagtgtcttaaaatactacaaaagtattatattctagttctgtagactagaattctgacacagatctcactaggctaaaatcaaggtgtcagcagggttcctttgggaggctccaggggcagatccctgccttttgagctcctattaatagaagctgccctcattcattggcttttgtgcccttcttccatcttgaaagtcaacagtgttgcatctccctgtgcctttgtgcttttcttccatttccctttgacagactccaactggaagagtctcacttttaaaggttcatgggattagattggttttacctggataatccaggataatttctccttctcaaggtctatacacttaatcatatctgcagtgttcctattaccatgtcagtcaaaatattcacaggttccagggatgggtgtgtggacatctttgggaggccatctttctgccaatagatgagtttctgttatttctctccttatcgcatctcactgtgtttgtatgtgcacatgatcatcttgttattttctctcttctgtatttacagtcttttttcattttctcttttcatgctgtatcactgtttatccttttttactatttctttcccttgctacacatttcttttttcccttattgttactatcctttactgcttcttagtattttctttgtatttcttattcatttggctatttatggatattttgaacttcctttatcttcctggctttttctaatttaattttcttatcaccttcctttgagccctcttggtctctatttttacacaacattgagtcaatctctttttctgtccttcttagcttcctcttctaacccttgctctcatgcagaattcttatcttcatttacacacattgtttaacttttgtagctccttcagccctgactgtgcagtttatatcttgacaaatgggaggcgggaaagcagacatagcagggagaagccattggtactgagaatcacaatccacatctacataaaaatgccccatgttctgcagccaaacttgaaccttttggagctcctgctaaaatctcttaaggaaatctcaaagacaacagttacatgattactgattacacatgcgtaaatatagaggtatgtttaataagaaagatcagaatagaatttggagtgatctaaattacctaggatagatgaagttctttttggtgtaaattttcttacaattacagcaacaacaacaacaagcccttcaaatataaatgtttcatgtcattgctttttcaacttatatttattttgtatgattctaataaagtaagcatttgatcagttgcagaactttcatgtatggacattgcagagaatgatgttgctgataatgaaatggcataatgtgtgtaaaactcaggttcttagtctttttaagccccagaacaaatctgttcagaataagatctaagttatacatttgctctccagaggaatgtatatgaagaaaattttgtatctgctttctggaggtttcattcataaattcattctataagtatttactaagcatatataaagtgaacaaaaacagagatactgttctaggcattaggaatacatcagtgaataaaatacaatactttcttttaaagagattatgctgtagaatagggagactgacaagccaataagtatataatatgccaggtggtaatacagaagataaggggatagaatgatggaggggagtcagtaggatggtagggaagctttctcaaaaggtgacaatcagaaatatgacataaaggagacctgatatttaaaggatgagtcaaccattgttaacggcttgctatcacttaggttcctgtgtgggaagtcaatttagatagtcagacaaagaaagccctttttgtctgttaatgtgaagaacaggttttagtttaacttcttacgcatagcagtgagtaactagaaattagcacattccagggacaacatactctttcagatttatttgattttccaatatggctaagcaaacatatgattattcattgaaatagtagctccagaggtggtattagattgcctacttctgaggaattaagagaagaaatggttgcagataaattttaaaaagctaacactttaaatgttatagcacctagatatacagcattgtccaatagaaaattttgtgatgctggaaatatgtaatatctgccctgtcccagtgaatagtcttcctcagaggttttctttatagcttccacatctctgttgtttgagatgtcccaaggaccacaaagatggaatctccaccctagagcccacctgagagggagtgactactcaaagcctctttacgagcaaaactgtggctcctaagtacctggccaagtcaaccacagtcctccaggatcttgttttgaattttaaagctgctctctcttgggcccactccatattactaccacggagagggtagctaggccatagtgcttctgtgaaggaggaagagccccttcaaactccagtcctttacctcaacaggcttagctatagggatgtctcctcaggcttgtgtttgtatcttcagataatttccatgggatattggtcttgattattttattttatgttatatagtcaaaaggctgataattgcttggtctcaataataagacattgcctcctcactgaaatattaatcagaatggtaggtggctgctatctctgtagagtaccaatcaacttaatctcatttggataaattttgaaaatgaaggaaagaaatgtggctacaaacaccatgttttattttttagcacctggaatcccactccaaaggagataaatttatttcactaaccttagcaaacaaatcaaatttacccactaactccacctatgcccaccctgcctaggagttcacacttgttcaatcattccattccattgcagcccaggtgaaaaaggctggttgaatttgagatgtgacctttgcttaaatttcatccccaaagtgtgcccctcagaatgtcacattcttttggtaaatagccctttcaaagtgaagacacaattatttcatgttatttatatgcttgaaatgcagaccttctgtttttcaaatccacaaaagcaatgatttaattttcagtagttaggaagtacttgggtcaaattttagccaccttgcttcaggataaatattactatcatttgcttttttctctctctcttttttttttaaacaatgtcttttttatgaacttgagagggctggtgatgattttgttttgttttgatttattttccccaaagtagagaaaacaagatctcctgttttacattttactttttattttacttaccaagcaggaatttgtcggtctgttgtctcacctactaacatctgtgtatcctggcattgaagattgggaatcacaagctctttaaaaggctgacacagatgggcagagatttagcatcctaattttaaaagtatatatatatatgtgtgtgtgtgtgtgtgtgtgtgtgtttgtgtgtgtgtgtgaaaaaaatagaaaatattcatatttaaaaatttagaattattagaatctttagtttcatggttagggatttgtatgaataatttttatttcaatatttacatatggcaagcattctataaacattccaaattttttgtacctgataagaaagaaaagaataaagcaatattaattgtggttggcttttgaatttccaaagtctttccttaacctttcagcatcagtagaattgtaaatcattgtcccaattaagttaacaataatttcgtttcttttcttttctttttttttttttttttttttttttgagatggagtctcgctctgtcacccaggctgcagtacagtggcgcgatcttggctcactgcaagctccgcctcctaggttcaggccattctcctgcctcagcttcccgagtagctgggactacaggcgcgtgccaccatgcctggctaattttctatatttttagtagaggcagggtttcaccgtgttagccaggatggtctccatctcctgacctcgtaatccaccctcctcggcctcccaaagtgctgggattacaggcgtgagccaccgtgccagtcaacaataatttcttaaccattctgtacaattcacatagcatgaggaatatgagatcaatatcccaaagtgaacatgatttttaaaaaatccattctttattaatattcacttggtatatatttaatcactgactcattagtcaagaagtatctgtagtgagaaaaatgtttagctttaaatactggtttcatgtgggaaaaagttaatatataaacatatagtcagtatatactttatttactaagaaaacacaattttgctgaattttccatctgattataatgacacatctagatattttaataataaagctacagcaaatacttgagggtctttgaaaggagaaagcaggttctatatttcaaaagtagcttggatataaactgcaaaattatttctgcagatgggcttgtttccccttttgttttatcaactttagatatttatgtcttaaaattaactaaagcaggacacagaaataaccctcttctccatttaaatatatattttttcatttgggttctagattctcaaatgattacacatatacattgttaaaagcttatgagatacattaaatctagattaaaatgataatatacttttacagagacatttcctgtagtacttacagcagagtcgtggatcaactcatctattcctaattattatgtagatattaggatatgagcatgagctcaagtactagtatttattttatgatatactggcagaaatcagagctgttgaatatgtttacttgttatctttttcattaagtttccaatatataaaactaggcattatctttctcataaataatatttgattaatttgttagtgattaaccatataccaaagggatatttgcatagaaatttttattccaaatctctccattgtagcttttaattacctctattaaggattatagtaatttaaaattattaaagatatctatgaattcttcaaactaaatcactgaaatgtcaatgcaagcttaatggttttgttgttgttgtttttggtaaagtagcatggtcttttagttaagaccagatagtaaatattttaggcttttctgaccataagatctcagtcacaactctgccatttgagtacaaaaacagtcatagacaatacacaaatgaatgtgcatggctggttccaataaaactttatttacaataacaggtgatgggctggatttggtccatggattatagtttgctgacccttgcttagaggataaatagctgtgtgcttgtagaaccaatctggtgagggaaacacttaagggaccatgttaattttaatgttgcacatatcctggttgctgttctctaggaaatagccatccctccagtcagataatgaaaatatgctggtgatttctcttctttctgcatggaaatcttcttaagggattttgagaattatccatcaagtgagacctatcagtgctcagtgcaaccctggtggaaaatataaattagttattcctactatttctataagtaggccctccagtcattgtgatagttgggccaatctttgttaagaacatgttgttgttgttgttgttgttgttgttgtttgtaagcatactttgaaaatgacctgccatgtaagtgtcaagaatagttaactcaagatggaatcatgattgacctgtagagtgtgatgggcctcaggaagcatgccctggtagttctgtgagttctcactagggagagacattttattatgttcttcatgccataggtactatggtctaagcaagtgtacaatgaataagtcaatgaattaatcaatggaaaattatagtctatagtgagctttgaattgtaggaggtaaacctatagcacattgtcacttcaaactcaacatccagttttacaatgactaagtagagattttctagtaagaaaattatccaagtttctgatatcacttttattctttcactggtgactctacccagagagaaagaacatgggtcctacattaggactgacatcagaggaaagagaaatgtttatagccagaagggaccttgaagatgaggaagagaataacaattttgatgactgcaacaatgatgttgacgctataggtttaaatagtaagttgttatttacaaaatgctgtttcagtcctatcactttccatgagttaaaacgaaggtttagattatgtgacttttgaaaggctaaaataaagtaagtgaaactggaatacttggaattctgctacctgatacccaattaggaaaaagagaaggcaaagtttaaaacaaggtctaggttgatgagttggtctattaaacttttctatttttctaatattcattctctttcttctggtaattctgggttttagaagagtatatacaattgaattgcttctgactgctgctattgacgcatgctaactaaaggaggcagcctcagcccagggaatttaatccagtcaagtgataattaagcatctatgaattggcattaattgccaacttttggcccttcctgtagatctgtccaaaccttgattgtaattcctgcatgtactgacaacttgatagtttagcatatcccagtgtccatttttaaggcactatccaaaatatatctctgctcattaccctttgatatttatctaaacaagtaacttctgatgttaagctttgagtaaaacgggggaaatggcagggaagaactgggcagagaaaacgggggaggaattcaaactacacttgataactgtgatgatgacaatttcagctaccaccagttttgaacatttacaatgagggaagatagtactgttttatatttattatttcatttaatcttcacatcattcctctgagataattgttattctttgtatctcatatataagaaaactgagttttagagggatcaatacattgtgtaaggtcacaaaggtatgagtgatgagggcaaggtttgacctcagctctgtggcttctaaagagtatcctgttgagcactaagcaatgttatgtcataatagctgggctctaagtcatggctaactaggaaaacttggagacccttgttactcaaagtgctgtcctcagcccaacagtatcaggagccccattccagacctgctgaataggatctacattttcacagaagcccccagtgatacattaaagcacactaaaatttgaaaagcatggccctaggcttttcctagacaacccctgcccagtagtctgaaagtccgtagagatactttatcatcaggaaggggagtaggcaaaaaaacaaacaaacaaacaaacaaacaaaaaacctaccacaatgtcctgtaaaaagaaagctttctccagcttctgaaatgcacatgtagaattttacagaggggctcaagggacccgggagaatagtgattagagggtcattcaaactgggatacttttgaaagggaaaagatcactaggaataattaccctggcacattaggcatgaactggaactgcactaagcaaactgggacatatgggcacctaagtcttacttggtgagaatctaccaaaatatcaggattttttagactgtaaaacatgaaaccagagagacaggaaatttaaagtctacaaatttaaaagggtgacaattagttattgattaaattattttattccacaaatatttatcaagctctttccttctttgtcaggtactttataagctacagagatatgagatggacaagacacaatagaacttaacaggactaggtaataccctttaagcttgacaacagcaatattaggaaacataaaattagagttaacttcatggaagtcataaattgcaagcatcctggttctatttctatcctgtatcttaagaagtgatatagtctaatattttaattcatggaagatgaatccaaatgtgataattaaggcaggttgggaagttagaattggaggaggaataagaatgctattttagatgatagccaaaaccatgccctccctaatatgtcacggggatcttctgacagatatggaaccctgggccaaatgggccataatgaaaattagaacacatgtaagctttggagtttatcatcttttgtgtgttttagaaaagagtatttatcctagggctttgttcaccctgagctgtatcttgtaaatgaaaagtacaatgtgtgcatcttccatgccgaaaaataaacagcaaccttacccttttgtaaacagtaatgcaatatgctcaagcaagatttacagatgcatccgtttagataaacaacaagaatccttattaacaattagtcctcatgcaagacccacggcaatctgtgctacataggaaaactattttacgatcaccatgctttctccagtgcctaggacagagtctaatgcacagtatagatcagtcaaaacttgtgggtttagtaaatgagtcagacggcatttcagggatgctgaaagaggagaacagtgtagtccttcctgctttaattctttttgcagagtgcagaattggttgaaggcagttcacgtagatagttccaggtcagtgcaggaaaccaggaaggagagggcaagaattgaccttgttgctttgccaactgactcttctattctggttttgtttccttcatctggagaagcagatgtgcctgcctgatagggcggaagcctggaagtcccacaatctggaggtaacatcctggtctctcaaacttcctgggtgattcattagccagccacaagcacaagatctgtcacttccagaaacttagccccatcaatgttcttatgatatgagcttaagatccagaacaaataacaataattgggaaattttaaatgaccatattatttatatataatactttgtgaggttaaaacaagctcacttaaaactttaaatatcctttgttatagctagttccacatgaaagtactgggtcaatttgtccttgtagtcaaagattcatcacaaatgaaattcaagtatgggcagcacaggccccatttcctcccatctcagaggcaaaggcatctgtcatcctgtccaaatcccatgcagttctgcttcatcagggtcactccagatagcatcatgttaactcttccccagcttcaacttctacactctcagtcatcttgtcatgtcaaaacccttccttgagcaaacctcttctgaaagccatctcttttttgcaactaaatctctcataagaatagtttacactcaaagctagttcacatgctcatctatctactcctgaactctctgctatctggcttctaccccatcattcctttgagtcttctgtcttcagggttataggcaactttgctgcgaattcaggagagtgagtccttattgcatgttacctctggaacctctgaatccagctgttttttcctgacaacgtcttttcttcccttttccataactctattatttctcctcctacctctgggagtaatatgtcttgctctcctttgaaggcatgttattcctcacctgctccttaaacatacttccatcttaggcctcttctcctctcactgtagacacatttctttcacccttttatcaattctgtggcttaggctactactttgttttatgttcttccatgttgcaaggaacagagacacacttggttatttcaggtaggagatatccattgtaaagttacacaggaaagaacttaaaaggggaaaaacatcttagcccttgtgaaaactgaacaccaccccatgcaagactcaaaggaaactcatccctgtgcaaagtatgactctagtaacattcgacatttaccaggctgtagacttgatgctaactagctttctctctttctccccacctccctcacttacccacgtcgctctagtctactctcaaatacctttcgttgacttttcttctctttccctcatggcttctgctccttcatgacatctgatgtctcttggtttctgctatctctctatctacccataatttcttgatagatacaatttattctataacttaaaacattgcaataatttttatatttgctttccttctgctttcaatgccttctggaactaggtggaatctgaatgtatgtatgtataaacgaatgaatgaaatattgaatcagatctactaactttgtctttgtatcctcactggctgcccatgatgtcatagttgccagttaatgagtactatataactgccattatgccacttacacatttcttcaaccttcacacattcttaagaagagatggttttatggactgaatgtttgcgtcccaccaaaattcctatgttgaagcctagccctacagccagtgtgatgctatttgcaggtagggcctttggggagtgattaggtttagctgaattcatgagagtggggctcccatgatgggattagtgcccttataagaagaggaagagaccagaccttgctctttccctgccatgtgagaacacagtgagaaggtggctgtctgcaagccaggaggagatccctcatcagaactgaactctgctggcaccatgatctcagatgtccagcctccagaactgtgaaaagcaaatgatattttgttttggcagccaaggctgactaaaaccagtggtattcctctcccattttttaatgtataaaaaactatggctctcacagatgaaattgctttccttagatcacaatgcaagtggtaaggccaggaattggaaccccaatacctgaattattttatggttttctgcattcattttataaaacaataagccaaaagataaatgaacaattattttttaatgaacgtgaatatgacgtatttaatgaattttatctttttgttctgcttttctattttggtctacatgacaataacacatcactataggcatatacgttacttaatattgctaaggcattaatcaagatatattttgataatagtgattaaaataagaattgattgatcttctatgtctctagaatttttagcttgtgaaaatacaaaccaagagggagaaatgactgtctttaaatttgtaaggcctactggataggtcgaatgaatttgaagacatttgtctgcaagtaacagaagactccccctccattggaaataaacagtaatgaaatttccatctaagatgacaagaagtccagcatggcctacgatctgggtaccatacagaatgtcaggatgttgggtccttctctctgcaggctctgtcctgctctgtgtattgttggctttgctctcaggctggtaccaagatggctgcatcagtttcagacatcacattgagatgtgacactgatcagagggagaagtacagtttatctctttttgtttctctttcatagcaggagactttcccggaagcttcatatttcataggcgggaattgggccacatgctgtgacaatgactactagttgtctccccttctccttgcatttcccccaccttcctttcactacctcctgtatagctaactgtcatcatgtgactaagtcccctgcagtaagggcttcctgttggctgaagttgtccagggctcctagcagcagtgccggacctgagacagcacagcaaaatggcagaaaagtaagctagttgagagcctcatccctgatgcatctatctactcctgaacagggtgccccctgttgcctaacacctgtcttcttttctccagtatataaaatataattccccagggaattatatttgcatcttatttaagaccactgttatttttatttcttgctcttttttgtagttatgcaaccaaacttaatctgatatgcatttcccttcttaaaacattcctggcaaatggaatagtgtaaccacaagggaccaaacataatgaggatctatctttggagccgggatgggtcatctacccttggtcacgtggcggaaggttgaatagccaaataacattagacctctctttggaagaaggagggaaggggaaatcactgttgggtaggcaactaactgaggctgctaataaagttaattaagttttccaaggtcacatggctaattattggtggaaaagtaatttctttttttttttttttaacatttttagtttcaaaggtacatgtgcaggtttgttatataggtaaattgcatgttgtggggctgtggtgtagagattatttcatcaaccatgtagtaaacatagtactcaataggtagtttttcgatcctcactctcctcccaccctccaccctcaagtaggccctggtgtctgttgttcccttctttgtatccatgtgtactaaatgtttaactcccacttacaagtgagaacatgcagtatatggttttctgttcctatgttcctccacttatgataatggcctctagttccatccgtgttgctgcaaagaatgtgatcttgttcctttttatggctgcatagtattccatggaatatatgtaccacattttctttatccagtctactgttgatgtgcatttaggttgattccatgtctttggaatattatggatagtgctgtgataaacatacatgtgcatgtgtctttatgatagaacaatttatattcctttgagtatatacccaataatgggattgttgggctgaatggtagttctgttttaaatgctttgagaaattgccaatctgctttttacagtggctgaattaatttacattcagaaaagtaatttcgacttaggttgtctaaaagcaagttcagtggacttctgtctataagataagcttagtcaatgatttgtcattgatattataacagaaattcatacacagctgggagatgacacctagctgttaaacatttattgcttcatcaattccctcttactaagatacaaatgtgagcagttacctctacattgctgagaatcatatgcatacaggtcaatgttatactcatatggaaagaagcagaccgcgcagaccacctcaaagttatatatttggccatgggcaataaggtgagaaaaatctgctttgctaatgttgttggcctgagctaaatattgaaatagcatccagttactcagcatgtgaaccaggcagtggggagtcacgcaaactgggactgttttgtgtggtggaacagaggtgatccaaatgtgtgtttgtgtgctttttagagtttgaggccaatttaaaaaatagtctgcactgcaccatgcacgtgggtttctttgtcaacaccatctgggtgctgactctagaagtttcacttcccttagcatactgtggctccattaggagatggggcacagcactttgatttcaaaggtggttggcctcattagctatttgtggaacttagtaaccagcagaaatgatgctgttggaaaaatcctctaccttaactttaattcatatggttttattttttttcttctgcttttgaggggctttcaaatgaagtatcagaaggaaacagtgctttttatatgcgcatgtgtgtagtttttttcttagtcaactgaaaagatagaaaaaacattctgtgtttgtggacagtattcatataaaattcaaaggcaaattttatctatgtgaccgataaacaaattactaatgcctgttaatcccagtgaattttacaaaatgatttgactggtgccgaaggaggcaggagaaagacagcaaatctgaactctataaaatccctcaaggagtaccttcttagaagacaagggaggaaatactttttttcaaatgggaagcaaatcacaatatagaattacagtgtttattattattattattattattatactttaagttttagggtacatatgcacaatgtgcaggttagttacatatgtatacatgtgccatgctggtgtgctgcacccattaactcgtcatttagcattaggtatatctcctaatgctaaccctccccccttccgccaccccacaacagtccccagagtgtgatgttccccttcctgtgtccatgtgttttcgttgttcagttcccatctatgagtgagaacttgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatccttgttggacatttgggttggttccaagactttgctattgtgaatagtgctgcaataaacatacgtgtgcatgtgtctttataacagcatgatttatagtcctttgggtatatacccagtaatgggatggctgggtcaaatggtgtttctagttctagatccctgaggaatcgccacactgacttccacaagggttgaactagtttgcagtcccaccaacagtgtaaaagtgttcctatttctccacatcctctccagcacctgttgtttcctgactttttaatgattgccattgtaactggtgtgagatggtatctcattgtggttttgatttgcatttctctgatggccagtgatgatgagcattttgtcgtgtgtcttttggctgcataaatgtcttcttttgagaagtgtctgttcatatccttcgcccactttttgatggggttggtcgtttttttcttgtaaatttgtttgtgttcattgtagattctggatattagccctttgtgagatgagtaggttgcaaaaattttctcctattttgtaggttgcctattcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatgcagtttcagctttctacatatggctagccagttttcccagcaccatttattaaatagggactcctttccccattgcttgtttttctcaggtttgtcaaagatcagatagttgtagatatgcggcgttatttctgagggctctgttctattccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacggtattgattcttcctacccatgagcatggaatgttcttccatttctttgtatcctcttttatttcattgagcagtggtttgtagttctccttgaagaggtcctccacgtcccttgtaagttggattcctaagtattttattctctttgaagcagttgtgaatgggagttcactcatgatttggctctctctctgttattggtgtataagaatgcttgtgatttttgtacattcattttgtatcctgagactttgctgaggttgcttatcagcttaaggagattttgggctgagacaatggggttttctagatatacaatcgtgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgagatacgtcccatcaatacctaatttattgagagtttttggcatgaggggttgttgaattttgtcaaaggccttttctgcatctattgagataatcatgtggtttttgtctttggttctgtttatatgctggattacatttattgatttgcatatattgaaccagccttgcatcccaggaatgaagcccacttgatcatggtggataagctttttgatgtgctgctagattcggtttgccagtattttattgaggatttttgcatcaatgttcatcagggatattggtctaaaattctctttgttggttgtgtctctgcccggctttggtatcaggatgatgctggcctcataaaatgagttagggaggattccctctttttgtattgattggaatagtttcagaaggaatggtactggttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgttgaggaatttatcgatttcttctagattttccagtttatttgcgtagatgtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcgaaaaaccagctcctggattcattaattttttgaagggttttttgtgtctctatttccttcagttctgctctgattttagttatttcttgccttctgctagcttttgaatgtgtttgctctggcttaataatgcttgtgcaaagatgattaggaattttgaatacattggaatatggtgataggaggtttggtactgatacacatttttagcaagccttttattataggctaaataagatttagaagttgtattgataatacatatgagcaagactgtttggttacctttaatcttcctttaagtgccacttacagaattaatttgtttattaaacataatgtcctcttattatctaacaaagtttcttatcctgaaaatctgaataattgtgtgttcctgaatataaaaatgtttacatggaaaaacttgtttgtttttggtgtcactaattcagattgatccgtttgtctcatataagatgggtttggcactaccagattttacagtgagcagaaaatgtttctgtacagattcataccatcagctctcagaggacttgacattcacacaaggaagaaattatttgtaatacctagtacctgaggtgtttgctttataaggagatgccataacagataatattataacaaagagttattaatgaatggggaatttacccatttttttacatacagaattcttctaaatcaagctgaatttatttttaaggagataagtgcttaggatttaactttctttaggactttgcattaaaatgtttctagacatgggtggaggacctttatgaagataaaatggaataaaatataccaaaccaatttttctattataaaaaggcaggaagtcactaaatcataaaagaatttacagaagaattgagaccactcatagctacctgaggaaaacaattaagatatagttaaggccgggcacggtggctcacgcctgtaatcccagcactttgggtggccaaggtggacggatcacctgaagttgggagttcgagactgtcctgaccaacatggagaaaccccacctctactaaaaaatacaaaaaattagctgggtgtggtggcgtatgcctgtaatcccagctactcgggaggctgaggcaggagaatcacttgaacccaggaggcagaggtagcggtgagctgagatcacgccatcgcattccagcctaggcaacaagagtaaaactctgtcaaaaaaaaaaaaagaaagaaagaaagaaagaaagaaagaaagaaagaaagaaagaaagaaagaaagatacagttaaaacgtagaactaccatatgacgcagaaactccactcttggttatctacctaagagaaatgaacatatatgtctacatggaaacatgtacatgaatgttcagagcagtgttatttataatagctaagaattgaaaacaatccaaatgttcatcaacaaataaacaaatgtgatatatcaatacagaagaatatatttagccacaaaagggatgattcctgcgacaacacatgcaaacctcgaaaatgttatgctaagtaaagaatccagacccaaaaggctacatattgtatgactggatatatatgaaatgtccagaacaggcaaatccacagaggcagaaagtagattcatggttgctaggggttgagggagagggatgtgaggagtaactgttaatgggtatggatttctttttaaggtgatgaaaatgctccaaagttgattgtggtaatggttgcatgactctgaatatactaaaacttactggattgtacactttaaagtggtaaattttatagtatgtgaattatatctcaattttaaagaaagatataattaagactcaagttcgagaaaaagcagacctgactagtagttctagcttttctatccacacaacagatatttattaagtaaatcgctatatccctagtgtactgctgttcatgacttgtaggatacccaagataatttctgggttttaaaagacttattagcatgggggtgatgtcatctctcacaaaggcagaatctttgcagctggccagagagaccccatatccaaaaagtaatgcagctttgggggaagaaaggagaaaaaagtactacatctgtttgaatacaatggatagagttaggagtctgattaactgacccaaacacataaaatttggagaacaataaagccatgagccaaatcataagagtgtaggatgtaagtttccctaaccccatccctcatctaacttaaaaagagaaaacattttccatcaactgagtgggaaaaaagccaggaatctccatgaatcaggaccccctggatttcttccatcctcattgctttggaagtgattaagtccaatgatgagccagtgtctataaagaattatgctttgtgtatgagcctgtcattttgaaattatattataaaaggtaaataaaggaaaatgacttcccaattcaatgcagtttggggtcggtccataagcacaataccattgtaattaaaatctaaaatgaaatactcagagacaacaggatcaaaagccgtggcatttcaaattgacctgaactatcacttactggcaggtaatatggctgtgatgaaattcctcagcaagaaaaggtttcaatggattaaggagaggtacaggctcgggtagtattatgtgtgtagccaacatagcaacaaggaggtaaagaggatatttgaaaatgcactccctccattaattatgctctacaataatattctaaccttgctttaacactgtagcatcattttcctcatttctgggtccaggcaatatggatattttgtgttaaatatgaaataaattctcaattttctttagtataatttaatacataaatggatgtaattcttctagaaagttttgttagatattaaggtacatatatcaaaacataatgtatgctatatattttatattatatcaaaatatgttaaatcactatagtgttgaagcacagtctaacaatattctttaatgtcccatcagacattaaaaagtatattttaaaaagacaaattttaaaaattaacagtgatcaagagatttaagaaaaaaacccacattgacatactactgtgatatttttctcaaaaaaacagcaaaaatgtttatatcaccttgatgtcaaagtacttcaacttaggttgaggtcatatatcctagtgaaagtagtcaaggaaatagtcatcttgccaaacaagtttctttttgtttttgttttgtttgtgtgtttgttattttgctttaagttctgggatacatgtgcagaatgtgcaggtttgttacataggtacacatgtgccatggtggtttgctgcatctaccaacctgtcatctaggttttaagccccacgtgcattaggtatttgtcctaatgctctccctccccttgtcccccacccccaacaggccccggtgtgtgatgttcccctccctgtgtccatgtgttctctttgttcaactcccacttatgagtgagaacatgtggtgtgtcaaactagtttctactgttgactaatcattcctcattctttagcctgaactccctggagcaaaagtagaaagttaataaagctgctgcctagtgcctaaggtgtcatgaggactgtgaaaaagaataaaacatcattccagcatggggagggaatggattagaccatagggcacttgggcagctatctttgactcagttgtcattagaataggactagcattgagtaaaattccaaagtttggtttgagcctttattaattaattagtatgaattcatttatcatgggaactatgctacctgctacactcttcagctacccaaagccagccgtaaactgctctttccccatttccagccatccccttctcctctaacgaagccctccctcttcctcatatcactcattgacactttacacaggagaactgaattacagttgtggcaccctaacggtcatatgtttggccactcacccaaaacaggattcctttttaccacattcagaatggataatcagatggttatctgcatgaacctttaagtattaagaatccccttacccttaagtcacttatccttgggtgaatgttttctttagatatagtctccttgaaggaggcccaggcctacttcctgaaattctcattctgtcatttgaaatctgctctcttgaaagataggccagatctactacttcaccattcaaatattttaggtcagcatttctattactgcacagcctttgcaacttcagtctcaacatcagtttctttcatggatttcaaaggtttgtcaaatgaccaagctttcaccatcttcccctctctagcctcactaccctcttcagaacttgctggatgcctcaatgtctttcaaaggcgtatcctccagaccagagtttagtgctccatgtgtgctctggctggggtggaatccattgcgtggtcacttttctcttttcttgagttggattccaaagtttttttcatgcagctcaagtttccattgcctggtgtaatgcttttgtcagacttggagttcatttgagcttatcggacaattgttggctcattagaaatcctacctcttccttttcacagaattaaactcaagttgcctctctctgtctaattaattgttacaatttaaatgcaaatttctaatttcttgaatttttaaagtatcatcctaaccttttaatctaattaaattattatatataaattacaattgtattttaaaaccccaattctctcttctattatattatgcattcttcctagcttagttgtctagtaaaaatttgataatcactgcccatgcttttatgtaagtttctgatgaagatgttaaacaagatgggaccaggtacctgtggtggtagatttgcctactttgttaattagtacctgatatgcatagttcttcagtccatctgtatgtacagctgtatttgctacattttactgtctgatccacaaagtttccggaaaaatttgtccagcatgctgctgaaatcagtaatttatctaaatcttttggagtcagattccatggtaatggaagaaaagtggatatatggtttgtggggaaaatatgtggagactgatgaactctcaggggatccttctacatagagaactatgtattattgtgtttacctttcagtttattctatcatggatggtactcctgtcctaactaaaattttataatcagtagtcctcatttcacaataaatgatgacaatgatggtggtgatgatagtggtggtggtgatcatggttataatgattatgatgatgctgatgaacatatatatatatatatatatatatatatagagagagagagagagagagagagagagagagaaagagagagagagagagagagagagagagctctttccatgtgccaggtactacataagtgctttatactttttatctcatgtaatcattgcaacaaacttgtaggctaggtgttgctcactgaccctaactagtttagacattcacaactggtaggttctctttggcagataatggaaacactggagaagtgacaagtggtaaaagttaactgctgtactaccatgtcactaccaggttgtatgaaagagcaaattcttctacataaccatttaatagccagcaggcaccaaaaatccagcctgttttggtagcttggagataatcaatttatctgtctttttgggctttctaagcatttctttgcatgaaaagtttgcctgatgtagtcacaaacgattgttagctcattaaaaatcctaggcagtgacttttctagaatatggcttcacccactctatgagtacaccctttccaatgatgaggtcaaggaaaatgatcagaaagtacagagaggaggcagaacaattagggaagagagaactaaaatagaagtgacgggtcagacaaaaattcatttgggctacttgccacatctctaatttcaaactccttatcctaaatcgggtttgtttaactctcaagaaataggtgtggcccttgggacaagttggctcagattgacatactaccatgcatacacacacacacacacacacacacacacacacacacacacacacacactataagcaatactgttgcctgagacaggttgtttctgattaaataaggacaccctagcaaatagctcaatactaaagacttctaagcactggccaagttcagtaaatgtcctgaaaggaagaagtttagttctcagggtgacttgaaattagaactttttttgctgtttttgttttaaaatgctttgcctgggagagagcactatgtggaattaatatccccttctgtctccacagcaccacactagtcagcctaacttagagagggaaattctttgttgccttttttccaaatacctgttaaagaacttttgctggggcttacctctgtgtgttgatcaaactgaaaattttccaaggatctgaggcttctctggagggtaggttggcattaagatttcttcaatagtgcaaaggatgttgtttttcacaaccaacacagatgtgcatgcttacaatttaccttcagtctggaaacatgttagtgaggcatgaatttctaattggctacccacagatggatacggtactaagtatgcttgaactgaatcatataatttgaaggcatttctaaaggtcagttgacatatattgtataaaaaagaaagattatatatatgtgcatatgcatatatatgtagtatatatacctatacatagtatgtatacatcaatccaggtgaacagagtgtatatgcataatatatagtctacatatgtgtgtatccatatattatattccaactaaaatatcattctcaggcatttaagaaacctgctcttacctcatttcagattccccatgggtactggaatattttatccttggggatgattaagtaagagagatacaacaccaaagctgacttatcattagtgactcagtactggagaattgagaattattcagatgtgccgaaatctctcttctgaccccctacatggaggacaagtcactacactgaagttggcccttgtctgtccccttgtcctttggttaagaactttgatcaactgacttaaggcctcagatatgggagatcctctactttttcatgccctaatttggtcctcagtggtttctgtgctgtctttaagtagataagggaggccctacttcttactggtaaataaactgaagatataccaaaggtacctgcttcagcatgaccattgccttatttggaccagttaacagtgtgtacttaaggctcccaggcagtgaatatctttcatctcctagcagattacaatctgctactataataactccccatctctgttgcattgttagctgtctttgtgtgtgtgttgtgtgggtaaactatttgatcttgtatttcatcaacttttaccaaactacctctttgctattgatgagaacagtaacctttctacacgtaagttccacttattcaagaggactattaagtgatcatgtctctcagttgattagaacatggtgttactgaggtataatttatttttgtagtcgttttattaatgacaacagtaaaatatacacattacttgccatggaacagatcacatgctgagtgttggacttgccttatgtttctctgtgtaagagttgactccaatgatcactcaagtatttccagaagggaaaggtgagaagtgattggtcaatgcctaaggctctcacaacttgtggtctacaaccctgtttgacagtgagctgtttgggcctcggtaggaattttcccacagaaaggatgttctcactggcaggctcccaggaccgcccagaaatccatttaaccataacagagctgacagcactgtcaggactggagttggcttccaagtgggaagtcagcctagtattaatagcacagttccagctgcactgtgggtccagcagacttctgacggtccggcctgggaaccaaggcactctttgtaacatttatgggaaatggagtcctcgttgagaatggtgggaagacagtactgaggcggtacaaggcccatggcttctcacttcccctttctactctaatcacttccaacgccactatccagcaggacgagatggaggggaatcctagaggaatccttctctagccttcaagtctggggagagcctgccctgttcctggcctggctcacttgggtcgactgttctcatgtacaggatatttgtaagttgggtgtttctaggtcacgtgtatttagttatatgatatgaatgtttattttaatatagtagctcttgatccaggcacaaatatattagaatgtaaagttcatttttatttttaaaagatttttcttcattttgactaatttcagttctgattatgatctcctgcttctttaccagtttaaaggcatcatttttatgtaaataaaatgggtgtgcatgattgtagtaaaacattccgttttgtggttacaggaggaaatgagagaagtgggtggtgcactgtgtatgcatgcgtgtgtgtgtgtgtgtgtgtgtgtgtgtgtgtgtgtgtgtaatttgaatatgacctaaaggatgggggtgtttgttaccccaagacatacttcaaggaattaaaaattgtgttgtactaaagggaagtctttttcactaataacttagaagtattgcagaccatttaggtttttttgttggtcagaagtattatagttaacagatttttttcccccgggagctctttgaatacataatttctttaaaaagatttttaaagactgaccagcaacctgaaaattattttctgctaatcccaagtaaatgtctctgtaatgtaagtgctgctttaaagttatcttatggggtacatatgacccaaagggaaaataacttgtttattaagttgattttctttcttttttcatgattcacaaattgtcaaattcattctgtttgggacagtagaaatgtggaaacatgtaagtgagtaacaattttaaagtgtaaatcaactaaaatgtatatgaaaccctgctgggttcttaggcagtctcttgatatttctaagctacacttctctcttctaggattctgttttgggacatagtcataaacacaaaaggaagatttcagcaccaaattatattcatctttaaaatattggggcccttcagccccttccaaacactggaaaactctctggagtttggtttgccaagacatgggaaactttttttccgaatatttttaagggaaaattatattttagggttatgaatgtagaattataacacagataatttaataagcctctatagctaagtctaggttctctttaaaagatcttgttttttcacccagccccatagttacatatttgagggagtgaaactgagcatacaggatttttggagtggcaggtccatttgaaatcattctcgtccaatgttttcattttctagaaaagggaactggagcccagaggggttaagtgacttgagcaggctactgttggtgatggcaatagtaggagtggccatcatttactgaagatcttctttttctgggtttccttacgttttattttaccctcacaaccaccttgtaaggcagggggccatattccagttttataagtgagaaatctgaagtttgggaagtcctctagctgctcaaagtcaacaggtactaagaggcagagcaagaatccactgattctggatgcctggtggcttctgcctcagggtgttttccattgtaccagacatttcccaggcctaagtagaaatacaagaagcattccttctttatacatgtttacttctaatatatcaagagcatctgtatctaagcaatcaccctggttactcaatcttttggatagtagtctggggtattgggtctccttaccttagtttttctgacaaaaaataatcttcctcctactggatttcataatattccaaaatttgtcttcagtggatgcctcaacatatactttgaaatgtctattttatttagatctgaagaagagtattctttttttttgctctcattcagtgattcattcatttatttattcagtaagtatgttttgaatgcctactatgtgcagatgctattctaggctttggagatacagttctggacagaacagacacaaacccctgccctgatggtactttatttctagagggccaaaggatggccaatacatacacggtaaaaaataaggtaagtgagatggtgataaatacactagaaacaaaaaacaaagaaatttgtttaatgagtggaaggagacaccaggaagatggggtaggacttactcaaaaataactgagaggggaaattggggagtgcttcttatcacattgtcaattcagcaaaaaatgccagtgtctattttgttcagcaaattcctttccaaaaatataagttttcaatcccccaccaatagtaaaatgcttatcctaactctgtctctatccttatgatatcttcccatccaccctttatggaacccattgttatcactattataccaaaaaaaaaaaaaaacaggaataacaggagttatccacatatctaagggtaatacaatttgagagtaagagaagcttagtgcctggcctatttttcccaaacatctaatttatggaggagaatcttgaatctcagaaatattgaaatgttgggaggctggggcaggagagttgcttgagcccaggagtttgagaccagcctgggcaacatagtgagaccctgtctcttaaaaaaaactttttttaattagtaggtgtggtgcccacctggagtcctagcagtttgggaggctgaggcgggagaatcgcttaagcctaggaggtcgaggcttcagtgagccaagatcacattgctgcattccagcctgggtaacagagggagtccccgtctcaaaacaaaacaaaacagaaaaataaatgttcaaatgactaaatgacgacctcagatcaaatggcaaggtgcttattattttatttccagtaaatgatgtgctgagttcccatggtgagctaagtgattgagctggatccaggggcctcagcactgacttcagaggagatggtctgtggcctggaggcacagagaaagaactgatacagacaaagacttctgatcccaacccagtgctccttcccctatcccatgatggggactctttgctgttttccagggtctcacaacggtgagaatggggttcccttttacatttgtacttcccactctgtacttcacgtatgtcataggttaaatgagactacttgagctgacctacgaaccaaaaccactgtatctttatttctatgggaaaatgcatgtggactttgaaatatccagctatcttaacagactttcagaattgaggagtgtctgagttggaaaatataagcaaagatcatttagtgttcagtgaggcaaactctagctgcccagcctctaagatactgactatctcctagagaaaacacaatcctctgcagtcctgaaggaagcatcagatgagatacaaataagtagtaacagtttcttccaaattgtatggggaaagttttcttctcttcactatgaagaaaacctgatgatcataaatagtgaccattttttccacaaagtggcaatttgtgagtgtgtataccagccattctgtagtttgtcatagttcctagggctatggggacctatcacaggattgtagctcatttaatctggattcactactttgtgggctggacttatgtttctattaatggtagtagccagtatagtgtcccaaatgcatgttgaatggcgtggagtggaaggacatgttctcttagctattctgtatgctagcaagtgtcattttcctgtctgccttccataatgggaatgccatggacatttcagttcgtgttctacattcctatcatcacctgattgattggaatgatattgctatataataaggatttcgaacatacataagcattctgaggaaacatgaggttagattgaactgcagtggatgctctaccacagttcaagggcaagattattacagttgccttgacaaccatagctctgcactctctgttttattacatactcttttcctatttgggaatccttttgagaagaaacaaaagaaagaatgtcagtaaggtctcattttcaatttatgaggcttctggaaataatagagtcttatatagctacaaaaacgtctccatttcttaaaatttccccaaacattggaaagtccaggcatatgaaatgaactaaaaataagcttttacttatgtcaaaacacaaatatcatctttactccctatagaagtaattattttgtaaggactgaaagaaaagattacttttctatttttctctagcgtacagctgtgacttctatttttctataaaagggaaatatttttgcctataaattttcattagtatttttacctgtattacagttattcaactgcaaataggtatataagtaaaatagtcttactctaggaaatggctaggttgagagactatcaaacagtgatattttaacaatgtgttacattattaattatcaacacatcctcttttaggtttcctttgtagagcacactagtttgtttgtttgtttgtttgtttgtttgtttgtttttcaagagaaaaggtgacaatatttgggtctttataattgttttttctgtattaaagcaaaaatgtagtataaatgtatactactgtgtgactataaaagtcattgagaaatattattttttattttgtccacttgttattaaatctttcttttcttttctttctctctttctttctttctttctttctttctttctttcttttctttcttcttgagacagggtctcactgtgtcacccaagctacagtgcagtggcatgatctcagcttactgaaacctccacctcctgggttcaagtgatcctcccacctcagcctccccagtagctggcactataggcacccaccagcatgcctggctaatttttgtagagacagagttttgccatgttacccaggctggtctcaaactcctgggctccagccatcctcccctctccgcctcccaaagtgctgggattacagtggctctatggaacaaattcatatgttaataccctaggatgggagttagggaacttttctgtaatgggacagatggtaagtatttcaggcttttgaggctatacagattttgtcacaactactcaactctgatgttgtagctgaaagaagccatagataatatgcaaacgaatggactgggctgtgttaaattaatactgtattcacagaaacagacagtggactggatttgtcccaggggctgtagtttgccaactcctactctgggagaaaaattgttttgcttacttatctgtccacagtctacaggggagtgtagtgcttcaggcaaattgcttcttttataatatatgcctaaactgagcatggtggtgcacgcctgtaatcccagctacttgagagactgaggtgggaggatcacttgtgccccaggagtttgtgtccagcctgggcagcatagagaaaccctcatctcttaaaaaaaaaaaatgtgcctaaaagtccatcttttcactctgacttttgtgtaaaatgtccccattgctaccatattggttctattagagagaaaggcaggggttacacacttttgcaactcattagggagagtagaagcagatattgataataatttccttgttttaaaagctgttagagcacatgaaaaaaaaattcaactactaagatttccttacaccctagctgaactgctcagttagaactgctcttgaatatcaaaggctaacgtgccctgcctgcgtaaggtggcaatataaactgaggtagacactgtgggatgcagccccttggcccccagctggcctccccatccccatggggtctacatagtcacctggcaccaagaaaaacgtgcttttttctttatttttctttgaagtattcactggtgctttgttcaaactgattttagcatcctctttgagtttgaatcagatacttcaaagaaaaatatagaaaaacgaaaacaagtatctatgtatttgttactcagatttagtaactgttaacatttgttcttatttgctttggatatttttatcttttttaaaataaagaatccctttcattgacacaattgtaacccaagaattttccccattctttctaaagaggctattgtcagaggaatctgaattattttccacttattaaaattggttattgagaggcaaaagaatagaaagaatattgattttatagtatatattcagagcatcactggtgcatagtatgaacgatttgatccaatttgtatggttttctgcccatcgaagactgaataatatcatgaatctactcccaagagagacatagagaatgcatcacatctctttcctattgggaatgggatatgaatctaaaagacagtaaatataaaccatcctaattcataatagagagctggatatatttttcaatttcaatggcaactttgaaaagtacattatttttctctgctgcctttaacatactaattgccttgtggtataaatgctttcataaatgctctctcatctgatcttgtgtgatagttacaatagatggtattacagctctctcccaggtaagggtatggatgcactgggatgtctgtacagtgtttggcagtcttggctggacctttgtatcacctaccgagctttgaaaagatactgattctgagcctatccacagaggttcaatccaaccagtctgagcaacagtattcttttcttttcttttctttcttttcttttttttttttttttttttttttttgtgatggagtttcactcttgttgcccagactggagtgcagtggtacagtctcggctcactgcaacctccgcctcctgggttcaagtgattctcctgcctcagcctcctgagtagctgggattacaggcacctgccaccaccatgcccagctaatttttgtatttttttagtagagatggggtttcaccatgttagccaggctggtcttgaactcctgacctgaggtgatctacccacctcggcctcccaaagtgttgtgattacaggcgtgagccactgcgcctggccgggcatcagtattaattgattctactgtactgctgaggttgagaacccccaatggaccgaccagtggttctcaagtagggactatttgcccccgcaaggggacatctgacaatgggacattttttattatcacaactgagaaggggcatcccctggcatctagtgggtagagaccagggatgctgccaaatatcctatagcacccctacaacatagaattatctggccccaaaggtcaataatgcttatattgagtaaccctgatttaagctggactaaagtccctctgactctaagccatattgtttccccagtctcaagttgctagattattcaaattagtcatcctcttattattgctgctaataaaatatattttaattaggttgttcttcaaaacaacatttacaatgactttttagtttatcaggaaccaagtgatcttgtgtcataaccatactgggataggcaaaaatccttatattaaacattttcaattacttttatcagaatacaaaacaagcaagcaaacacacaaaaaacaacacaccatcaaaaagaagaaaagagctatttctcaacataaattgctctgtatgtattatcccagatgagcaatgtgtattatataaagcagtggatttcaaacttgagagtgcattgaagtcacctagagggcttgttaaaatactgattgccggcctcatctccagagtgcctagtcagtaggtccggggtggggttcaaacagttgcattttgaataagtttccagctaagattgacatttctctcctagggactatactttgacaatcattaatgtaaagaatttctctatattagcatttcaaatgaatattaaccctggggaccatctattaaggcctcaagttaatattcctaaaagttaaaaatcattttatcatagtatacaaataacttaaaatatgattcatcaagaaatatagagggcttcctaattctatagttacaatcaggacagccctatagaatcaaaccttttgctcccacttctaagagcagcaagagctagcaacagcaagctttgcttaagaacaagcctagtagttttatgaatgcacagctctctacctgatcggaaatgaagggatgccagttcactgagacatttttaaacgcatctggtcaatgagaaagttgatattttctgtttcctgatgtgtatccttcaaattatacataagtgcttaagtgaaaatgacttgatccaaattcccttagctttggatacattaacatatgctcatggaagggtggatgggatatctaaaattttattgaagtgtattgcctctctataaaataacaaaaccttaactccttaagtaattaaaatatttggcagaagtggctaaataatgttagattcaagtatggaatctgaagcccatttcaggtatttcaagaacaagtcaattattcatccagtctatcagccaaagacacttgacagagagcagtgacatggtgttttgtaaaaggcatttccatagtactagtgctctcattttgttgtcatccagtagaaagaagtgtacacatttgtgaagaaatgcatgaggtaataaaactatttaaaaatccacattttctcaatttagatggacttttcttaaactagtataaagttaggtgttaccatatattttgtaggcataaaaatctaaacctcaaagtggcagaattcaagagtacccatcccttattttctacaggagttcatctgaatcccttgatagtaaagattttctttctttctagaacctgacataattcctagtacataccaagtgataatgacactttcattgaatttacttaaatagctatatgagaggtccatgtatttctatatttcatgaatttcaaattatatatttcagtcccatttaaagttaggatctttataaagaaaatcctgaagaggatccagactatagcgtccaatgtgcaaatttttaattgtgagctagagattgagaataaaggaaagttattggaaaattttccaagaactaagcctttctgttgtgctggtattgatgatatatgtgtcagtcagcaataagactaccaaaggtgaactaaataatccggtgccataaaatgtcttataaaacttaagctgctaagaaaatctaaggattaaaaaatgtacctattcgcatacttctgctgttgtgtgtttaagagcaaactgagaggttgctatggcattacttatgcgtgcatggcaacagagcgaacttagtgattcagcttgataaaagaggaaattagctcaccatttcccctttccccaaatcagagtcagatatccaaatatttcattttgaaatggtatatccatcaacacgttctaatggatgaaagtcagtgggggtgggggtgggggaaatgtcataaggtgaaattcgtatgtcatgtgcttactttagggaatgcaacttgtgtctaaacagtctattcatatctctgcatccttctttccccctgataggatggggtttctcagtggcatctgttgggtgaatatacgatgatgagtaacactttggcaaaagacagcaatttatcagcccgtataactttgttctaatggaagtggatcatcccagaatttgagaaagaaacattgttcagctgtgaaactccaattccctgtgtgtaacagccctccagggaaggagtagattttgtcagcataatatgtgaagtttagtcattatcaactgcacaaagcagaggtcaggcgtgggcgtacatgtgggaggcactattatgaaatcaacccacagccactgccctgctggggtgatccaatacaaacagagccaaatgtcatgaataaatgctgacattttatcacatgattagtttaaatattattttactactgtgctttttcttgtattatttatctttcacatctttattttgtttccggtttcctttctttaaactgataaatgaaaaatagggaagtatgttttgagtcagtactttgaccatgaacacaggaagttaactgaaccctccaccaccagaacaacaacaacaaaaaaactctaaacctgtgaatcttggaatcttagatttgttctgggttgacatgggttttggaatcataattttattaatttattttttaatttacatagagtaaaattgaccttctggagggtatggttctatcagttttgacaaatacataaagttgtgtagccaacatcacaattgtgatacagaagaattctatatataccaccccccacccccacccccaccaccaaatctcttccttctgccttttcgtagtcaacccctcttttcaccctcaggctctggcaaccattgatctgttggaactgtattaatctgaccgtttttctccactctgtccattcatgcaacaaccgtttattgataatctatgctgagctccattttaggtgctagggatgaaatggtgaacaagactgacatagaagtttctatctggaaacaagataatgaacagtagtaaatcagtaattccaaattgtggcaaatgctgtgtaaagaacagaaatatttctgtgacaacagatatctgaaggcgaaatctttttttttttttagacggagtctcactctttctcccaggctggagtgcagtggcgcgatctcggctcactgcaagctccgcttcccgggttcacgccattctcctgcctcagcctcccgagtagctgggactacaggcgcccgccactacgcccggctaattttttatatttttagtagagacggggtttcaccgtgttagccaggatggtctccatctcctgacctcatgatccacccgcctcggcctcccaaactgctgggattacaggcgcgagccactgcacccggccgaaatctattttagacactgttaagaaggttactctgagaaggcagcatgtaatctgaggactggaggaggagaagaagccagctgtgtgaggtgtgggtggggacacatggggtaatcattccaggcggagggaacagtatgtacaaaagagagttgggagtctagtgagtgaagggagcaatgccatgaggtgctgtagatagataggcagagcttcactaaggtgtatgtacttcattgcattgcagtgagaagccattgaattaggatggggctctaatggggatggtttgattgatgttttgagctctgtgtagaaaatctgtggtagaccagcaagaatggatacaggggaccagttgatttgcagccaccatccagttgactgttaatggaagattgggcttggcagcagctgtggagatggagaagggatggatttgaaatatattttagaagtataagcaacaggactaagtgtttaattagatatgggtaaggggctggtgaaggaaaagggggaatcagatgtgactctcaagagcttgcttgagcaactgggtgggtgatgctatttactaacatgagtaaaatattgagagagaaacaagtttgtattggaaaatttaaaagctggggctttggacaggctgaaatagagaaacccattagacatccgtttggagatgtgatgcccctagatggggatatgcatgtagaattcagaggagagctcagagctgaggagagagaaatttgtgtcatcatttaacttttaattattcattatatcataaatatacaatttaaatatattattatattttgatatattaacgttaatataaaatctgtattattaacaatttattcactgatatttattgagggcccaccatgagggagacttagtgaggaaatggaggtatgatggtgagtgcaagcctgtatgatctgagacaggctggcagtagtcacacagatatgtgtaaaatttaagggacctcagtaccacaaaggagagggttctatgaaagggcacgagagggagattcgactaaatctgggtggaggtgagggtcaggaaaggcttccctgcgcattaaagaatgaggaagtgggagaggatatcagattaaggaaagaacatggataaaagtcggtgtggtagaagaccagagattttggttctcagatgcactgtgattccaatttagatgtccagaagggcatcccaggaacatctcaagcacttcaggcaattcacattccttcagcaaatatttgttgagcacctggagtgtgcctgagattctttcaggtgttgggaattcagcaatttatgtgcaaaagttctttccctcatgaagcttgtttctttctggtggagctgattcaggaggttcacaaattccagacacatcttcagaaggattgactaagagatgttggcctgcaacagagccatgaggagtgccagcatttagagctctaaaggagcagaagcagcagcaaagaacctagagcaagtggctagtgaaggaaaaagagagaaaaggggtgcgtatagcaaaagctgggggaggtccagatggcaaaggtaatgaatggccagctaggtttagtggtgctgagggatcaggtagaataaaagcagaatagtcgcccctcagctttataacatggcagcattgggaatttttaccaaaccagttttatctgaatagtggaagtagaaaacagattgagttgcttgaaggagtgtctgggaagtgaaaactgacaaagtgagaagatattggcaattgagaagtgaaaaattgctgatgactttagagaagtttgccttcagttcgggacttcattattttcctgcaggaaagagtcttctgttagtggggagattaattaacttatttttgcccaacttgtctatctaaaaggaagaaagtagtaatacattaaaagattgagactgctgaggatgaaatggggtagtatatgcatgcagtggatgctcactaaaaataagagcttgcatttatagtattttaagtttgccagtctcactctacctgacataaattttcagtaattatcttattaaatgccaagtaagattcaaattattattaactgatactcaagggaggaaatagggtaagttaagcaaattgccctaataacgctgctcataagccatggccctcggagaatttgaatccatattttctgtggtttggacatggtttgtttgtccccatcaaatctcatgttgacatttgacggtcagcatggtgatatcggaggtggggcatagtgggagatgtctgggttacagggatggatccctcataaatggcttggtgctgttctcatggcagtgagggcattctcactcttgacactagattggttctcaggggaattgattagttcctgcaagagtgggttgctagaaagccaggacacccctgggtttggtccctctttgcacatgtctgcttcctctttgaccttctcagacatattttaatggaacacaaaagctctgctgaaatccaagcagatgccagtgccatctatcttgtaaagccagcagaactttgaaccaaaataaacctctgttgtttattaactacccagccttagctattcctttatagcaacacaaaatgaagtaagacaacatctgttgacttggttctatgctgtgtttgctccacttggtgttgtaattttattcccctataagaattgtatctgcttaagtggagactgagtattcatctactttgtatccccatacttaccattgcatttagcccagtgcctggcacaaagtttgcagttgtgagtggcactgatatgaaatttctcagcccttggcccagccttcttgggctgctcttgtttttgaagctccagtttatactcaggagaaatgctttggacttcagacctccaaactgattcatgttacacatatcatcagtggagaaagtgggacagagtaaagggtggagatagctcttgaacacgacagtagaaatggtatgatgttagcagaaaattaatatgtgcacatcttgttgtactgagaaatactctaacattataaggaaacaaataaaactgatcattgctaggtgacgtattatatatatagtatataatgtaaaaatacatatatagtgtatgttgtatataatgtaattgaatattatattgtatattatatgcaatgtacatctatatatctatagatatctacccttgtgtatttttttcctacaaaatgaaatactttcaccatcagagagtaccaagtaggaatattcccaggagggtctgagattgggatgcaatctcggaacccattaaagagcctggggacaggtgggctgtaggagtcctgtggagagcttaaaaggtgtctcttacctcttgaaagaaatgactgtgaggggtgaagtaaactgacccggtgtacgtctccctgggatatattacttactaacttttaggtcttacctaggacacgtatataggaaatgttcctgaatcatgcttggctgcattatttccctgtagtggcaaaagtggcctgcagaagctgtgcattctgggtccttgctagaacccagatgaatgttgcttgggaattggagaggaaaaaaggaaacagagcactcccaaattctttcccaaatctcttggatcgaaacatcttaaattgccatttttatatgtccaagatggtcaaatagtaaccatttcacgcagctcaaccaaaaagtatgatccagctactacagagatgtggacattggaaggccttcttgttggtttcaagtttggccaattggtagacatctggggctgtatattaaggcatcttgattttgtgagccagagcaaaggccttcttgttcctgtctctatttgaatagtatctttggtgagagagtgccagcgtcatctatttattatccttcatgctcagtgactatgtgaaaagaaaggaaaagacctttaaagctggggtgattgtctagacagtcctaaaatagctgctccaggtgcaaaggaagccataaaatgcagacaaagcatgagactcctttggcgaaaatacagtgtgtttgaactctcataggctccctgtaaattatgaagtagaaaatgcccaggagactagattccaataattatgatcattagttattttaaattgccaccacttacttcacacagaggcattctctgtgtgctaaattaaatttaaaatattttaaaaataattatttgaataattcagagctgaaatagtccaggttgaactatttagcaggctgaaacacctgtgcaagctttaattcaaaatatacagagaagtgacttcatttttcactccactgtggaggtcttctaatacaaaacaagaccttcagcaggagtccatgccccctggttctgcaccttcttgccttctactttgtcctgtgcctacccactgcactctcaaggtccaccatgacccggccctgctccactccagccgtgtcctctaggggatcgctgccaccttttacctaggcctccccaccatggcctctgccagagccagctccttgtgggcccatgtggaaatgagacctccagatcccatcctgggaaccaccaaagcctttaagagggaaatcaacagcaaaaagatgaatctgggagttggtgcctaccgggacaataagagacccagttagattaccataaaaaatttagacaacagcaaagacttggaaccaacccagatgtccatcaataatagactggataaagaaaatgtggcacatatacaccatgggatactatgcagccataaaaaagggtgagttcatgtcctttgcagggacatggatgaagctggaaaccatcattctcagcaaactatcacaagaacagaaaaccaaacagcgcatgttctcactcataagtgggagtttaacaatgagaacacatggacatagggaggggaatattacacaccggggcctgtcacggggttgggggctaggggagagaaaacattaggagaaatacctaatgtaggtgacgagttgatgggtacagaaaaccactatggcatgtgtatatccatgtaacaaaactgcacattttgcacatgtaccccagaacttaaaatataataaaaaaatttagacaaggaatacctgcccatttggggacaagctgaattttccaaggcatctgcagaaccagccttgggtgagaagagcaaagtgttgaaaagtggccagtctgtcactgtgtggatcatttctggaactggggtttaagggttggagccagttttgtgcaaagatttttaaagtttttgaagacagagatgtctctgtccaaaccaccctggggaaatcacacacctatcttcagggtagctggcatgcaactacaagattatcaattctataaccccaagacttgcagttttgacttcacgggtgctatggaggacatttcaaaaataccagagcaaagtgctcttctcctgcatgcctgggaccctcatgcaaagcagtgaaaggaaataataatagtggcaaagaaaaagaaactgcgttctttgatatggcctaccaaggctttgccagtggtgatggtaacaaggatgcctgggctgtgtgcaacttcattgaacagagcattaatgtttgtctctgtcaatcatgtgccaagaacatgggctttatatggtcagtgtatgagagccttcactgtgatctgcaaagacagtgaatgaaaccaaaagaggggagtcagttgaagatcctgatccatcccatgtattccaacccttctctcagtggggcctgtattgcctctaccattctgaacagcctgggtttgtgaaaataatggttgcaagaagtgaaaatcatggccaactgcattactagcatgcagactcagctgatctccaactgcagtaaggagagttcctcacacatctgacaacacatgactgactaaattggcatgctttgtttcacaaggctaaagcctgaacaggtggagaagctaaccaaggggttttccatctgtatgacaaaggatgactgcatccctgtggcagggatcacctccagcaacacgggtaatcttgcctatgccattcaccaggtcaccaagtaatgtccctggtgtgagggaacaggtacaacttttctgtcttcagctgctgctaccgtgagcttcacatggaggataagggagggtagatggtggtgagtagatctttttttttttttttaaccacagtgcgtaatactgagtgattgaatgcatttctcagaaaagaacatgtagcgacattgggcagaggcatctgtggctggtatctggaactttgtgactctaaaccaaactctcccccatctttttatctccaacttttccgaaagggtttacatgtgtgagaaactcatagcaccaaaaaacttgtcaattatgccactgcaatatttcagaagctttaactgaagcatcttacggtgtcaggggttcttcatgagaaatagcacacattagaggctttgagagaagacctagttctgtcattaacagtcagcctcaagtttgtcctcccatgatggagcaaccttatcaacagaccatatcgcagaagttgtgttttatgaaaaccaatgagtttgctgccactgcagcaaggaaaataaaaggtgctttttcctctcatttaagaaaaagaaaaggctatctcttctcctttttcatgctattcttttccttatgcacaaagatttttaactatcctagattttcatcccattctactgctggattgaccatctaccctgtattagtccattttcgtgctgctaataaaggcatactggagactgggtaatttataaaggaaagaggtttaattgactcatggttcagcatggttggggaggcctcaggaaacttacaatcatggtggaaggggaagtaaacaagtccttcttcacatggcaggagcaagaagacttgctgagcaaaaggggcaaaagccccttataaaaccatcagatctcgtgagaactcactatcacgagaacaacatgagggtaaccatcccattgactcagttacctcccaccgggtccctcccatgacatgtggggattatgggaactataattcaagctgagatttgggtgggaacacagccaaagtatatcaagccccatcctacttggatttatttaagaataaagaacataattttctaatgacgccatagccttactgttctcagtggagaaggtaactgcaatttatctgagcatcttcttcgatgattgtgtaattgtctcctgctggatgttgcctctgcccagttggacatcctcccttcattgaatatggaaagcagattagtggttgctagatttaagaagatgatgagttgagagggaggtgcaaatagctgtaaaggggtagcaagaggaatccttgtggcaatgaaactgttctgtgccctgactattgtggttgtcacacaaagatacatatgtgataaaattgcatataactaaatacacacacatacacacattcacacacaaatgataacatgtaaaacttgtgaattctaaataagatagttgaatcaatgtcagtttcctggctgtgacattatactatagtcatgaaagatgttacaactgggggaagctgggagaagagtataggagatggctctatattatttcttacaaatgaatgtgaatctaaaattatctcaaaataaaaaagtttagtctaaaatgcattcatcaacatgaacttgagtcaaaccatcttggaagagaggcactttgatgtattcacttcacaaagcatagggatgaagatctctggtagtaccagcaagccaaaacacatgactttctgctgtctgtaccctgtggccctgcactgtggataagggaatgtatgtgtcctctagaacatttttgttttgattgctttgtgtttgtttgcatcaagaaaaaagttgcaaattaatgagaatatatgtgtatatctctaagattcatcagcacccaaaataccagagcaagccagacgtcatagggaagccctgagcagaatctacaaaaaaggattgaataatttgattattcagagaaagcatatttctaggggatggatctaagagtagcttgatcatgaaaatggtgggaaaaatatagcggcaagagggtcactaggtggaagtaatatgtctagtttttttgagaaccacacttgagctaaacctttaaaatccaatcaaagaatgaaaatgaatagattagtgtgaggaggtaaacgtatcatttgaaaatagccttggacttgggtactttgctctcattgatttagcaatatgccccattttgttagttgtttatacagagcttcacagttttaaagtaagcatagccagttatgtctatgatttctctgtattcagttatatttgcccaggaaagtctaatcaacaaacagttatcagttatcttacccatgacaacattgtgagatgttgtgagatgccaagaatagaccacaagagcctctttgtgatggtctcagacctccaaaaccaataaagaagaataacacagtaaatcagtaacatatctatagcatttgaattcacatagagaatttgtttagtgggcctgactaaatgccttcactttgcagcttacaggggcttgtgtttattctgcctatcttaagcatggttttactcatttagtgggagcagttggctcatgtcttttacctatttcatttactaactctaagggagtcaagaagaaacttcccctttgcgctctaaagggtcactgaaaatatactggcatgaggcagattgattaacagaagaaaaggcatacacgtttatttaacttgtatacacagaaaccttcggaatgaatacctaacatacaggggaaaatggacagttgtccatttttatgcttaggttcaacaatatgtggacagccatgtagaaatgtgattggacagaaagggtctgatttaaatgctaatggactgagtaggggaaacccagtaaggcctgtccatctagattattcttggcctctctgagaagcatttcttccttcttgatgtgagagaggaccctgtctggaacaggagtcttaggatctacagtcaaaccagttaggtcagatcatttcttcatggccagtttttacgtagaatatttttaggttttatgactgactttcaggaaaaggggttctgatttgtatgatctatcttggggaaaagggattctagtttccatggctatccttagggcaaaatgggactgagaggaggacaggagaaggtcaggagaaacttttgcttctgaagctgctcagcagcagtcttcattttgagatactgttttctgagccccaacaaaattcttctaacatgctgaacatgtgccaggcactattctaacatccatgagaatagagaggaaaggaagagagggatcctgcagctttccagttgggtgctgagatgatgacaccattcactgggtgactccaattgatttgctaaatctattctctgcattttgactctgccaccttcttaccgtgggtctatgagcaagtttctccactgttctattaaatatctgtgaaatgggagcaatggtggtgttgtgatgattagatgagtaaacacatctagagcatagagctctatgcctggcacaaacgaagccctcagttaatatttgcgggatgtgtaaaagattgtgtttatctggttttcaagaccatcctcctcagagacgccaaggagatagttgctatgcttcctggcgttctaagacccacatgcatctcgttaacccttgagaaatctagtgggctctcagaatttttaaaattatatattaataaattataattgtatttatttggtgaaaagtgatgttatgaattttgaatacaatgtggaatgattaaatcgagctgattaacatatacatcccaaatatttaatctttttgtgattagaacatttgaaatttactctctgtaattatgaaatgtatggtactcagttattagctatattcaacatgctgtgcagcagatctcaaaaaaaactcaaatgtcttcctcgtttctgaggctttgcaccctttaaccccattgctgacatcccccagcctcaccagcttggtggaacaccttgagatgtgcttataacagtagctgggatgtagtcagtgctaaaaaattgttagcttttgctgttgtgcatgtagttgttgttgttattgtaaaatggtggctggaatccacttgcgaatatgcagtcatgttacaaatgaggatgtttctgtcaataatggaccacatagacaacagtggtctcataagattataataccatattgttactctacctttctatgtttagatatgtttagatacacaaatactattgtgttacacttacctacagtattcagtatagtaacatgctgtacaggtctgtattacaggagcaataggctgtaccatctagcctaggtgtgtagtaggtttgtgtaagtacatgctatgatgttcacttcgtggtccactaggtcactagtaagcctttctgtacctttttgtatgtaactctttgtatgtctgccacactgtatgataatgcttaggtgtttgtataaatacactctatgatgttcacaatgacagttttctcaggatatatcctcatcattgacacgtgattgtactttaacagagatacaattcttgaacatcttgttagaaggagatgggagaaataacagaaataaaggtagtgtcttgcatttttcaattattaaactaatcaattcattaaaacagctgtcattaattacttaaagtcaggcaggtgagggaaagaatggcttgacgttttctaatttatcactctttcctgttgcccctgactaaacaaactgtggctgctgctacagctaagtatgtcaaactgttgaatacccaagccaggcttttgaaatattgaaaaatgactactcccatgttgatccataaaatctttaccatcttacagagagctgatgaatcatctctctagcaccaggttcacgaacttcccataatgatctcataactctggtgccaacattgcctgggctcggtaaccttcatgaaatttattattaaagtttgaaattcgttcttgtgtaggtgtaatgggattagtcgaattgcaaagatgatagggctgctatttacagaaaaagctcctttctaacacttgccttttctaatgagtcaccataatacctctgtaattattacattgattgtcttttgcagaattagatttttttgtaactctgggagattttgattagaacattcagttattatgtctgaagagtgatctagctacatgagttaatagtctttggattgaatgtgttgaaaattaaattgaaattagaatttttgtacatcaaggcttcaggtgccctttagcaactttgggagacgaagatatctccacactcagaaataggttttactgaaaagtttttggtggtgaaaaaaataaaatacctcaaacaagctgcagaaacaaagattttcccagaaattctcaacaactatgaggatagactagaagttctgcaagggcagacacttgtacatcattaatccttgacagaattggtaggaaacctttggattttagccagtgtggcagagtaccctgagacgtgacagaaaagagtggtggtggtcaggcactgaattcagttaactgttactggtttctaagaactcatcatgcattcacatagaatctttgtcaacttcacaaaaatcctagtagagtgagatttttatccccattttaaaagtgagccatgtaggtaactcgctcccaaattactcaataaatgctgcatctgaattagaatctatcggaggctggctcccccatctggacttcagcatgacttcattaatgttccctaccctctccagccctatgctggtccactagtcactggtgtaccttcctataccataactgtatctcctgtacagaataataatgctcagatgtttggagatgtatgtgcaaagttcagaaatgactttagacaacattttaccttccttcacgatgaaatgagaaaaattaacaccaatctaataccaaaacaaaataatttaccacaaaagtgattatcttgtaatgtgaaggattcaatatgaactatcactgaatatggtttgaaagggttccatattaatgcatgtcagagaagcaggccagatgctgactaaatcagcaatgtctttgttgatgctttttggcctgtaaagtacctgtaaagtacctgtaaagtacctttaaaaccctgtaaagtatcttgtaatggtgtagaataatcaaagacttgggataacttctgtggtcacaaagcctgttgtaaatgaataaccaggacttttgttttgataaatctaatctacattcctctgtagcacacgattatactcaaaagcaggttatgattgcccccaaattcctaggtaccattgtgaagtcaggctcagacctgactttttgatatctttttacctgagcccctacatccctggcaccaatagaggacatggtaatagtcactaaatgaacccataatatctgtgtttaggaggagtgacattttttggcttattgctggtattcaaatgcctctttactcacctatctttgacaacatccctctggattatggtactcacttagtatgcccttcccataggtgttcaacattccaaaattatttgatactttgcaaaacatccagcaacatcaaatattttccaatctttaaagggctgaatttagtttggccttagaacaaaacaatctgattgaagtaatgcatactaaaaagtgaatgacgaatatgttttgttttgtattatttgaaattttagacaaacttttcccttacaagtctttaaaacgaaatgtgtgagcaagattttcttttctttcttagcaggaatgaatgtcagatgtccttttcttacctcaacttctctttactaccccattcagaaacttgacacctttctcctgaagtgttgatgacatgtaatctaaagaatatcttggacatttaggaaaattaaacacataggaaacttttttttccttcctagcatgaagttttctatttttccttcctttgggtgggacaaaacattagtaacttatacagtgctactccctaatgtaaaattataaagtcatttgtatttagggatgtaggggttttttttagatttaatgtgtacttatcatgaaatcagtggatgattgggtcaagtctatgacattatttaactaagcggtctgccatggcattatttaatgaaataatttttaaaaatgcttttattttactgtaagccattgaagaaaaattttactcaaagtttaacaagtgtttagttcatgatgaggcatttgcagctgtaagcaatcatattactgtgccatcatttagttttatggaaaatgaaaacgtttacttaaggctgttaaaagtttgttttttaatagtgcctcctaagcaatacaggctaccacttacttttgacatcgagggaaaaagagttactcagattcattcaagctttagttatattgatttctacgatgggtttttcttagcatgtcaagtgattcctgttttatagtgaaggcattactttgagtcaatatcaaagtacatgatcccctcaaccttcaactgtgtttcctgctttgtgaggtgccaacaatagcaagaagggataatttaaattccgctttccataggaaaaaaaaaaaatcccagctgggcgcgatggctcacgcctgtaatcccagcactttgggaggccaaggcgggtggatcacctgagatcgggagttcaagaccagcctgaccaacatggagaaatcctttttctactaaaactacaaaattagctgggcgtggtggtgcatgcctgtaatcccagctacttgggaggctgaggcaggagaattggttgaacccaggaggcggaggttgcagtgagccgagatcatgccattgcactccagcctgggcaacaaaagcgaaactccatctcaaaaaaaaaaaaaagaaagaaagaaagaaagaaaaagaaaaattcctttggtaaaacattatatactctctaaacagggattctcttcacaccattttgaattgcgtgcttcttgccttgttgcacagattaaactgggaaacaattttatgtgtagcagggtttctaaacctcagctctattgacatttgggggcagatcattcttttttgtgaggggctgtcctgtgcattgcagaatgttgagcaggatgcctgatttctagccgctagatgccagtagcaccttcccctcagttgagacaaccaaaaatgtttccagacatccctaaatgtcttattgggtgtgaagtcatcctcagttgagagctactaatctagcaaattagcatatttctagcaaaatagcataactacttttaaaaataagtttggtctaggatgtttttctctttcaaatgaggtatattttagataattttcacttcaataataaataataattacagaaaccaaaatacaggtttcagatgttatctgtgtaggaatgtgaataacagtgacaacattttctgaaagaaaaatttgtatgtagagactaacaaaggtgttttttctcatttgtgcatttaattatgatacaataatttgattatatttagtggtaaatgaataatcttcattagaaaattatacaaagaaatgaacaattcagaaaaaaataatagctttcatattttgtcctgtattattgaagtaagcatgttgcacccacttgatatgcttattattcttaaaaatttcccacatttcttggtaaatttgagtaattcctgtattgtcagtgaatacattataattttaatagtgattgataagcattttgatctctagatttattatcattaaacaatgcagtcacacactttaaacagaattagtagaaacattttcttatttttcttatttggaacatttatcagactaaagaattttaagtgtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagtcgagattgcgccactgcagtccgcagtccggcctgggcgacagagcaagactccgtctcaaaagaattttaagtgaaaccaaccactactttgtgctgcatatatgagagcacttcaaaaagttcatgggacaaattaaatgaaaagataagaaataataaatagaaactttctcagcatcaagctcaagacacttttttgatcaatgatacccgccattttagtccatctctaaagaactaagggtcctgggaattttaccatgtcattgcaatcttttttattttattaactgaagacaaatgggtgccctttagattttttttttttttaagattagtaagcaaaaagaagtcagaaggagccaaatcaggactggaaggtgagtgcttagtaatttcccatagagactctcacaaaattgcccttgtttgataagaggagtgatccaggagcattgttgtagtcatttttctgctaaagctttggctaactttctcaaaatactctcatagtaaacagatgttaattgagttttggccctctaaaaagtcaacaaacaaaatgccttgagcatcccaaaacgctgttgccatgacctttgctcttgaccagtctgcttttactttgactggaccacttcctcttggtagccactgctttgattgtgctttgtcttcaggatggtactgggaaagccatgttttatttcctgttacaattctttgaagaaatgcttcaggatcttggtcccacttgtgaaaaatttccttcaaaagctctgctcttgtctgcagctgatctaagtgcaatggttttggtaactttagggcgtaaagtttgcttgactttaatttttcagtcagaattgtgtaagctgaaccaattgagatgtctatggtgttggctattgtttctgctgttaatcattggtcctcttcgattagagcatgaacaagatgaatttttttcctcacaaattgatatggatggcctgctgctgtgggcttcatcttcaatatcatcccttcttcttttttctttttttttttttttttttttgaaatgggggttttcactcttgtcaccagactggagggcaatggtgcgatctcggctcactgcaacctctgcctcccgggttcaagcaattctcctgcctcagcctcctgagtagctgggattacagctgcccaccaccaagcccagctaatttttgtatttttagtagagacagggtttcaccatgttggccaggctggcctcaaacttctgacctcaggtgatctgtgcacctcagcatcccaaagtgctgggattacaggcgtgagccaccacactcagccctcatcacttcttaaaatgagtttttcatttgcaaactgttgatatctttgggggactgtcctcataaacttttaataaagcatcagtgatttcaccattcttccacccaatcttcaccataaatttgatgtttgttcttgcttcaattttagcagaattcatgtttccctgacaggggctcttttcaaactgatgtcttatctttcttagtgcctcaaactagatcttgttaaggcaggttataacaagttagtaagaatttattttggtgtaatatacatttgaaatttttgtatagttctttcataatgcatattttctatgaactttttgaagtcccctcatactttctctttgttcattttactagcgtgtttgactaagataagttttaaggacaaaagtatgacttgtatggtttttataattaagtatttctgtaatattccacattattgccagttctgtccagggagaagtttttccagctcattcctgaataattgttacaaaccattcacattcatctaaggtatttctgataactaatatcaaaaccttcagaattcagggtatactatgcttagcaatattacttggagcttctattcaaacagcagaaacagattgttttcctttatccaaaatataatataagttacatcatgtaaagcagtgataacattttgggttaaaccccaaatcacaacttctgggtgagaatccttcaaattttaatataatcagcagaagcattctagtagagtttaaaaatgtttatacctaagaaatagtcactccagatttgtcaatctattgtgcttaaatatgaaaaatgtgtacatacaacacttaggcaaaattcacagaatgagttctgtatgaatataacattgtggacaattttatcctatttaccacatcaattgatcaaataagtttatgtgaatgtatgctatcttggaaggccaaggcaggtggatcacctgaggtcaggagttcaaaaccagcctggccaacatggtgaaaccccgtctctactaaaaatataaaaaattagccaggcatggtggtgcatgcctataatcccagctacttgggaggctgaggcaggagaattgcttgaacctgggaggcagaggttgcagtgagctgaggtcatgccattgcactccagcctggacaacaagagtgaaactctgtctcaaaaaagaaaaatatgctatcagtgtttttcactggggaaattttgtacctccccccaggacacatttgccaatgtctggagacttttgtggtcacatttgggaggggtgatttgctactggccaaggatgctgctaaacatcccacagtttagaggacagcaacacccaccacaaaaacaagtgatctcgcccaaatagcaagaatgccaagattgagaaactctgtactgtagagatgatcaataaaatgttttctttattctccagtgattttcttgagatgttcttcagatttgggacattttgcaaatgttaacttgcatcactgtatctgtgggtatgccaacagtcttactcacatatgtcacgtcacagcagaaagaaaagataatctcttaattgtcattttatcttattttccagagcgccactttaactgcaatttcttcacaaagatttctcaccaggaaactggcagctgtaatatttatgatccgtttcttttttatttttaatttgttttaatttttaatgtttgtgggtacatagtaggtgtatattaatgatgaaagtgcgccattcctgtggcaaatgtttttgaatttttgatgcagacttgttttgaacatctgctttgtgctttatttgtactctttagaatcttttctttttgaataatatgaaaattgctataatggctgtggctaaactatgcatttttggtgtgatggacagttacaacttcttttaacacaggcttatttttaataggataacattgaatttgaaaatgtgtgcgtatatgtgtgtggctgttgaagttctgggagctcagatctgagagccagcaaatttagatgtattattttattcaatcattcattttattgagaagttacttgtgagtagcatttattgcactatttttatattcaaaatattactatttttagaaaaggtacttattttgaaaaatgttcacttttcctgctttttatactaacttttacatcaaaataccactgtgcaactaaatttgtgcccaattgaacaaatttttaaataaattagaactacaggccaaattgttacattagaaaacacttagaaattgttaccatttcttctattttgttgcttccagtaaatttccttcatggcacaatttacaaaaagtaataaatattgaacatgtatttaacattaaaaacaccgcttacatccatatacagttatggctcttaaaatgcagacttttgtattgtagcagtctatgagctgtctcttttgcaaaatatttttctttgtagtaacagctttatttcaatgttggctgactatatcttttattcagggactatttgctgaagtatttgcaactaggggcattttggatgtttaatgggaacaaggagaccttatatataattagaattattccataaggtctgagtgtgtgtatgcatgtgtgtatgcatgtgtgtatatgtaggtgtatgtgtatatatatacacatatatgtgtttgcgtttatatatgtgtgtgtgtgtatattatacacctgtgtgtgtgtgtgtgtgtgtgtgtgtgtgtgtgtgtgtgtgtgtaaagagatattttctttgaattgagcaaaacacacatctcccttttcttcattagggcacaagattttttcctattcctttaactattctgttctgataccataaaagccattcacaataggttgtaggtggctgtaatttataatcatttcagtagtaaaattcatcatccctgggattattccctctcttgtcacacgttaattcctggctccagattgtctttgctgtgacttcatctgtaaagatttgcttcccttttcaatgtccgccttttgctttctggagatataacctttgtttctcaagatctgaatgcatggaatatgaaactttccccaactccaccagcacaagtgacctctttctctcaaccctgcagttgtttatccattaaaattaccaattaaatttccttttatacatgtcttgtctcccactaattggtagccgctgaggtctgagacagcacagcccatattctttaacttgaccctgaggagatgccggtctagcttttatttaggttagggttggcatctgaggaactgtgttcctattgcatgctgcagtcatgagctaacagaacgcttaaatcaaaagctgtcaacctaacatgaagaggcatccacagagctgtctctgagaagctttattctttgactcacatctccaatgtgagtaatgtggttgaaacctagcaaagtcaaaatttacttgaagtgatatggtggatccggtgctgtagatgatgattgtagacctgaaaaaaagaagttacgcgaataacatctgcttttctgtgtgatattttcccccccagctgtttagagaattagaaattgctctgtcaagggtttgtttacaaaagcctggccaatttcaaaatgaagctgcctttgagttgtccctgtttcatctcactgtttggaaaataaatctgaaccattaagatgtaaatacatcaagttagaagccaaaggcagtgaaaaccaagtaaaagcaagaaatgtaccacgatttaagtattctcctgggaggaaaaatatacatggtaataatttttgtatcttataattttattattaaattaaggggagagaaatttgaaatcagcataatatctattttgtgtagtatttaacactgtgatgtatattgacaattgataatgaatcaaaatatgtgcgggtaactgtatgttcattaaattagagtttggtaatgagatagaaagagagaatgagaggggtacaggtgtaagcagcagttctcaaagtgtaatcccggaaccatcagcagctgcatcaccctgaaacattagaaatgcaaattctcaggccctgttgaagacctactgaatcagaaactctggggatggggcccagtaatctgtgttttaacaagccctccagaggattctgatgcatactccagtttaagaagcacttctatgtagatggatggatggttggatggctggcaagatatgtgggtacaatgacacatacatatgtaagtacaagtataggtatgggtataaatacaaatatgaatacaaatacagatataaatacagatattttgagagagagatatatagatagacatagatatagatatagatatagatatagaaatgtggagttaccatcacaggacttttttagaggagcaaattatttccttttacttattatatgattgaataaaagctgttcttttctctaggcaatgggtctatcatttataaactgagaaaatctactggtggtccatttgttgaaccattttccattaggttcacttaaagtgtttgttccatcaagtctgccacctgggtggtttccttcactgcaaaactggtttgctcttccctcccctctgtcttcttggcagctgctgtctgccctggttcttatccattggtagatctgattgctttggggactggatcaacagttgaatcctcacaggattttgaagccaacaatatcctacatattggtccatttttcagaatttcttcatttgtgttttatccttccatttttctttctaagcatatataatttatttagattggtgcagaagtaattgcggttttgccatggaaagtaatggcaaaaaccgtaattacttttgtaccaacctaataatttcagccaactattcatatgcagcactgtttacaatggggatgaataagtaacagctaaatatctgataaaaggggatgttttaaatatagtagattgcaaaataatatgatactttttgagaagaaaatttcaatatgcaaaaaatataggggataatattcattaagacataatcaatgattgttggattatggatgattttaattttactcattttgcttatttttatatttatgattacattagttgtaagctcaaattgctgttataagcaaagataatgcagatttatatgtatatatataaaacagtaaaataaattgattgtattttttatcttcttcctttccccactatgctatgaacttaaagtccagcaattatgccagctgtatctattcatcatttttcacattaaaagcaatattgctggatagtagaattaaatgacaactctgcttttggaaatgacaggaagtctgctgtaaatagataattgatgtagacgttaaagccaaatagaatttccatttatggagaagggaatatttaagggtatgtggctataagaaaatatttccttttgcttttaacacaagatgtaacatgacttgtcatgctcaggatgtgttttgaagtggataatggcactttccctaatatttggaggcaccgggcttgatcctcttttgaaggccttcctttgaagataaacatagacattggttttagcttaattctccatccctaaaattccttcctgctctaaaattctataattccataacaacagtgtataagcaataattatgaaatggaaaaatgagccattctacttgccatccttcatgtaaagctgtactatggaatcctgctctaaggtggggccggtgtcatttctccaagcagtatgatgccctggaagaaagcaatgtacagtggcctgtgattctggaccttggatcactttgatgcccttggcttataataaaagcaaaatccatttaaaccaccttaaataattaggaattttagaggctcatgtcaccaaaatccataagtatgtagggtttcatccagtgacttgacctttttcctgcagtgctcttcattttatgtccctctaagtgtcacctctaggctgatagcaacagaacctgtggcagtttggggataaatatgacgatgtctaagctagtgtttctcaactgtgggtgaccaccccaggagacatctggcaaagtcgggaaacatttttggttgtcacaagtggagaggtgctactggcatcaagtgagtaaaagccagggatgcttctaaacatcttcggtgtgcaggacagccccaccagagagaatgatccaacccaaaatgtcaatagtgctgagtaactctggcatagaagaagaaaggtttcctctgcctataactcacttacattctaggaaacatttccaaaggcttccagccacatttccctcacatgctggtgcctatagtacaaaaggctttaggcctgggttctgagatcaatcgtgggtggggaacagtattaccaagatcagctcactgagccccaaaatgcatgtggcatgtccatgctatacactgtcaaccagaacaataaatacccgtcatataatagtactattttgttattagcaagagaggggaattcaggcatcattactattcagccctaaaaaagaagaaattcctgttatttgcaacaacatggatgaatctggaggacactgtgttcaatgaaataagccaggcacagaaagcaaagacaaatgctgcactttctcacttacatgtggaatctaaaaaagttgaactcatagatgcagagactaaaatggtgctttccagaacctgggggtggggctgagggttggagagatgttggtcaaaggatgcaatattttacttagacaaaaggaataaattcaagagatctattgtacaacatggttactataattaacagcaatgtattttattttgaaaatcactaacagagtagattttaagtattctcaccacaaaaagtgacagctatgtaggtaatgcatatgttaattggcttaatgaagacatttcacaattgtatatgtatgtcaggacatcatcttgtacacaataaatatgtacaatttttatttgttaattttttaaaaatcctgtgaactgctaaagaataaacatactctccaaacctttctgtgggatttggggaagtgtttcttcacctgtatttttttctgggttatctgcattaatatctttctagaaaaggatatgactggaagtggcttattgacaatctggattttcccaagagaaattaccttcaaccaggagagatgactactttaaagaagggctttgcagaacctatgtctttactgagtcattcagcaatccaagtgagagatgatgatagcttggaccaagatggaaccattgaaattatgagaagaggtcagattctgacatattttgaaggtacagccaacaagatttactgacagattgactatggattgtgaaatggacccattggtgatagagagtggaagttttggcctgatctactggaaaaattgagttgctattgacttagatggggaacactatagagaagaatattgagaagaagttgaagaactcagggaattcaagaaaaaaatgtcctagttggagatataaactaggtaactatcagtgcatagatgtcatttaaagatacaaggttggttaaaatcaccaaagaggaattgcagatgaaaaataaaggagattcaagaacagagccatggtgaattccaacattatgttacattcagagaggtgatagacactcaaaagagtgtggcatccacaaagcttattctcacatttgttaattgacgtcaaaaacatggctggttgttttgtttttgtttttaacttaagctctttcaaattctggaatttgggtatctttccctaaaagagaaaaaacagccttcgtcttttgagcaagccaggaagcctcttcctgccgtcaattattaattttcttaacatccacttatcatctaaaacaggggttcccgacccccgggccgcagaccagtaccagtccatggcctattaagaatgggactgcacagcaggagtgagcattactgcctgtgctccgccgcccgtcagatcagtggtggcattcattagagtctcataagagcgctaactctattgtgaactgcgcaggtgagggatcttggttgcaagctccttatgagaatctaactaatgcctgattatctgaagtggaacagtttcatgctgaaaccatccccgccgcactgtctgtggaaaagttgtcttccacaaaaccggtccctggtgccaaaaatggctggggtcagctagtctaaaacatagcgaagctatgggctaaggaacttaccttgcttttgtttttccatctgggcaaatggttcatcctgcccctccagggtgagaaatgcctgtccctttctctcaatctgtatatgcaggctaacaaaagatatttttcagagatgatttatttcaccagaacgattattgataatttgcatttatggacacttggtgatcttatcaatatttttatgttttctcttttttagcttttaagttcaagggtacatgtgcaggtttgttacatggataaacttgtatcatggggttttgttgtacagattatttcctcacccgggtattaatcctagtacccattagttatttttcctgttcctctccctcctcccaccctctaccttctgagaggtccccagtgtgtgttgttcccctccatgtgtccatgtgttctcatcatttagctcccacttataagtgagaacatgcagtatttagttttctgttcctgtgttagtttgctaaggatatataccatggaatagcatgcagccataaaaaagaatgagatcatatcttttgcagggacatggatggaggtggaggccattatccttagcaaaatgttttccctttttgtgggacattatcttgaatttctcagaaatcaaccacaaatttaaagagtgaacactggatatctattgcaaatttttctaaaataacatacataaatctagctatgagaaaaacagctttcaatttttattttgcataagagtttcttggaaagtttcttaaaatgcagattccttgacatcagaagttctgttatgatcaatttgggactggactccagctggtccatttcatccatcccacaccattatctgattacagggcagaggatccacaagctgttcaggagctcatataaatttctgcaagctgaaaaggaaattattgactcccaaagtaatgatgtaaatactcacctatatatctaaaaacatagcaagtgccaatttcattgtcaactagtatttttaacaatctcatcacatgtaaaaacaattcgtaatgtacattttgttctcttaacaagtattcctgaacacgcacaataattacttaaaaaatcacagccaaacgagaatccgatgaattacttattgccaaatcatgtcaaaatcaaaattgtaaaaattcttgataatacaaggagatgaacctcaaaagtaagtgcttaaaatagctcagagctcctggaactcacttttaacaaaaagtaaccccaggtgattctgtatttgatcttttgcccacacttggagaatctaaggtctgtgtggggatgcttcatatcatcaaagcgtacttgtcttccttcaatcatttatcaaaattcttagcacctaaacctagcatcttagcatgatgctagattataaaaatacagtgataaacaatctttctaattgtgaagcctccagcccagtaagagagacagccaatagacaaatgcacaaacaagtaaaatcaattataggttgagataagtgctaagaagaaaatcaacagtgtgttgagatcaagaagccaggaaacattaatatcagattggggaagtcaaggaaggctttttgagcagatgatatttaagcagagaccagaaaaaggaggagccagccctgtgactgacgccttaggaaagcagttcaagcaaaggaaacagcatagacagaaacccctaatcaggacccagcttgccttgtccatgagtgtttgaagaacaggaggaaagagaggaggcatgaaaggtgaggctaaggaagttggtccagaccctttgacataggcaagttctatgtggatggattttattctaagtgcaatggaagcccgttgatgatctttgcttgcttgtttgttgttatttttttaaggttggatatggtgtggtactttgtgtagcagttgaacacataactcgagccagactgcccaggcaggaattctggctttgcctcttataggcagagtaaagttgagcatgttctaacctctcttcactcacttcctcattgtaaaatggaagtaataacagtacctacctcttaaggttgtttagcagatttaataaatatgtgatatgctctatgtatgtctcaaaatgaagaattgtctttaagaagattactgttatttcccccatgaacaaattgagtaaggacaagagcagatggctaggttgtctggaaggctgctaaatttgtttgggagaaatgtgatgggggctggaattggagtgatgaaagtaaagatggagaggaggggtcagattcctgatttattttggatgcagagttgacagaagttggtaatagattaaaagtagaacatgcagtgaagaggagaataaagaaaatgacttagttcctggctcaactaactgggtggataaaaataatcattatttaataataataataatcatcatcatcatccacaacaacactgattaagcgagtgctgcataccaggcaggcattgtgataaatgctttgtaaacacctctaaagatgtgggaggctaggataccaaaacatttgccagaagagaaagtcaagagttcattagtggataagggaagtttgagatgaccctgagacaccaggtagaagggtcaagaaggcagctggatagtcagctccataaacacaaagatgattggtttggagatagtatttgagagtcctgaactttgcaatgggatttaccaccatgtttttttgtataatggcttgggctgttacgataatatttttgtcttttttggtctaattctttttagttcaagacctgctttgtaaaaaccttagtgtcaatcaaattttcagtcagttctccatagtgtaaaataaagtattgcattaacatttctgactctgaaacaactctactgaactaaactacttaatctgaagtttgtgttgtgtgtgtctgaaacatttcctcatcaaaattcaaagaaactttagttcaagttatggcctgaaatcaacagaattatattaattcatatggatatagaaaatcatttatttacagtatttaaattgacatttaaacagtttttccaatcccacacagttagtggcataaggtcttgagaaagcatgaaacattttttttttatcagcctcatatttcgttgagcttgccaaacacagttcattttccatagaaatttgcaaacctgagtagtggccaaattttcagagtcgctgaatgtaagccaatgaataaaattgttaaaccctttgatttccccccacttttttcccttaaaaagtaacatagcgtgtgcctgagttttattttttgacatctattacccacaacactcgagtgtgtttcagaatcagcctgtatggacatttcagtacaaaatgaacacagccggcgctttggggaacgttcatttgcagctttgttatccttagacaggaagccttctcctccacactttgatcgacatttttcagaaggcaatggcatcaacctttaaaaatggatactttcaagggtttaaaggttgagatttttaagacaaacccagaataggcaaaagttacatattggccaaaaatgtgactccagaaaccatgtgttgtagctaactggggccactagcaaatctttcttttgagacttctgtcctgttagcagaatgcactgatcgaactaaaccttgagcatgacacaggatagaactagttattgttaagaaaataatgttcaagggcattggtccattgtacccaggaatagtttggaaagatgaaggatatggaaacaaacaagcaaaaaaagaagaattaaaattaataattaaaatgtcagtaactgtaatgtatttctcttagtggatgataaaattacataagaatgtcgaccttttctttaacccaatgaccatagtggcagtctcttcattggactgcttccttcattggcatcgccttctaatttcatttttacttatgatagtgaaaatgcacaatggcccctggaggcaataccctaatttttttgtttaagtgctcaaaaaagtatatcctttccctgcgaaaaaggcagagggtcacaattaattactgaatttcagctatgaaaaacccactgaactgtgagagtccattgtgcttaagttgcatttaatctctttggagatgccaactacctgatatacaagagcaactgtaagttccaaaaaaactctcacagataggaaccatagacatggagagaagggagccactactcagaaatgaaggagttggggaggagtggggctgaaccatgaagccagaacagaatttttgtcagtggcctagaagcaaagctgagaagaagggtctgaatgtgctggggaccagtggttgtagctccacactgagatggaagcctcctctcactgtagcttctgccaaaacacataggtaaatttgcaggagtaatggtgacctcggaagagcctggtgtaattggggaatgattgttgcaagggaataagagccagtatttcatttggtcttttgtgtctggcatttttcactcagtataatgtccccagggttcatccatgttgtagtatttatcagtacttcatccctttttgtggctgaataatattctattgtagggatatgacacattttgtttattccttcatctgttgatggattatttgggttgttttgactgtttgactattaagaataatgctgttaggaacattcatatgcaagtttttgtgcagacttacatgtttttcatgtccatatttcttgggtatatacctaaaagttgaattgctgagtataatggcaaatgtatgtttaacatttggagacacattctcaccagcactatgtaagggttccacatccttaccaacagtttttttttttttttaaagctatcctagtgggcgtgatgtgataattttttttttttttttttttgagatagagtctcactctgtcacttaggttggaatgcagtggcacaatcacagttcacttcagcctcgacctccctgggctcaggtgatcctcccacttcagcctcccaagtagctggaactatgggcacgcaccaccacaccaggctgttttttattttattttaatttttgtacagacgaggttttgccatgttgctcaggttgatctcgaactcctgagctcaagtgatccgcccaccttggcctctcaaaatgctgggattaccggcatgagcctcactgtgattttgatttgcatttccctgatggctaatgatatcaagcatcttttcatatgcttatcagccatttgtatatcttcttcagagaaatatttattcagattttttttcttatttttcaattaggttgtctttttattattgaattgtaagagttcttcagattctggatacaaatctctcatcagatatgtgagtgagcatttttttcaaatgattttttccctccagcaatcatactgcatttctaccatctactgtaaactgccatatgtctacctcatttatctcaactttttaactttttaacttttacacttttcttcctagtgggtgcttgggggctttcagccttctgtgcctggggaggactttcagaactaagagctccccagggtgtctgactcagaggatcacagtgacccaaggctctctccctccgagatcctctagttgtgcattccagacagggagactgcctggccggctcctctagcactttgagcagtgtccctccctgcctcctgtctccttctctgttcccacactgcacaggggctctgcgtggggagtatgggggctcgctactgcctggagctgctgctattgctgaggtgtaagaaccctggagaggtaagaagatacggtgtgtgtatttcaggctctgtgtttcgtgcctactgctagaagcaaggtaggacccaagccaggaagacgtgaaagattccatggggtaataatcccagagcagcatctggaaaaggtgaacataagtaggaaagaaggagggaagtaatagcgttggagggatttgctcaatgtgtcctggcgcttgagtctcttttaacatcaaagctcaggtggttcaaatgacagtcacactgcctctgcctgttgctttaagagtaaattcagagtcttcaaaccaggcttattggaatattacataccattgccaagacgtgtatatttttattgaaagttcagagcaaatcatagtaaggacccaccatttcttctgcaccattccttttggctattttctcagtatttgaaaatcaatggaatttgactttaacatgcacattggcttataatgttactgttgcatgggtcttaatgttactgttccagtccagtgtttttgtgctagaggtaaggaaactgaagttcagagtgaatcaggcattgccaggatcaccagactaatccaggatgagccaaaacatcattgctatggagtgtctctttgggtctcaatcattgggtactatataatgactgacgactggggacaagggcataggttgcccttttccttagtatgatgaaggatcaagattctataacatcgataactgattagggtactaatgtggaaccacaaaatgtggttcagctctgtcctgtggccactccatgcagcaaagacagatggctggttcagaaaactttggttttgttgtttgcatacaataaaggtagcatctggtgcaaattttattttttttaatgattccagggttttttctttaatgatttcatagaaagaaccttaaaactcatcttttcagaatattaatttagattgttaccgaagtgttcacagagcctaattaaatacttgctggtttcatatagctacaagtaaaagctgctttgaatccttcctaaacttatattggtttatttggtgaattgtgtgttaacaccaagaaagtgaaatcattggcttttctacagattggtgatctattaccttaaacaatatgatcaggccacatcaattcatttgcaaatttcttcctctctctatcatgtgcacatgccaccataggtataaagtaattaaaatatatacgaattatttagtttgttaaaagccaagttgcttttgaagaaaatttgctgctcttagattatgattatttacagtttgttaagtgatttcattttgtaggcatagactttttattgtgattctgattatttacagtaatagcaactatcaaatcaactaatgtggtggtgattgcagatttttggatatctattactgtttatcgggaacattttttcactaccagaacggggaaaaaaaagccacaaaagcagtaaatcccattgctttccaagtgtcattgtaaatcctgctgataagaactgcacattttagcaatgtttaataagtactttaaaaattgagaattgtctcaaaagaaacagattttgaagttcctctgttgtacctacttccagattaagaaaaatcatttgtggaaaacaagttgatcccaagttcctaatcacagggagaagatgggattttgtaaacctgcagagcctgaatttgttattgcatgcagctgtgcaaatttgcaaacatttccttccctagtcaggaccctatggaaggagccagtttggactgctgccttgatagctaacatttgtagaggctgcagtgcaggaagctattggggtacctgaactttgtcatctattttaatctgggcattagatgccaggtagagagagtatgcaagccaattagttctgcttcaatgtcatggtagggatatatcagtagccttattattcttgtcattctcggtgaatttcagaatgctgcttgaaatgggctttctgtatgcgttgagtgtgtgttcagtgggctgtctgggaaggaagatagcggagggccaaggcctgggtctcctaaaacacatgattatttcattgaactaatcagtgagagaaagacagggccttgtggtttctacgagcactggacttgcgtttctttgttttccatccatcctttggaaccagagaaggcatgaggaccatccatgagcaggttcacactcaaagctggttgcccttaccctggttgccatggcaatgttgtcctagcgtaggggatacttgcctatgtttgtagctgtctcctccccatctttggcagtttagcacaagaggcaactccctcatgcaactacagagcatttaatgagttagggattcttcattttgagttacagttagctctctagtatatttttgggaggacaaatgggcaggaaaaattaagtcacaggagacaagcttcatgactctaatggagttgaatttacatttgccattaaaaatagctatagattgtttaattagaatcctagaggcggatgacgaattagtttatctttcaaatggtactcataaaaaatggggcagtgtgtgtgtgttttaaaagagcctaacttcttgttaaaatttaaagttcaaaccctcatttgtaaattggtgatagagacaattctataacgttgtgagaattaaatgagctaatacatgtcatgtgcttagaatagtgcctgaaatataataagcccagtaaatgttcagtgttattattatcattacttttatatgacagcatcctgggtgtttaatgctaatgatggctcattgagcagatattaagcatactgaccagtttccaggtatttttccaaatctgcctcaaggagcttgacagctaagggggagacaaaagtagaaagaagcagttgtttgaaatagaggcatggtcaacatatcctgggaaacctctgagcctgtgcactccagccctgtggactagcgagagaggtttctagaagaggtgacattgaggtgttggtcattgatggctgctcccagatgtgtggatatgggggcaaggagacaggggaacctcacttccaggagtgccagccaacgtagagcagtgagagaagatttctagaagaggtggcattgaggtgagggtcactgatggctgctcccggatgtttgggatacagcagcaaggaggcagggagatcctcacttcagaagtgccttgagttggttatttggacagatagggtgttcgatggcctgggtctgtcagatattctcagctgcccaaggtcagtgcttaatcatcttctctccttacaatacactgctttatattctccatggctgtaggggttttattctgtaacaattttgtaacaaaaacttcttaatcaaaagaatcattcttttggagagtggtggttctgaaaatcatgagaattaaggcatcttaaattactgcccactttatggacagaaccactcatttctcattattctgccagatccaagcaaatctcagaacagaacttatcccagactaattgaataaccttgaattcagtagttacactcatggctaaatttattattttctcctctttatcactcgggtagacacaatcactttcagaggttcttcagtctgatttacaattagctccttagcacatctttggaaggtcaaacaagcaggaacaattaactcacaggagacaagcttcttgtaacctcccaagaaacaaatactcacttctaagtaagttctgaagaagcaaataactattctaacttctgtcggacggtttttaaaaattttgttttaatttactttttttattttatagatttagagggtggacatgctttcttacatggatatattgtgtagtggtgaaatctgggcttttaacaggatagttttgatttagagacattagctgacttaatcacgggacagcactttctttattttgcaaattctccttaacacccctaccactccccaagctgttttgatttgtttagatccctgttgtgactccagacattgccaaaggtcccctaggagacacaactgtacctgcttaagaaccactcatctagaggaaaacggtttggtaaaggccgggtgcagtggctcgcgcctgtgatcccagcactttgggtggctgaggcaggcagatcaggaggtcaggagattgagcaatcctggccaacatggtaaaaccctgtctctactaaaatacaaaaaaaattagccaggcatggtggtgcctggctgtagtcccagctactcaggaggctgaggcaggggaatcgcttgaatttgggaggtggtgattgcagtgaaccgagattgagccactgcactccagcctggcgacagagcgagactccatctcaaaaaaaaaaaaaaaaaaaaaaaaaaaagtaaaagaaagaaaaatgaaatccttataatgtggaattagctgaattgtgccaatgccagagtgacaagggaagggtctgagttgggagtcactgtacacaaaggctcagccctagaaagaaggtaaaaggaagacatgcagagagaggtggtctcaagttctagcctccacttagtggagcgcccccatgacacttgcctggtgttgctctcctgttaccctcagagtggtgaattgaggatgaaggcttgtcttggaggcagcaaagaacagtgtctggggatatcaggtaggagaaggcaaagatcatttagggtcacaatcagtaagggaggtgttcaggtggctacactgtcagagtgatgcactgataaatgacagacatgggccgggcatggtggctcacacctgtaatcctagcactttgggaggctgaggtgggcagatcacttgaggtcaggagttcaagaccagcctggccaacatggtgaaaccccgtttctactaaaaatacaaaaattagctgggtgtggtggctcactcttgtaatcccctctacttgggaggctgaggctggaggatcacttgaacccaggaggcggaagttgcagtgagccaagatcatgccactgcactccagcctgggtgacagagcaagactctgtctcaaaaaaaaaaagacaaacgtgatgtacttcagtgcctgtggcatcaaaaacttccatgtcatatcctaattttgtatcactcctgcttccaactgggtagtgttctctttgggagtctacagaggcaggacaaagctctctttctgattacaagaactgtagctaacatttattgagcttggggctcattaacatgaaaagactcagagcagagcatgatattagtacattttatagacgagtgtactgagccatagagaggccaaaaaaattgtccaagtttccacagcagataggcaatggtcatgattgtgaatcaaacggtttggttatggaggctgcaccccctaccatcacactggaaagccggctttgtgcttctgtggacacttaactgacacccccagagcctgcacattccatggccaaatatgaagcatggaaaattatttggagaggcaaacaaaatttggctgtttggaggaattgagattttaatatcgttcatttttaaaattaatagtaaagtgaattctgggtcctgtggtgttttttgttgaccataggacaatgatatttgcaaatgggctttattaatttagattttgtgatagaggattcaagtgtgatttattgaggtaaatgtttcgaacccaaatgaccactcctttcttctctcttcaaatcctcaccactcccagcccaatcttattcctcaataattatttatcgtctggaagagtcaggtgtttcaaatgaggccagcatggacttttcccaacagggaggtattttttaatatctaaatgtcggcctatggcccttgctgttaaggctccagatcaaataggggcaaaaggaattgaaagccaaatcacaaaaataagtaaaaactccaactaacaagaatttcacaacagacataagctgatgactattttattaaagcaatgtggagtactactaaatgctactatgttctggaaatgtaggaaattggttgaagtcgtttttctcttgttagtctcatgttaagctgttcatactaggatctcttgggttattttttcccaattaatacagttgtctactaatttattttctttttaaaagtcttggccttaaactcagtcttggtattttcagctattgtttactaccaaaggaaaaacttcggatttagagaaaagtctgtatttttattttgtgtggagttgagaaaggggatggtaaacttgacattgcttggaaatgaaatgcacagcttgatctttttttcttgatatgatttttgtattggaagaactgtagtatgtcttggtggtgataatgaataccataaccacataatcattctctaaatgattgtaatggaaagaagttttatttaaaatttcaagttactcaaatggcacatgtctccacatgtgtctttttactacaggtaaacccagaaagcatgcgtggttatgggtgtgtgagtgtgtgtaacgtgaatgtgtgcctccctctatgttatgttgcactattagtttgaaccacaaaatagaaaagaatgtaaatatcttctgaactctggatttatctgttctaaatgaaagctagaggggaaaccattttagtatgtaaagtttggcctgaggaagagaatggcacttctacagttcttagaaaattctcatagaggatcaggattactggcatgcttggggaacaacttgctgtgggtagctgagattttcagtttcaaccagcaaatctgttttgtttcatcttttgtttaaaatatttgaattaataagaattatttttcaacttcaagaagtagtacatagagcaatgctgtctgataaaactgaatggtgatggaaatattctgtatctgtgttgtccagaatggtagccactagccccatgtggctatttagcgcttaaaatgtgtctactatgacggaggaattgaattttaagttttatttaattttaatttatttacatttaaatagccacataggacaggactaccatatttgacagtgcaagtattagagtataattaccagttaatgtatgtctctggtttgaaacattcctctgtattatcacactacgtatctgaattttgatttggaaaccgtggctgaatgctgggattgattccagctctgccaacaggaaaggagtggtgaggaaagctgttggacagctagccaaggatatttgccatatttgccagagtgttttgactgtacttctgtcatagtattaataccatttggcctttttaattgttatttgtgggcttattttacccctttggtagattctagattccttaaggatggggccttgctcttttcaccagcacatggaatagtgccttgccctagagtgtgcttaataaatattgactcaattgattagaattggtccatgccaattgattaaaagcttttctacctttaaaaaattgaatctaaattctttaaaatcaagttatttgtttgaatattgacaccctcccaataaagttatgtttattcattccagaaaatgattaaggggccttaatcataaaggtactggaataaagttaccatgggtttgtgtaatataaaccctgcaaagactgtttacaattctgtgtgggtgtaggaagaaaaaaggattcaaatataaatatgagtgagaaagaaaacttgttttgagtccattttatgcatttgttaacattttgaagactatacagtacaatttatcttaaagttatgaggtgaaagaaatgacttgtgtttaaaatcactgcaattctctatttgaagctccattgataacattttttgaggaaaacaaattacttgaataactttaaattcagtacattattatgcatatcacataatttcatttaaaaatcttttttccatagaatgagatcaaaagaccagattttgattgccagtgtggtgtgaagtgtaaagccagtgttccatgtcctattttgtttcataatataaacattcttcaaaagtttatctttcttaatgtaaagaatttttcatataaacttcccttcatttggttcaggttttagttattgtacatattcataaattttcattttatcaactgttttaactgatgtataaactttgttttttaaaaaagatttgagacagtataatttaaattttctctaaaaagaaatatattccttatttgcttgccaaatggtgaatttgtatgactaaatgagcagttcctacctgattcaagaatactcattcataatatatcatctcaaatgataggaaaatttaagtttcattcaacacaaagacatgaatgatttttaatgcattttattgtctgctaatggtacttttttagttacagaatttgctaagtaaagtgattataagcaaaaatcattgtgttcttgtgtcactcctgaaagcatctgaagtattcattcccctctcatcttctgatcttttaatcctgaaaaaaattgcaaaagaacagttaaaataatttacaaatgttcctagtgagtaccatttacaataacatgtctggcttcagttttgtcaaaacaatgtacaaccatttaagttgaactctataatttctgaagtttctttgttatttcgttgtcattagatattaggtgtccatgaggactgcttccaccttcaggacacttaaagcctattattttataataaaataacaattgctacctttttggggggtacgtcttgcatgtcaggctccaagcttatcacgctattttgttttccataaaacaactctaagaaactatcaatgtttatactcaaattttacacaaaaagaaactgagttttaaagagttcaaactatctgcccaaagtcacctttccataaatagctttgtcaagatgtgagcacattataaagttcatggtattaattattcataaagaagtaaatgcattttctatgtacagagagaacatgtgccttggactagaatagccaatgataggcaccgattacttgggattcaatcaattttcaaaaaattctgccccatattttccgtaaacatgctcacaattatgaagccatttatgacatatattatgatttttttaaattcagaaactatggtatttataattggacagagacttgaaaataatctgatttcgtcattttcccccatttaaaagaaaataaaacaccgatacatttgaagtaacttttacaatactgcctcgtctttgagggcaaagccagaattggaacctttgtgtcctggcttcttatcctggtcatttccacctcacttctctcttcttctcagtagcaaatcatcaataacatgtataaattggaattacagttggatacatatacatgataggatcacataatctcgtatacatagaagtaagactttatggatgtagattaagtttgttttgttgactattcccattcatttgtaagagctacctgtaatggaagatttagtgctaaattgcagtaacttcttgctaaaagcttaatcatctatagaaccccagtacagaaaaggaatctaacagtatgtttagtttagccgcctccaagttagattgaaaactactggaaatggggaatcttcctgtaggtttttgaagagatttcccgtctaccttttgtagcctgttcagatatttgcactctcaaaattatccgctccctcttgtcttaagccttcagtgcaactctagcctattcttgctagtcaaacctttgaaatataaggagaactgatattcccttatactgttgcccttaaaattcatggggtttagtaatatatatttctattaatgggttttggtaatacatattctggtagaaattcagtaatagtaaaattgaaacctaccataaaaactgtggtcttaattaccaagccatttagaggaatttgtctttaacataaaggtatagcatattgcttggactaatagaatcatagacctgtaactactacaactctagatccttggttgtcggagaccttagaactctggggcctattttgctgcaccattttcacaggatttgcattgtagtggcttcaaaatatactcaccacttcctcccgcttggtcttgtctgttgatggccaagcttccagagtcagatcaggaagcatgggaggcaggggctgcatggggaacatcggaggcagaggtggctgtggcggcaggggctgcatggggtgcacaggtggctggggctgcatgggctggtgaggctgtggctgaacaggctggggctggtagggctgctgggcgggcggagggaggtttggctggtggtgttggattggagtcatggagtgttggccaggaacgggcatcattggttgctgggggatcacgggctgctgagctggcaccactgggatgtggtgatgaggctgcagggtgtgagtcggggggtgctgttgggacagcacggggatgatttggtggtgcagccatccacccatgggctcgtaaccataggaagggtactggtgagaaacagagaggcaggtttaccattggctcaggtgactccaaccagagaagcagcagtgttttctttgccattatggctataggaatattttattcatttttcctttgcaaaaatttgtaactgtgtacacagatatgattttttacaaactaaatttcccattaatgtctgcatgtggagtagacatgatatttcacttaatatgggaattttaatgcatgcctaatattttcagggaataaggaacaaaatgtctacataccggtggccttatgctctggtaccacttcaaaggggtaagcaccttaagagaaaaagatattagaacccatttgatttaatttactttcatccaatatagaaactcactgatgcagtaggaaatatagactcactaatgcagtcctgtcaacattgatagcctgagaatgtgagttctacaaaagaaagaagaaggtaaaaatttgttgggtgcttcctgtgtgacaggcactgtgtttacatccatcacacacattcttcatcttttcttatatgctaggaggcaagtattattactctcactttttagataaggttatggggagttaaagagattcattaacttgactgaggttacacagggagtaaatctgtttaattccatagttccttcttttcattgtaagagcaaaacaaacacaaaattatgacataataatatgacatgatgttaatttcatttttttctttgatgtcacaatgggaaaaagagaggtgcaaacactgtccctcatcctagaaacacagattgactgatcagatgtgtcaatcttttcggttcaacagaaaatcttgcctcaaaatcttactaacatttgtcttcagcttttataagtaaataaactcatagattgttacctgaacctgtgagagaagtaagaatcttattcctttctgaacagtatatatacttggttagccttaggtttgaggattcttcatatagtaatacggcatttaatcgatacaaaaaataatcagtaaccttgctcatattatacttgacaaagcacttttcatattcattaactatattactctccaaacaatattttgaaatatggttattataattatttcctttctccagatgaggaaaccagggttccagaaagaggaaatgatttgcccaaaatcacaaagttagtaagaggttgaggagaacctcaaacccgacgtccaaaactcatgcattccgctgttctgcggagtctctcctataccacttagtcactaatatttcagcagaggcaagcaagagacacacatagagtgtgactatcttagaatcaggagttttttgagctggaaagagttttaaataacatcttacctaatccttacattttactagctgggttagaaccaagctggtcagagtttactttttgccctatcatggagcctccctgagtagtggttcatgatgggtaagcttacggccatatttaggaggacagactgagtcagagtggccaggcgggaggctgctgggacgacacaggcttgaggccaaccatcagagcttaaactgggaagctggtggtaggaactgtaaaatcaggaccacttgagaaacatctgggataaagaatcaacacactattctttacagagcccagggcattgttaacgcaaacaatggtcaaaattagtaaagagaaaaattacctcatagctgaagttgatataaccagggtgcccaggatgaggtggtagcttttacagggaggaggggaggagaatagaaagagagaggaagggagagagtgaaggaagagaagagagaggaagagattaagtcagtatgcaattgttcacattaaaggagactgaagctactttaaaaaaatctatatagtgcagaatatacttgaggtctgtttttagtttgaacaaatgtgctgtatagaagaggagaccttttattttaaagaggttcagaacagctaaatgactgttcctggggttatagccttatggctggagacctggaagcagaaaccagcacacatttattctccagtgatctttggacagcatcccacccccacgcccagtgttttcaatgaatcctaccctatcctgcccaacagtttacttgctgataaaactcaccccataatggggagagaagtgtgtttctctttcacaataaagaaatatcaacaaggagagaattgtctcacgaatgttcccttgtagatcaggaggtggtcaagtacttttaagtatcaaagggatttctcataattgacatgcaaagtaaacaacacttccatacaacaaaagaagccacaaaagaaaccacaaggtgggaattattgatgaatgccagaacaagatgggtggagcaaagtggaaacattataaatcccatggaaaatgaaagagttgatttatgacgtttaggccgatctttttttattattctgccaacggttttatggcagaaaaattttcaagttaaaaataaaaggccacctgaatgatgatctgaatcaggactgtctgtcctctcaaaagtggggcccaagtgtctggtgcctgtattgtggaactctggttgtgcctggggtccagggaggagagacggtcatgcagaaaatctccctcagacattggcctcatttaggattggctctattatattctttaaaaatgctcacatttcatgggaaggtttattctctctcatctggatgtgaatggttttagtcaggtcctataccctcttgaacaataccatcttagagagtgggaaaagggctgaatttgtaaggcagggacccctgaggaaactaggaatcgctgcaatgcaggatttcaggaagtcagagcacagaatcttggttttgtgggtgagagaggaagagaggaggcaagggtgcaagcttgctggcttctggttgtatcaactgctctttattccaccaaaaagcagatgcagcctgcttggcatgcatgtgatctaagttctctgcccttatgcacctgtgtccagacagagtgggtctaatgtcctgatctttaatacatttgaatataaaatatatcactatgtattgggtgtaggcaggatcccgggcaaccacaaaaaagtcacgtactcatcagatgtacccaaaggggtggggcctctgagaacaggaatgtggctcaaaaagtggattcctaacacaaaaatcttaccccctgaggggtaagagcagcaatatgtggagggcaggaagagatttggaatcttgagaggaattgggttttagacaaaactggcatctctgtaatatttgtccaaagctggttaagcactttctctggagacctttcaagggtcccttccaaaagcttcctccatctagagatgggtggtgatatttacaagctaacagttccaacagaatctcctggggtgcttataaaaatgcagagtcctgggccccgccccagctgtaccaaatcagaatttttggtagcggcatttgagaatatacctttttaaaacaagctcctgaagtgtttcttcaacccagagacatatgaagacatctgatctcatactgttttaaaccctaatttcaccaactatgagcagatttttatgtccaagtttgtgaaattggacactgacttatgcaaggggtgttttactcacaggcatggcaaaagctgctcccaggaggcaggcaaataaaatccaggtccccatttcttgatggttctgaaatgtaagtcaacatccacttttcttatctcttctgaaacatggatgtaatgaatgctccataaaacacacataatctacattagtctattgctagtaagaaggatggagccattgtttgtgaatttacttcagtcatatgtgatttccagctctcagcctatttcattgtttctggagtcacagtagtgataaagatgcatttaatttaggttgagggctaaacaagttacagggacatgaatgatctatcttcatatgactttgcatgccattttcctatgcctatacagcccttagtcatagaagctaaattgtatttataattaatgattaaaggaataaagttggctctaaaggttgggaagatcatcaaagtgcacagtattttataattttagaacaaggaggcacagaaatgtctcgtgcacagtctacctggacattgctactgttaaaaacaaggactaatcatttgagaaaatatattaatttgccaagatagattttagttccagaaattcctatctacagaacttcaggcaagaccctccagtaacatctctgagctccagattgtggagcaaaagatgtggctgaaccaacaggagaggatggtacgaattttatgtgattcttcaatgaattttgaatactttctccctaagaggtttcattttctttcaatggaatcttcattttgtttgatgttgcactgtaattattctataaataagacccttgggacattaagcaaaacaggtcctcctaaaatgtgcacattgatttgtggcacaaattactgggaaaactgtcagaagaaagaccttaaattttgtataagaagtgaatattacatgtgataatgctgtctatgaaaagtacactaaagttttctaactcctaaatttgttttttgtttgtttgtttgtttgggttaatgagaaaaaacacttcatggatggttctattttatgtaattaaataaaaagcttttcaaagtagtagatcacagcctgtgaatgtattatttttactttaatcgataattaattaaaataaatattttactgtgaaatgtggccaagaaagacctttggaattagacaagcactttgttgcattataaagttaaaaatcatttcagtaatcagagtctaatttaattatgggccaactaaaaagtaactattgatggcatatagtattagaaatgtagaatacatttatatcttttaaaagaaatgcagagaaagaaataagcacaataaaaaggatatcaaattataaataaaatccacatacctttgaatgtattcagtgcaagtttctgtttgaaactcagggatgcttgatcctttagatttcttccaactataagctcaatttatatcattcatggcatctgtaacaaccaatccagtttctaaaggaaaaatgtgttgagtataactaaaaatccctgtatcatgattttttagaagctatgatcagacataaggctgtatgttgtgattagtgcatatggaatctttcattatgggcaataataggtttaacaggcaaagagtttcatcacgctattttgaagtcagcaaattagttgactgtacatgttgatatattcagatttatttttaaaaagcttctctgccatcgccttttcctcagttctagcaaacaacgttgttctttacaaaaatcaaggtaggtggttgagattctctagtgtaatctggatatcctccaggatttttccagccctttcagatcaggagaaattgattcaaattcccatttgggtaaaaccccaaagctctctctagtttctctctgaggaattataattttgggatcaccactgctctattatctgcttccattgaaggtattttttctctgttccccttggctactcctttatcacccctctggtgtccaccaaaacaggggacaaagccccttctcggccccatgctgaaacccatctaccgtaaaaacaatcaggaacttaaggttcttgcagtagcaaagcttttactgatgatctatactacaaggcaaggagtgcacaccagacagcacattttaaagtaaattttgttttttacaagcaaactcatgtcacaggggatgttgtcctttgcctcccatctcacagagcagcttggcctctcagtatggcggcccttctttgcccatatccttctggcccaatcccactttctcatacaggcaaacccaaattcctctctatttttcagagtctcttaactgtctggctagctactttgtttccatgttctcagcagcctcccctttccctaagcaatgaccaaagctattcactttctaaaagaacctctgatcatctacctattaaattcatgtgtgttttacccctctaccttggtataacacatgggctttttctttcattctggaatttgattagattgatctaattgagcaaagttgtaattagtggcaggagctaactgacgagtcgtccatcaatattagatcaataaaggagatactgaatatctacccagatacagttgatgttatacttggatctctttgaatacacaagtaatacttataaagtttgtatatatacatatgtttatacgtatatatacaaattacttagcctgtctgagcctcaatttcctgatatgtagaatggaaataataacagaacctagctcagggaattcatgtgaaaagtagatgagtgacatctctggggaaatggaagtctatttattactctccccaaccctgtcagctggcatacagtaaatgtttaaagaatgctaataaacaagattccaagatgatctttggggataaatcagtagggatgaatattgcaaagaaaggtaagaccttccaatcagggagagagagattgcaaagaaggaagtagaagattataacaggtaaaatgtatgcatgaaaagaaacatagaatatgattctaaaagccaaatgtccccaggatttggctttatttatgaatatatttattggtgaattttatagcagagacaagaaggattccctttgaaggaagttggaaaatggaccttaggaggattggcaggggtgtacagcaaggtggtaagggagaggaaggaaaatgtggatcacattttattcactttcaatctttttcccccattttatataattacatatattggagtgtctgaaaggattcaggatattttttttttctacaaagttgtgggtaatctctactaatgaagtcaatgatgaattactagtagccttgtagttttagaaagattgatcttatactttttctcaccttctaagaatgagaggatgatatatttggccataatgatcaacaggatgctgccttaatgtggcattaattcctctggaccactggatagtgagttaccgctaattcaccatggacagttgaacaagctttgatggccgattccatagaaataattgattttcccctactgcatatcctgaatcataggacattaaaatatggatctctgtttgaaatctcttccactaatttaggccccacttacacagcttaaaaattggtaaatgttttgaggaaaatgaaatttcaattgaaatatttttcctataagcaattattttatttatgaataaattgactgcataaaatagttcttttgctcatttttttgtagtaggtattctttttcttgacttgcagcccagtacgttttgctgttctcacaatgcttatgttagcaacttccccacttctaatttgctgcttctaatttacagtatgctagaaaatcatatgcccaagcttgttaaaagtatgcgtgaactgaaagtaaaggaacactctaagtggggctggcctgggagggcctcgcctgtgagaaaagcaaatgaatttcggttttgtgacacttatttttgactgctgggagggtgtttggtttgttttggggttcctctccactggcttactgcctgggtttcaacagcactcggggtatgagggtggcctttggataagtcaggtattatgagtttgcaaagcctttcctatcatctgtaagagttcaactcttgagccttcttttaaagcatccccagggttatccaatattctggaataatttcaacagtgagtcttcttaagtagctggagccaaagctggcttttaaatattttctctgtagatgtttacttacaagaaaacatcattctctaggatagcttttttttttttttttttgctggggtagagttggagttgtatgatcttcagatcttaggcacaaaaccaccgatgaattccgatacacatcgtaactttgaccccaccgcaacccttagaaatcaggtattgtgtcttatactttcttgggagctccttggtacctagaaaaagctcttatacaaagtaggtgctagataaatgtgttgatgaattaatgaaaatgtagaaaagttttccatgacattgtaaacatagaaaatgtggattctgaaagaaatcctacagtgatttagatggaccttttcaatagctaagatggataattcagcattgctctcaactgctcctgtggacttctgtgcaaatgacctctgataagtatctgaaaagggagatgctgtaaaagcgctagaatctattatcctaacagtctcattacatttggctctgacctcttagttcaaattataatatactccaaacaaatacactatgatagataattttttgttgttgtttttgagacagagtctcgctctgtcgcccaggctggagtgaagtggtacagtctcggctcgctgcaatctctgcctcccgggtttaagtgactctcctgcctcagcctcccaagtagctgggattacaggcacatgccaccatgcccagcttatttttatatttttagtagagacggggtttcaccatgttgtccaggatggtctccatctcctgacctcatgatctgcctgcctcggcctcccaaagtgctgggattacaggcatgagccactgcgcctggcctatgaagtaacatttaaaacaaaatgtctaccaatagcggggctggttcaaatcgattatggcacaaatagcattcaagatgaggatgtcactctgcgtttgtcaacataaaaagatgttggtgatacattgttaagtggaaaaatagattttttaaagtccccttctctaatttttttctccctccctccctgctctcccttctctccatttggggagatattcgccaaaacacagtagttatctagggactccttgaaaatctctgggtagccgaggtttaaatttatttcttttaaataatctgtgaatgcaacaaatgcaggggaaatacgagaagtttggagtatgatatttctcactcatgttcagcaagagagatgagtaagtgatagtgctacttgcataggccctgggtatatccaatgttcattcttagggggaaaaaaggttcaacataaaatccaagacaaaaaaaaacacacgattttttaaagtgagagagcccttttaaatcatgagtaggaaatattttaataatataaacattcacagcaagagttcatacagcttgtaatttgaaaagtccgtaggcatttgctaaatatcaggtggaacaattttcaacaagggaaattatatgcagttgaagagtgtgttgtttggattataattaactggtaactgtcaggagtgaaaatggtacatctgtgttaaaagaggtaggacagtaatgtaaaaacaagcatttttattcctgtttattgggtaaaatataccaaagtaagttcaactttcctgctgaggttcagtggagacatacatagattagtagttttttaaaatattgttcagccataaaatggaatgaagcactgatccatacagcaacatggatgaaccttgaaaacattacattcagtgaaggaagccagtcataaaataccatatactgtatgactgtataggaaatgccaagaataggcaaaatccatagaaacagaaagtagattcatggttgccaggggttgagggaagggggaaatggggagttactgctaatgagccccaggtttctttttgtgatgatagaaatgttctggagttagacagtggtgatggttgcacaatcttgtgaatatactaaaagccactcaattgtacactttaaagtggtgaatcttatggtatgtgaattatatcttaatttttaaaaggacacatattatatatggtatgatatcggccctcaaaaaatgtacagcctttatacattatgtaaaatatagattaaaaggctaaacacggtgtaatggtacagaacaatagtgtaagtgttgccccacgatgataaagttgatgatgacgactatgatgaagatgaaactaacctttattgccagccatggttctaagcatttaacatgtttaaatgtttattggtcacctcccgcatgccgggtatattctgggtttatgttttacatcagtgattaaaacacacaaagactcctactcacagtctcacagaaagcaactatgaacaatggatataataaataaggacagcagaagagaaagcctatggaaaaggaaaaagtagagcagctaagaaggattagacgtgctgagttgcacgtttcaatagggtggtcagttttaaacaatttcttgaagaaggtgaggtgttcgcctgagcatctctgggatcagcacaaaggcaccagcatggaagtggcccagtgtgttagctagctggcaggaacccagcactgctggtgtggtgcaaggtggagggcataagaggagctgaaggccaaaaggtgacatcttctcatgcttccatgatcttagcaattaaatgtagaattccttgcctaaaataattctattgttcattgtgtgccaggggcttcaggctttggagatgtgaaggatttggatagacatagaggctatttcctcacagggctgagtcattggaagaaagagaaacgggaatgggcagagcatgcttggtgtgcagaaaaagaccagctaggcagcagcagaggttttaggtagaaaaagggcaatggcagatgggctgttgggaacagagagaccctgaatgttggacagggaaatccacttgtgtcccctctgcagtggcaaagcactgagcatttgtatccactgtccttgcttgctagggtttctacaagaaagttcgtctggaagctcagacttgtgtcaagaatgagaaggtagaaacacaaagcaatcagatgacttggctgtcttcacatcacattgagagtcagagcagacgcaagacccctgggctctggccctggctcagacactcttcacccacttgctcacagatgaatgaggcataccttggggccccagatcaaatgataacattataagaacaactggaaatagataagtctttaaaaatacagaacataatgtttttcctgtgaaatatagggttgcattcaaaaactgttaccagagaatattctccagagaaacctacagctattcaaaactgctctacaatataagctcttgtttagtaagaaataaaagctatttaatgaaaggtctataaaaacggatttaataacttaatacataattatatgctataaagttcatgtgttgaaagggtacacttgagtgggttttagtatatttttaatgtatttacaaagtttgccaccatcaccatagtctagttctagaacattttcatcacctgaaaagaaatcccatacccagtaacagtgaattcccattctcctccccttagcacaagacaactaccaatctatttcctgtgtctatggatttgcttatttggtacatttcatagaaatagagtcatacaacatatggttggaaaatgtgtctctgagaacctctacaaaaaggtttgtcggtgttagcactcttggcatttggggccagataattatttgctgagggatgtttagcagcatccctggcctctaccttctaggtgttagcagcaacaaccctcgctcttaagttgtgactaaccaaaagtgtctccggacatcgcatatgtttgatgggggagtgagggggcaaattcgcccctagttgaaacccacagatttacagttacctaagaactgagctgggtgtaggggtgtataaagtgaggtgggtgcctggacccagggtgctgttgtggaaagacaactatttcagggtctgtgaaggtccaaagtttgtaccccaagttccaaaactctgtgattcattttagcaaataggaaagagatgactaggggcaagaggcacaactgttatttagatgaagttattgttcaaacaatagctggtggggaaaaacactcattttttcggtcactaaaaaagatagagggtgatgggtgcaccaaaatctcacaaatcaccactaaagaacttattcatgtaaccaaatatcacctgttccccaaaaacctatggaaataaaaagacattttaaaagatagaaattgttattttaaaataaaattcaatagtatatgccagtggtctttaccttccttataaaggactggaatcatggtgtcaataattcaaaaagtgtctaaatttggatttgggctgttttatgttacaacagtaagaattaatggttctcaaagagccttacttaagtcagctttaacattactctgcagactataaacaccccttgagcagcaaaaggaagcatgaaatttgatttataccgtagctaacgaaaacaagtgggcaatcacaatttgatcataccctactaatctaatttagtctcaggaatggactaaaaagaggaagcttgtggactttagaaatatgtacatttcagaaaatataagtgtgacctcttttcttttcagaattgtgtaagtgaaggaagctgtcatcctccctggtaaatccatttgtaaataaacgggctaaagaaatcatgactgtggtcctttctagttcttaggatctgtcctgctcagagtgggaatcacaaagtgattgaggtaataactggtatctttgttgttctcagtttaaaggaagtgttctctcaaactgccttagactgcgcagccttgaccctctaggacttgatgccctgtgtatggcattgttatcagatgcaagttagtaaacccagattgtgtttacaagtaggttgtcattatacagtggcttctctgtaagtacaaaatgtatatttcctttttatttatcatggactatagcaattacagaatgtagctcttgtttttatcagggatattactgaggcccttaaactcaagctgacttacatttattttaaaatacatgttccaaagatgtttttaaaattttaaatatgcatatttttaagattttcccctttaacctgttctcccatcctgacatttaggatggggaatagacagaacatctgagggagtttgggtctcacagatcggctgtaaaattgagtaagagcaaaatgtttggaaaaaaaaaaaaaaaacaatctgtgtggttgttcatctggaaagatctgttccccactcagtagcttacagaaggctcaacatgatatggatcagctcgaattcattatctgaccaaacagcaactcaggaatcttatgtcctgtccaaggtgtgctgtgggactcaataatctctttccagatctattatatctacataaaaatatgcatgagaatcagataaactagtgggcctcaaccaggaatgattgtgcccttcagggtacattttataatatttggaagcatttttggttgtcacaattggaggatacggatgttcctggcatctagtgggtagaggccagagatgctgttaaatattctacaatgcacaggaaagccccccaaataaagaattatccaaccccaaatgtcagtagcattgaagttgggaaatcttgttcaaggaaattcccagtgcctcaggttgtcttatgagatgtggagcatgtcaatatccacagttgccagttgtgccatatggaatgctgcaaggagaaaatatagatacacatgaaaatgtgtttttgggatttggggaaatacatctatggatttgatactttggtgttccaaagatgtggctatttttgcccacaagtgttgcccaaaaccctggggctatgtggtgcctttttcacagagcaagtacataaagtacagactgttaaacagatcactcacctgctataaaatgtcagttaataatgaggtcctatcatggatattagttgaatgataagtgccacttctttcctcttacatgtttattagtgtcatctaaagcaatggctctcaaaatgtggtggctggaccagcagcattggtatcacctgggaacttgttagaaatgcacattgtcagccccctcccacacctactgaatctgaaacttttggggtagggcccagcaatctgtgttattttaacaagcttccccatgattctgatgaactttaatgcttaaatcggagaactgttggggaccaccagcacctgggagcttgctagaaatcacatgactaggccaggaccttgttgaaaggcagattctcatttagtaggcctgagaaagggatcaagatttgggactacagatatgatagcttgggtaaaaactacaaaatttctcctttttgagccttctatttccctcttcaaaaattgggaagacattgtattggttccctgttgctgctataataaataatcacaaacttagtcgcttaaaacaacacaaatttattatcttacacttccagaggtcagaagtctgaaatgggtctcactgggctaaaatcatggtacctggtgactgtaggggagaatcatttttcttgacttttccattttctagaggctgcccacattccttggctcatgtttccttcctccatcttcaaagccagaaatggcctggtgagtctttctcatatcacatcactctgacactgacccttctgcctccctgttccacatttaagttgctcctgtgatgatattagtcccatatacataattcaggacaatctccttattttaacagcatatgattagcaacattaatcccatctgcaactttaactcctctttgccaggtagcataacatattcacatattcttgagatttggatgtggacatattttggggggcattattctgcttcctacacaaataattttacctttattctccagcaaaatttgtgtcatagagaaaaatcttggaaggaatccagtcaggaccaatctcctaccaattcagaaatcttcctgcaaaatcctccaaacttggccatgtgatactagcttctcagctagactgtaagctgtatcctacagaagaccctatcttatagttattctccatctcctcagtgcctagaagagaatttagctcataatagatacttagaaaacattctttgattggtacactgctttcaggcacatagagcacgatatgactatatagactgtggaatcttgactttgtgaaactgagggattgatgctgaatctctgtcaagccttattaccctcctgtgtaaaatggggataatattacattctgtataggattgttgttggaatcaaatgaaatgttgtaaatagagcacatggagatatagatataatttacatgaaacgtctgaaaccataacatggtagaatactaccttgtgataatttgctaacaaaactgcacaagataaggacaggtggtattgagtctctttacataatgcttactgaagtgtcgcctctggcttcatttataacatcaatttagaagcagtgtttctcaacatagactatatttttgaaccattcgtgtagcttttaaataatatttttgcctgggttccattctacctagtttctgatttacttggtctaagcattggctccaactcttgctatgtttttgaatcccctggggaagcttttataaatatcgatggccaggtgccacctccagaaattctgtttcgatcaaatataatgtgtagccatggttgagatccattgaacacaacttattctaccttataaattgttacatctgccagacctttactgtatatgagaagttgtagttttatcaactttgcctgaatcagtggatgtttttctaatttccattcaatgtcattggtggaattaagaacactcaacataatgacatttgcaattataaaggtggtatcacatccccagagttttagcaggatggcagaaccacagtgagcactcagaaaacgtttgctaatgatgggccaaaaaaaagtgtcttttatggtctcttgatttattcaggaatattgcattgcagttgagtctctcacagagtccacttgaggctgctaacatgttgatttaatgaatgggtgcatttcatgaaccacccatccgagtgaattactttgggtgtagctgttttgatttttccttcctctgagtatatggttttgttaatttaaacaaattcagttgttttaccattttgtagacacattctttgtgtggccaagaatcttgtttgtggtggccacaccacaactggatttgaatgtagagcaacccagcaaagaagtgctaatttgaagcaattgttaacattgccagcaacaaaccaaagtgacctccatcaatgggttcagttagcaaccctgaaggcaagacactctgtttattccattatcgtttccttcatctatcagaaaccctaatcttcatggatgatgaaataataacaatctcaaacttaagatatattttgttcatcttaattttctaaatgtccttttttcccctcagtacaaacataatacatgtaaataaattccaacactataaaaattcattaggcagtgtcaaagtcccacaaatcccatcctccagtgatggccactaataaccatttgagaatatataaccccagatctccctgttaaattataataaacatttatgtccataacttgtgttctgcaacttctttgtttaactttacatatagtggatatctttccaaatttattcagagagaactactccactttttttcatgactgcccagaattccactgaatagataccccgtagtttagttagccagttgctcactgatggacacttaggttttttatgtttctttaaacatatatgcatataactaatatataataaaattaattatatataagtattaatatatatattttggtagattataatacacatgtagagaagtgcacataagtttacaacttaatgaatttctgcaaagtgaacacacctgtgccagatggagaaccatccctgaccagcacctcacagggatcccttggactcccttccagtcacttctccccaaaggtaacccctattctgtatttttgtagcatatattggttttatctggttttatagattacattactggtatcctacagcatgttattttttatgtcagacttctttcgctcaacgtgatgtctctgggattcatctgtattgttgtaggtggttggagtttgttttttcattcccattactgcatagttttccattatgtgatataccacaatttattcagtctactttcacgaacatttggataatttacagttcggggctgttttgaataatgctgctatgaacattctagcacacatattttggtgaacatatgctcacatttccgttgtttttattggtgactgggtttttttgctatcagatattgtactgaagtgaatgtctttgcaaatgtatcttgcacattttgcaagtattgctataaagtagatattagaattgctgggtcaaatggtattcacagaactgctccgaaaaaaattttgattttttttttttttttttttgagacaaggtcttgctctgtcgcccaggctggagtgcagtggtacaatcatgtcttgactgcagcctcgaaatcctggactcaagcagtcctcccatctcagcctcccaaagtgctgggattccagatgtgagccaccatgcctggcctaaatattttgacttttaagctaggtctggacctcaagtaacctattgtggatacacccctttgctattaccattatctgtgacacagacgctgctattgtgtcttcctgactacaaggcaagactaacaaaaaccagaatcttctggctcttttcagtcacgctctagtgagctagtgcctctttcatgtatccactgagggacaaaaagataaaatgacctagtgtcccaggatgccagcttaaacttttgagtacattgatgctatgataatatacaccaaatggactctgtggctctaagtaccatccactccagattgagataacctcctttcccaagtagagaaagaagattctaacctggaggtgagagccatttgcatgtcttaccaaaaaatgtcccattcagaatgagctgacattgggagacattaggttagagcagtgtttcccaaccttggaactgttgacatttagggtgggatcattctttgctgtgggggccgttctgtgcactgtaggatgttgagaagcatccctggactccacccatcacaactggcactttcctcctcagttgtgacaaccaaaaatgtctccaggcaatggcaaatgtcccttgaggggcagaatcaccccagtagaggactactaagctagtgcttatagaagaccccagctctaaatcagattatgttcagattctggctcagccactttttatgtgacctaggacaaagtacctaagttctctgcctcatttggctcatctgttaaatatagatattaatagtaatatttacctcaattggttgttgttgagattaaatgagattattaatgtgatgcacttggcatagtctttggcaaaaaaataagtgtcgaaagttgttaggtttattagtcataatctttattattattaaaaaaaaatggaggggtggaagaaggggtcccattgtgtatcctggaaaaaggatgaggataatgcatatctgaaaaaacatcaaaggacaaggggctcataactcttggaacacaggcaatgggaaatggaaatgtggagaaaacattaagtgctatgatggaagacaatggcatttggttgtctctctctgttccttctcaagttaacatttggaaactagaatttgtggaaaatagactttggcagcagaattaggcatttttaggaacaggataaatcactgtggggaaatattttattgtattactcttgttaatatgaagttattaaactttcaatagtgtgttgaatgcttttatcttaaataataaaatatattcagtgctaaagcagctgtattgtttttgatattattaagtagaaaaatttatctgttaggagctttgttgggttgattttcacctgataccctcttctcccaccaaagatctaactttcataaattctggcaatagaaaaacaagtcatcatgttaagctaggtctgaaccttaagaaacacactgtggctgcatccctttgttattgccattatctgtgatgcagatacagcaagacagagtggcatcctggacgggactccagatggagagtatgagtccagggttatgtctttgtgttgccaagctgcaccttggcttgtcacttcttcccattgtgcctcaggttctgagcagatggaattagtttagcatgtcccaactatattctggggaattcgagtgatatggagagatggtctgaaaattaaaaaaaaataaaaaatagaaggaggtgagattatagcaagtgtatttaggaggtactccgagttatgatttcccctctgcaggacttctctattattcttattgtttattgtgactacttaagttgaagctaccatgcacaactttttcaaatatatttgattatggaacagcttggaaaatcctgcattaaataatgtatgtgtcccttgcaggcataaaaatattctgatttcttttgaattaatctgtcatcatggctgtgacaaattaccataaatttagtgccatgaaacaatacacatttattatcttaaagtgctgtaggttagaaatctgacacaggttgcactggacaaaaatcaaggtgttgacagagctgcatttcttctggaggctctaaaaccacccacactccttagctcatggcccccttcctccagcttcaaggccagcaatattacatctcttagatcattattctatagtcacatcttcctcaaactctgaattctgctgaaaggggttgtcctattttaagggcctgtgtggttacgttgggcccacctggataatctagacttctgtccccctctcaaggttattaacttaatcatatgggcaaagtcccttttgccatgtaaggtaacacattcccaggttccagaaatcagggtgtggaaaccttaggggtgagagatattattctgcactacctatcctagtggcttcttccatttctcaaccctggagggtgtggggtcgtgttctgtagagccaggaagaagttcagcatttgttcatctgcttttgaccctagcaactcatgaaatgtgcaatgactatcttgtaaggggtattaaattcttctggcttttcctcacccagtaagcaataaaatcaaagaggacaagagtaattaaagcaagcctattgatctattttgtgtagcattctttttagcttctcttctgatataggcaagaatatctccctgaaaggaactaaactctgaactgtactttaacaagtaaaattgccatgctggatatcaacaattagtctttagagttaaaatataaacataaatgattaaattagttaatctactctttgtggtatagccattacagggctaatttttttttaaaaaaaaaaagaatactagaaacctctaaatttttcaagacactcatattcatcagactgtaaaaagcaaaagaaactgaaggattgtgttccttatcacagcttggaaaaagctctgatggctgatctatatgaagtggaaacattgcatgagttttcttgtaattgttgatatctcatgtgaatggaatgaggcggaaaacaagttttgcactaaaataagtgtttgaatcttgctatttggagtcatgttgtctacgttttttttttttgtttttggctacatagttaccatatgatccagcaattccacttctagttatatacccaaaatcattgaaaacctacgttcacacaaagtgtgtatgaatattcacagcagctttattcataccagtcaaaatgtggaaagaacccaaatgcccatcaactgaagaatggacaagcaaaatttagtatatctatacagtgaatattatcctgccataagaatgaatgaagtaatgacacatgctacaacgtggatgaactccaaaaacatgctaagtgaaagaaaccagacacaaaaagcccacatattatatgattctacttttatattaaatgtcaaaaacatgcaaaaccatagagacagaaagtagattagtggttcccaggggctggggtgagaggggaatggggagtgactgggtatgggctttccttttggtgtgatgaaaatgttttggaatcagtgatgatggttgtacactatctatgagtatactaaaaagaaacacagaactatacactttaaagtggtaacttttatggcatatgatttttatgtccaagctcttctattattttactataatttatttttgaaaatgtaaatttcaatatgcttcattgctcagagaaagcatgattttctatacatcagagcaaaagtatttacacaggtctgtgaaatactgtgtaatttatcattttaaaagtcgtatattgaggagaaaacatttttgaaaaataaatctgaaaagtggcagctagaaaatcagatgtgaaccagtaagtgcagatggcttgttttcacgtcatacctgcatttggtgtcatacttcatgttggtttctcccttttcaattttcccttttacatgtttgtctcttaatactaaaagtcaggaagcaagattttcttttttttgcatttttactggaagtgattttagctactttaaaataaatgtcctaaatataaatattccctgctggtcttgtttccatgctaatagacagaaatgattttctgtatagacagaattgctactctccttcaaattttctttcaaccagcaaatatacaaaagcacaaaatgttagtgctgtttctattcttccagaacctacagtctagccagggagaaaaggcacaaatatagataatcaaatagctttccaatgtttaaataagagtcaagaaaatagctgagatggggcagggtcggggggagatgagtgtgatggttacataggagggacgtatcggtgacgttagagttttctggaaaaatagctgacatttaaacattcccacccctcctctttcctccctcaatgagacatcacaagtgattgtctagacatctcaagtgtctaggtcatttggaaccttgaaagaagcagattcgccttctttaacaaacataaggtgaatttcctttggtcatgttttggtgttccttataggtccatagtaaacttgtttgtgttttagatggtatgattttcttgttaatgtgatgattcatttgtaatgtccctgtagggggacgacagggcttctcagaggaggtgatgctcagtaagcattacagggtgagtaggaaggcatggggaagccatttgggctgagagcacccctcaccctaaccatgaagtcctctgggctcttccatgtggctgaaattaagggatgtgaagtaagtgaggcttggtgaagcccaagagctaagcagtggccagatcttgagcgatcttgtgttttcacctcagagttgagaacttcatctggaaagctaggagcctcaatgatggctttcaaaagggaagggacaagatgagttttgctttgtagggagagacagcctacaagagtgtggaagtgctggtggacattcccagagaggaagtgttaaaggaaaggacagtttttaatgaggtgggatccacagaaactggtgactttctgagtgtgagtaggagagacataggaagcaatgttaaaaatgattttgcttcagttttcctgggtcactgcagggaacccatactgatgtatttgaaccacagaatcattgcccctaattttattgtgtgtattttcaaataattggtttacttaaagcaagatgcatttgcatacgtaccctttacccactgtgtattatcacatacctattataaatatttgtctatataagatagaaatatgtcacatatataattcatcatataataaatatataatagtcaagagatacatatagatacacatagatgtagagatagttaaatctatttaatatggagacaaatctataatgtttgtagtttttaattacaagtttctcaggccggccatagtggatttgataggcatcactctagtatgaatgtcttttctttcgagaatacttggaagaaatgctgattcctaataagtagctcataccaaatactaaagtccatgctactgatttcactttttctccctgagctttttctcattatgtgcgtaaaagaaaattagacattgagtgatctctgtggacccatctgctcatacatacagagatgtcacaaacatagttttaaaaacatgtggttcctggacacaggaaggggagcaacacacactgggtcctgtccggtggtggggttgggggagggagagcatcaggataaatagctaatacatgctgggcttaatacctaggtgatgggttgataggtacagcaaaccaccatgtcacatgtttacctatgtaacaaacctgcacatcctgcacatgtaccctggaacttaaaattaattaaaaaaagaaacagaaaaaaaatgtggttcctttgctgtttgaaatagtgaaatgctccaccatgaaatgtgaacattgtcatcccctatgtcatatatctggtgatttcttttcagtgggtccagatctggggtcggcaaactttttctgtaaagaatcagatagaaaacattttaggtgttgcggatcatactgtctgtgttgcaactactcaactttgctgttgtatcggaaaagcagccacagacaataggtaaatgagtgggtgtggttgttttccaataaaatttgattacaaaaataggccttaggctgtcctttgctgaccctgctttaagtcaacagttgccacctcaaggtcaaggcatgcctcagtcaatgtgttagaagtaatttattacctataataattaagttacaaactttagaatatttgtaagaaaactaaatgagagagaattagagatgagcctagaaccacctcatacagttattttgatgaattttcttgagtaggagagcaaggtgcagaaaagtagcataggatagtggttaagaccacaaactcaggactaaggtccctgagtttgaatttcagccatgccacttgcaatatgtgtcctgggacaagttacttgactgccctgtgctttgatttcttcatctataaaatgggcatattaataaacctcacattttaagattgtttaatgattaaaaccatgagtacaccataagggactggaataataatgggtacacactatatgtacaagagatgatagtcattccccacatatctaaatcttttggatttagatccaggacatagctctcagcttattttatctgtgctgtgagtcactgatgaataatccttactgtgcaccactaattagtagttgtggtgactacaaatttttatgttgctaatgggttgtaattttgtagtttctgaggttaaaaaaaaaatctacccatagatggatacttaacaagaaagaagcagcaaaactctgtgtagaaaatgtgaacgtgcacaaatcagtaatgcccatgagtgaaaatgacatgggaacatgttgttagggtacaacagttaaaattaccaaaaggtcaacaaagcgattatgtacttgaacattggacatcatgttctttatgttcatatcactgaattctggaattctgagtctactggttttttttttttacaaatgaaataaaatgtagctatgtttacagcatacccttccttgtccatcctattaatattaactggtggcatggaagtcaagaaaaatgactcattaaaataaaaatttttaataatttttaaaaatcagattaccatataattgatttttttgtaactgttttcaaaatggtcttcatattgccacgttaatttatcaaatacttggaacatgcttttagggatttcatgactttctccttcaaaagttggccccgctatttgctttatttaccaaaaaaaaagggtgaggtttggggaggggtgtagggaaaaagcaatcaaaacctgggtctatcagcgcatgtgacacgttcatttatcataagtgttacatgcatagctctctcctccctacaggactattttatctccactttacagagcaggtaattgaggcttaaaagcgttggatactcacatggctagttatatgctgaacttgaattcaaacacaggcagccagaaggagagtcctccctgtaaccactgtgctataacactgcatcccatttgaatgaaacagtggcaaaatgaacagataagatgaaagctgcttaactgtgctactgttcaaaatattccccatcacatctatggcagagctcatggaaagtgacatctggatcaagcctgtgcacgtgaaaaacaattttaaattatggatgtatgtgcttggagacttaatctcttaattggtagcattgttaagttttctttctgctgtcaatggaagagaaaggaaaaaaagaatctgagctttgagatgagggcacgttatgctctcggtgtgggagaaatctggcagaatcagtcaatgaaggaatatatggagagtgcagtcatcacatgagtatgtggaagggtgcaagaaatgaggagtggaggcaggagggagggaagcaaaggtacatgacaaattcttagtggaatttggagaaaagttatggatcctggaaaaagttcaaggaatttgtcttccctgatagtttcattaagctctggccattacaatggttctcaacctggactgcaccttagaattttggggaaagctttataaatatatcattgtctgagccccaaccccagacagtctaattgacttggtctatacctgtgctgtccaatacagtagccactatccacctgtggtaatttaaatttgaatcaattaacattaaatacaattaccaattcaatattcagtttctctggccatatctcaagtgctcattagccacgggtggctagtagccaccttagcaattagtactgttaacaaaaatgtccattgttatagaaaagtctattggaccatgctgttcttggggagagggacatggtcataaaaatttttgaaaactacagcaagtaattataatgtgcaatgaacttagagaactgttggtccttggagaatacatttgttctaaaatgtatcaccacttgtatctgaggtcattttgctttggaagatgattctgaaaatatcattaatgctagactttttctgcagcctagaaatgtagccgcatatatttttatttaaagcagcttgcttgctcatttactctacaagatttagatgagttaactaccagactgcaactaaaaatgaataacttgcttttccccacttagaatgaagtggtacaacaattcatgtagattttgaattacttattaaaagagtttaataggataaattatcttacagtaaaaccgagaggctcattgtccacagctcacattttaggcaacagattagaagcaacgtctatatatttgatgatatccaaaattaatttattaacttaatatgtttatgaagtcgcatgtaattttgaggaaattgttttcctttctcattagagaagaaccccactgagaagagacttttgcaaagtgccaaagtgcaattgatgaaacacaatgtcaccaaatatagcattgaaatgagaaagtggaaaggaattcactttggcattttttattttgcctagtttgtttggcctaagagttttcaagctcctaaatacgatattcttctatccttaaggcttgttttatatcctgctgatttgtaaatatctgacttgggattgggttcttcagtttgaggtgacagtacttcagcatccctgtatcttttaggtaatcttgctctgaaatccattccatgtttaatgagcagtgaatatacccataacagaataaatgacctgccctacaaagagttcacatgacatcttacctagaatgagtgccctcttatctgagtttccttcttatttcaagaaacctgaagcatccaaccttataactcagcgttcctcactacatgagtagaaggagcagctacaaaataagtaccattctctgcagtgtggtagaaccagcgatatacagatttctccataagaatcaagataaaatgcttttctctaggtcaaccctcctgggcacctaaaatgagatgcaaatttcacactctgtactcaaaggtatttctccagctataatcttgggcttaattttctggggatccatatttattggaaaaagagagggactctcataaagaaagaattcctagagtcagcttgttttattgctgcctagactcgcttcttatcagttcattccacaggtagagcctccgtttaccggttacattgtagactcagtttgcttcctctctttatccccttcctatcagttctgcaccactcggcctcattcatctttcctaaaacatctctttcatggtgttacacccctacctaaaactgagagtggctagttctacttgtaaaggatctggcatccaggaggttttctaacatggctgttccttttttctttaaatgaaatacctgtccctctccttattcctggaggtcattgccccatctattggctttcttttctctgtttcatcctggtgccctgcctctgtttctgcatatttctgtgtctcaattccacagggctttgagccctgagctgtcatctatgtatttaccaaaattctcccagttgcagagaggccttccagtctctgttggatgctctgtgtcatacttactttgtttataggtcttccaaggaagtgaataaagaaaaggttgctggcatgctgtgatattgcctaggggttaaaattattgcatttgaaaacagactgcctgggtttgagtgccaactctttacttgccagttgtgtgacttctggcaagctctttacgctttacgctctctttgtttcaactttcttatctgcaaaatagagataattctagtgcctgcctcctagaggatagcgtattcatggagacaataagtactcagtaaattttagttgttctttattgtggttttgactgtttcagattcatggtcttaaatagctttccagttactagatttgctttgatggtagagtttagatctgaaggatccaaaacattctctccgtgcaaataggtcacagtagcatcagaaggacgctagcaattagaccaaggtcagggtgctaggaatggggaaaggacggacagctacagttaaggaagcaaatggcagcaatgagagaatatacattggcttatcacctagcccctggaagttctgagcaatacaaagatagagtctgatggttaaactgatggtaccacattttcactgagcactgtaaggcagcagatgaactaaaatgtctctcacaatttgcatttttatatatagtcttaaaaaatattaagaccttacatgcgaactctatgctacactcaaaaaaggttaccaggaccaatggaaggtttatcagtaatgaatataatctaaatgaaatttcactgtgccattttatgagtcagtcatgattttgaaagataaaagcattacctatttctaaccattggctatatattattcaaaatctgaaggatgtcattagaaatatatttgtcttcttttatattaaagactttctacatgctcagcaaaacaatatataaagagcaatttttactttaccatccagttgatcaactactctgtttccaagtgagaatgtaggaagggacgaaatgagtcatgatgtcgttcagtggggagaagtataggaggagtttcaagcgcaagggctccagatcaggctgcttagatttattatctgtgttcatatgggaagttcaggaaagtgaggtcagctgctatatcagatacatccccaaatttcacaacataagtctatttgtcattcatactgttagattggccacaattggtgggacagctgtgctccaagcaatgattctgaacctgggctgcttcttcctttcattcagctggaggtagggtgggctggatttaggttgagacattggggcaactaaacctttcacgctggctatattgcctctccacgtggtctcttcaacatagtggctacacctatgtcatgggggctcaagggtcctatgaatgcaaaagcagaagtttccatgccttcttatgtctcaggtccagaatgggcttggcatccccttctgccacattcagttggttaaagtaactcatagagccaggcgggcttgaagggcaggggactacactaggcaaagaacactgaaaaatgtggtccactcctgggactaccacacatggctatgcaggttgcctggatgctgtctccaggtttttatggactggggctagaaatgaagcttgtcacttcctctgacattccattagctagactccagtcatatgaccactattaactgcaagagaggctgggaaatgtagactagctgaatgcccacgaaaaaggggctacgggcttcatgagcagtcagtgttttcctcactgtgcgccatccatttctgtgcctccatcacttcctctataaaatgaaattgttggaggcagtgaatacatggcacacatgaagtgcttagcacctaatacatgctcagtaaacttctactgttatcattcactattatgtagtggctatttgattttattccatctaagtaaaagcacaccgcactggataccaggctaaggaatttggactttgtcctggagctaaggaggagacatcaaagggttttaggcaaaagagtactgtaatcagaaatgtattcactcaaaaagtttgacagtgattctatgatatttttgccttaaatgtgcaaaatatcaccagtgatataaacagaaataatccagaataagagccaagaagaaggtggaatgaatgcttaatggcatagattcttaggctataaattgtttcttggtatgcttagatatggagggttaaatgggaaaaaaatgaccattgtgctctcagcactttttgtgattagcgaaactcttccacagatggaaccttttagttgcttcctgatatttatttccaaggctctttcagtgactctttggtctcttattggttttacttaaagagttgttatttaaatcttaaaaaggattccttatctttatgttttgtttttctggtttgaatgcattttccaaagaataccaaatatacacaccttctccattatttctgcacttcctcttaaggcctgccttgcttccactcttaaaacagactaggaatttcacaagatgttgtctctcgggattatttgagattattcacttagtcaccttcttacgaaacatttattgacctgacagtgtatgtctccatcaaataattgatttaacagaccactctagtgttaggtaaacattcttatttcatcactgtctcttccttattagatacttataacatggctcctactagtactgactctgaactgtggttttgtcttccagttaatttgtaagctcatagtggttgggatgacagccgcattacttatgagctgtgaatctttgagcaagtcacttaactcctctgcgcttctgtttcctcatctgtaatatgaggataataatgtaacctactgctaagaattattttgatggttagataagtcagtgcccataaaatgcctaaaacaatgcctgacacttagtaagtgctcagtcagaactacatgttgctgtcatctatttataaactaaaggatcatttgcctaataataaaaaatgaattacatatttatcaatttcatgtgaaataatatattaagatattagatatattgatattaagatattagatatctttaaatgaggatgtaacttccattgatgagtatccagtatgagccatgttgactgtctactggaataatgcgtattttcaacatcagtttttaggatagtggtggtggaggtatgtgcagtaacaggtagattttactctgaatctctgtttaagtttaatcattctagtaaagaaaaccacctggaatattttactgctttaaaattccttccttagcagcagcagcagcagaggctatgtgtggcttacatgattagtttcacagaatcctagtaaaagcataccgagtccttaattttgaatcagtaagatcttccatgaaatcatttcccggtttgtaaattataatcacagtgattcttttgttggaattcacttgagacccatgagagaactataacttcctattgactgggaaacaaagatgtcttttcgagttgtatttggttcagtgccatgtggaatgcatggagatcaaggtaattcgcgattggaattaatcttcccttttctctctgctcttcatggatgccacccccaacccccaccccaacctgaaccctcttagatatggccatgtgggtatattcactctgacctccacaccctctgttcaggaaatgaacaacttctcaaggactgctgtcccacaaagaggataaaatacagagcatgtgttatgcttcagtgtgaaagagaatgaaaacttttgctttttagtgtgtgtggctagtgttagaaaaatggagtcagtagttttaaaatataatttaagaactgagaatttgtcctaaacaaagaaggcatcctatgtgctttatcttgctctcaggggtttcaccagtggcttccaacattctttggttgattcctaataaggacagtttgcacagttacaatccaattaccgtttgtagatccctgtggaaaagaggattttttttagaggaatccttttctaactcgagtatatttcttcaaaatactctcattctttttgtcccttccctcccctctttcctcctccccaactctctctctctctcaccctctctctctctctctctctctcacacacacacacacacacacacacacacacacacacacaggcacacacgcatacaaacacacgcactcactcatttgtgcacttactcagggacacagcctgcctctgttctgaaaggacaggaacttctcaatgatccgatgaaaagattgcatatttttggtcccaagattcacagtagcggaggtctctggcaacaaaaggtatcgtgggagtcacagctatgccagctgggccatttctcagacattcaatatgatctgccatttcaggatgcattttttaccaaaaaaataatttttttaaaacagactcaacttcctactgcaagcttagttcagttagattagagaggacagcaaagacgcggctgattataatttatgggtaagcaatataaatatctatacttacactactttttcagaaaataattgtgataaagttttgtgattctttcacatccatcttgtgatttaggaagaaaactggaatgatcagtgtctgagatgtgtgacagctaaaaactgtctgtgtcaatatggatttatgagaaccttatttttagattaatgatgtggcagcttgaaatgagcaaactcaagcaggaaaggattgtgtcatgattaacagaacagcataattgagctaatttctgtaaaagattcgggcacaggctgttttgaagtctgaaagggtaaagtggtttatctttccctcttaacttcttgaatatgggtgcaacattttagttgctgtggctgtgataaatatgggtttaggggaacagtttggatattaaataaggctaataatacatcggatgtgcttgtgctgtcttttacaaaagaggaaactttaagcctctgaatttttaaacactgtctggctttcattattataagggtatgtctcataatgaaagggcttggtggtggaaagaggggaacatgaccctgatgtcccagatcccattatgccactgcagctgctttgctcatttgtaaagttagaggtttggattggtttatcatgaaatgttatgaaatacatatagtggttatgagtctaaattctagaacctaaagcctggcttcaaatcctaactctgccacttaattggtgtgtgctcttggcaagttacttaagttctgtgcctcagtttcttcatctgaaatatgggaataatgatggtaacatagtccttaggttgttgtaagaattaaatgagataatataaataaaaggcttagaacagtaactagcagagagcggaccatctataaatgtgagcagtatcttcaaggtctaatctatctccggaggtcgttctaatttcagtgaactaaatttaattagagaaagacaagtagaaccatcagctgctggccctgtcattaagaaatttctaattcatgccagtgtttccagtttttgcaaccctgagatttgtgcaggccatcttaccttcttcctcccatccaagactcgagagaagcttagaactgagaattaaattgatggccattagaaaagtccacaattcaactgggactacacagaaatgaaattgaccttttgctctgacgtttttgcccttgaggacttccagtatgtcccctctatgctaaccactggaaaggttctttccactggaaacaagatgtaagtgacatttgattttttagatggtgttagcccagccctgggtttgacaatgttcatttctacttctttagtttatcggtaacccaggtgaacaggccatttgcagataaccacttctatttcatgctagcatttgcatattttctaatatgctaaattatgttgtttgatttttttttttacaggctctctgggatgtttctcagagacaaaatcttaggagaggaggaaaatggtgatggcaaaaggcagatcctaatcatagatgtgtctttacttttagtccagtccaggggtcagcaaactttttccataaagggccagatggttacctttacggaagggcagcttcatggactgtgcagtctctgttgcaacaactcaactctgcaattgtggcctgtaggctgccacagaaaataacaatgaatgagtgtggctgtggttttcataaatcaataaaacttgatttatgaaaacaatcagtaggcagtacttggctccccggctagtcagcttgtatcagcaaaatccctgtcatcatccccatttcatagatgaggaaaatggggcatggggaatgtaagtagcttgctaaaaagccacatggctggctagtaagtggcaaaactgggactcaaactcaggcagcccagcttgccaccccttgcttttagccaccaggctatgctatacctatgtcaaccagtctctgcctgggctgctgggctcccaaaacctgcctggctcattccctcacctccttaagggttggtgcaaaaatcatgttctctgtaaggctgtcctggtagctcatgcagcactcctattcccctcaccctgtgctacctccttctctatctcttatcaccttgtaaaacttgctgtgtaattcagcacacatttcttaagagtttttggtgtctctaatacttccaagttaagatgctgtgttaggtccttcttgtatcaccataaaaatacctgagactgcgtaatttataaagaaaggaaaagaggtttaattggttcacagttctgcaggctatacaggaagcatggtggtgtcatctgctcagcttctagtaatgcccttgggtaacttgtactcaggatggaaggcaacagggaaccagcctgtcacatggtaagagcagaagcaagagagagagggaagaagtgccatgcccttttaaaaaaccatatctcacatgaactcagagcaagaattcactattgcaaggacagcaccaagatattcatgagggatccaccctcatgacacaaacacctcccaccaggccccacctccaacattagtgattgtatttcaacatgagatttggaggggacaaacatccaaaccacatcagatggtgatgcaaatttagagtggtgatgattaatattaattataacttaaatttccatttattcaggtcttgtgggagcttataagccttccacaagaaattcatttgtattgtctgatattatccctacaaactgagagttaagtcttgttcttttctccatcttaataatgagaaaaccgatgatcagagattttctgaatcttaccaaagaactgccatctatctgaatccaagtcttcaccaccatgccagtgagactcaacttttattatgcaaaaagtaagactcatctggggatgctgctttataatggaggtgcttgggacctattccctgtgactctaattctctaaatctaccttagagccaaaggaacctacgtgtttaacaatgatcattctgcccacgtgattccgatgccttgggtccacaaaccacattttgaacagccctgcctcaccccttgtttggccctggggagtttacagttggatgagattaaagagatgctgcagttagagactagccccaaggatgtaataaaacaatgtggtgtagaacaaaaccaaaattatttcaatcaattttatttcatgggaaaatcaagtctgtaaaggtgcaacttagctcaaaagaatgactttctgaataaagcatagatattagattgtttgggttttagtttgtcttttgcttctttttttctaaacatagagacatatacttctggtgggaaggaaatctctttagttaacacttttggtgagttgttctccagttaatcaagactctattgttttcaaactttttttggtttgcttcttttaattaggtttgtagtgtttgtacttattaatactagcttaaaataagccctatgattctgtttatgtgtataatacgtagaaaaatacatgtaaaatacacatagtaatgcatgatatataaacgaatatatagtacatatttttatgataaacaaaatatataaataattgttaatatttccagcaccatcattttaaggagattatatgtaatctgggcttaacagcagacttatttatgctaaaccaaggtttctcaacttctgcactgtagacaagttgatccagatagttgttgattttgggcagtagtcctgtgcattataaggtgcttagcagcatccctagcctctatcttctagctgccagtatcaaacgctgccccagttataacaaccaaaaatgtcttcagacattgctaaatgctcactgggggcaacattaccccaccaaggaccattatcctatatcattttatcatattgctgccctttattaatgctgtcacatagtaccctagaatagaaagatgtttttacaactgccaaggtctttagtctatccagagacattggatgaatttcaatttcatctacatttataaaatctaaacaaatttgaaatcatccattttcaatccttaaaaaaattccatgatgatcactcaaaagactagattcagaaagccttcaaatgagtcattcatttataagataaacagtcaccaaagaaaaatgctggtctggaccatgcatgtgagccttgagaaaccaccagaaacatattctagactgtgctggtaggctttggtgcccttcctgggtgcttgtttatcactttatggtccatgccatgagagtcaaagggagactatgacctttgtgttcatgtcttactgctcctatgaagtctgatgggtgggtataggtatcacggattaactcttccccgcgtcacctattatcacatttattttctcccctcatgtactggcatgggtttttcttggcttatcaacaggctatttcaaaagactgtctcttaatggtttattcgaatccagaatacagtttcccacatatatacaacattgtatgggttggttaggtttccaatttatttaactcatgatggggctggttcattagtccctagattgacaaatatttattcagtggctgttaagtgccaggtactgccttagataccgagaacatcaaaatgaataagccagacaagggtcttgccctcctgaatctagctgttgtatatggctgataatgcaaggccctaggactgggttgctggaatatggctgtagatgctacacaaatatgtgtagggcactacatgaccctaatctccatatcaggggttggcaaacaacagccagtgggccaaaagcagcctgatgcccgtttttgtatgacttgcaagctaagaattatgtttacatttctaaatagttgaaaaaaatttgaaggaaggatattttgtacacataaaattatatgagccttgacttttcatgtcatagataaaatttttggaatatttgtttatgtagggtctatggctgtttttgccctacaatggcaaaagttgagtaactgtggcagagaccataagacccacagagcgtaaagtatttactatatgtaattttctataattctattttatgggaaaagtgatttcagaattccagtcttgggacctctccagcacaaatcattggtgatggtacctgtagtatgaagcagcaccttagcatcaggtagcagggagataagaatctgatggaaggtcaaaacctacttttttaagtgtctgcgagcatgcccttcaccccaccaacttccttttctaatgctcccccttactcttgaattcatttcctattgctgccataacaaattatcacaaacttacaacacaaacttacataagtctcatgtgggcctcactgggctaaaatcaaaggccatgttccttctggaggctccaggagagaatccttggcttttcctgcactagaagctgtgtgcatttcttgtcttgtggctcctttttccatctgtaaagctagcagccaagctctttcaaatctttctctctcccacctctgcttccattatcacatttttgtctcgcttctgcctctacctctctccttgtgatgacattgcactcgcctggataattcagaataatctccccatctcaataatctgaaattaatagcatctgcaaagtcccttttaccatgtaaaataacatactcacaggttcctgggattcgggtatggacatctttaggggagacattattctaccaaccacaccttccacctgattacgccttactgtacttctctctacctccacagaacaaaatgtgggcagaggggcaactcacaagcttgcaacaaccagccagaatattgtagtggctaagagtggcttctgagagtgtcaggttcaagttaatttttttgttgagtgaaaaaataaggattatgtcatcacttcatttgtttaataaaagaaagcagggtcatgcttactctcagtttcagaaagtaacgtccttactattatgactgtcatagaaatagctttctttcccttggtagatttgtatctttctttgacaatggaggacttcttggattttctagacttactacatagcacttattatagcctaactgaacaatgtggatgcacactcaaactagaatctattcaagccttgagctcagtggttctcaaccctggctgcatgggagaatcattagggaacttcaggaaaaaaaatggacaaagaaaatgtggtacatatacacaatggagtattattcagccataaaaaagaatgagatcctgtcatttgcaacaacatggatgaaactggagattgtcatgctaagtgaagtaagccaggcacagaaagacaaacatcgcatgttcttacctatttgtgggttctaaaaatcaaagcaattgaactcatggatagagagtagaaggacggttaccacaggcttggaagggcagtgtgggggatcaggggaggtggggatagttaatggctacaaaaaataattagaattaatgaataagacctaccatttgatagcacaacagggtgactatagtcaacaataacttaactgtacatttttaaaataacttaaagagtggaattggatggtttgtaattcaaaggataaatgcttgaggggacagataccccattctccatgatgattattatgcattgcctgcctgtatcaaaacatctcatgtaccccataaatatataaacctactatgaacccacagaaatttaaaaagtaaaaataaggaaacaaaaaatacagatattgtcttggtcactgggtctgccataacaaaataacctcagatctctcttttggttaacaattccaaatataacaaagaagtttaaaaatccaagaagttaagaaccgtgggctgcaatatataatggactaaagtaaacttgaagcatcgcactttactttttattatgctaactgtagtcatttgtaaacagtttgaaaaaacatatattatttgattgtgttggaactgttttaattgagagtacaaaatcaaagctcaagaaaaatataaattggccaggttctgttttgccagacttagtaatgttttaattctgttttttcaaaagaaaataccattttcaccatgtccaaaactgggtgatcttccttctccccctgcaaacataattccctctgccattccccatcttggtgattagtgttactgtctgcccagttgctgaagctagaaactcaagagtcatcctagattaccccttctcttcccctcactgcatccagtttattctctagcatctatgtggttctaagtttctcccgtgtctgttcaaattggaatcagcatcccacttagcacggagtcttttctcatctccacatctttgacttgctctcccctttaattccttaggaaacttgtttccagtcatcttccctatatttcaaatctgctcatgttcctctctagctcaaagttcctgaatgactagccatcgtctatggaggaaaatctaatctggtttgcattgccaacagagacagccctacagaatctggccctgacttctgcttggcttcacctcttgcccttttcctccttccagccttgtaattccctgaacaagcctgttttctcaaactcatttgcctttgcacctgctgctaaagttgcattgctactgggcgaaccctgccccctcttactcaactttcaagcctccattgaaacactaccttctctataaagctttccttgatcctccagatagataacaaagccttgtctcctaggcattcattgcatttagtacttacttctagtaccacaatctctgtgttttatggattgtttgtgttcttcctacctgaaggttaactctgaggacgaggactgtgttgtcatcttaatagtcccaagcctaccacagagcttagcatctcatctgtgcttattaaatattgtttgaattaattaaccaggaggacttagtaaataagaacaaaatgtcccttctaggaattactttatttcagtcataagctatagttcacaggttgggaaactctagcccgccagccaaaaccagcctgctgtttttgtaaataaagttttattggcatatggccacactcgctgatttataaattatctgtggctgctttcatcccaccaagccagagttgagtagttgtaacagagatcacatggctcacaaagcctgatatattttctatgtggtctttacagaaaaagattgtcaaacccctactacagataattaagcccattggaggtcacatctttgattgcttttaaagaataggtatgtaattctgttttgacacttcaaataacagtcagctcccgtaggtacctaagcttgatatctaaaatttataaactcatctggggactttctatctgggagaaaataataataaaaaaaattccccaatagtgttccttgtagttctctaagcttagagggtgtgagtgaggggtacacccaaggcctgagtccccaaccataatgtctatatgtcctattttttcttagtctggttataccaaaaacataaaagaaagaaaaaattcaaaatacactggccccagaagaattttcttctgttcactgaatgtgactgcagcctcctcactttgactagatttgctcactcactcctctccccacatcccctcctgcatcaccctccctgagctcctcctgggttcctgctagtcttcatcattatccactggatataattcatacatgtcaaggcaaagaaactaaaagccataacttctttaacacttgctcaaattttgccttctcagtgaggtctttcctggctgctgtctctaaaactgcaaattcctttcttctacttccccttctttgcctttttctccttcctagcagttatcattatttcacacaccattccttttacttaccccgttcattttctgcccctaccagagtataatatattcatgtattaaatgagtgaatgaaatcccagataaagagggaaaatatcaaagaattaacatcatgccattcacttttggaatgaatacactagacaggaatttgtcaccagtgtgaaacaaagtgctatggcactttgttgctgggaccagtctttctgtctcccttctttaaggtgagtgacttcttttttatgtttttaagacagagttttgctcttgttgcccaggctggaatgcagtggtgtgatcttggctcactgcaacctccccctcccaggttcaagcgattctcctgcctcggcctcccaagtagctgggactacaggcatgcgccaccatgcctggctaattttgtatttttagtagagacgggcttttgccatgttggccaggctggtcttgaactcctgacctcaggtgatccacccacctcagcctcccaaagtgctgggattacaggtgtgagccaccacgtccaggcgagtgacttctttaagatggtgaagtcttatgggattctgttaagtgttccatttattgcaatgagtccctgcgtgggccagtacctctccttccctgatagaacttttctttcttgatcattgagcaacagtagctgcctcctcaaatctgttgcagcatgcctgatacatgagattcacaagaagtctttagtaaggagacactgggtttcagaggattgtaaagtactttttctttggacgtcactttcttactgtctgcattgagggtggagccatttaccctcagtggcctgcaagggtgtgcatgtgtacacatgagtacacttttaggattgtggaaatctttgctttgactctttgatgtggagtattttagcatcaaatgtctctataaatactgaacatcttcctgttgatcataactctaagcttattgtgttcacaataactcatgagagtgctacaaatagaacctcagtggttacaatattagcatagagtttaaagccctacattcttagcttgagtccttattccaaatcttataagttttatgatttggggagaattacttaacctcctcaagactcagtttcatcatctatattatattggtatatgttactatactattcatataatatgtcataagtataaactttactattataatatattctcatatattatactagattatattattaaattttacatgagataggtaaaaaatgttaaccacttcataaggttgttggagggattaactaaaaagcccttgactatggttaacagtaatatatgatctcaaatagctagaaggaggatattgaatgttagcaaccaaagaaataataagtgtttgagattagttactaattattagaaatatatatctaataaccatatgtatagaaatatcaccatgtgccccatgaatatgtacgatttttatttgccaattttaaaaaatgcccttggtgcagccgctggcacatggtaggctctccatacacactcatccccctatatctgatgtgtgtgatggcaattagcagcagcacagtgtttcacaaaagttagaagttcccatgtgttcccataaaaaggaggaagtaggaccctcacagtatctttctacatagtttcctcaggcctatatgcataatgagataagatcatgtgacccagcagatacttgagattttgacatttgcaactaactgagaaaatccacagtgaactaaaagaggatttgactttgggaattgagacccaattttggaacacaaaggtggtttgcttgactttattactaagagaggatgagatttgtgagaggtaagtgaactctgtaactcttgattttttttttttttttttttttggcctacagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaaggtaaggcctcttctgcctttctgccggggaacactgcaagtcaaatattggctctgccaaagccgtgagctgtgaactcttctcacacctaatattcacacaggaaggaaactacagcttcttggttgttggctggcattagtgtccatttgaaggacatgttcaagagggacaatttgcatgtcaggtaatacatttatttaaagggaaggtcaacttggagcattacaaaggaaagctgtgtgtatatcaacagtctatatggattctgaacaaccaattaaaaataattttcaggaaggtcatcttaaagggtcagaagaaaagctgtgtctatctcagtttggtttcaaaataacccatttgaaaagaatgccttaacactctgttaaacttgtcgtttgaccctatgccaactcagaatcagggattttaccgaacctaactcctttttagccagtttttcagctggtgtgttgtatgttgcactggagccagtgcacacctgattggctgatgtttgttttttaaacagatcctgattccagtaaagatgagacacatgtacttgaattccttgaatccataaaactttgtctctgtatgtttactgttgtctataaaggcactttttttttttttttgagatggagtctcgctctgttgccaggctggagtgcagtggcacaacctcagctcactgcaacctccacctcctgggttcaagtgattctcctacctcagcctcccaagtagctgggattataggtgcacaccaccacgcccagctaatttttgtgtttatagtagagacaaggtttcaccatgttggccaggatagcctcaatcccttgaccttgtgatctgcctgcctcagcctcccaaagtgctgtgctgggattacaggcgtgagccactgcacctggcctataaaggcactttttaatttgtattagtatgtagcagacagctactttgaggcagaatgaaaaactatgatgttatacacataaagtaaatctgccatgaaaagcaacattgggcagggtgcctgaaacttaaaggaaagcagaagagggataggaagcttctagaaactagaacatttccacggaggattttggtatctgcaaaacttctcttctactttgttttcttttggaggaggtcgaggggatgcttcatgaatatttattcataaatagttcatatatatatacacaacatatgtgcatatatatgtatacacatatacacacaaataggtggttctcaagcagggttgattttgctccccatgccctggggacatctggcaatgtctggatatacttttggtttttgcagcttaggggatggatgctcctagcatctagtgggtaaaggctgaggatgctgaccaacaccctataataaataggacagccccctgcaacaaaaattatcaggccccatgtgctgaagttgacctaccttgctgtacacacatacattcacattctgtcacccacagtgccagtggtgcagttctcttggctcagctgtggctaacagaaagaatgctggcttggaggtctaaagactaggacttgtgaactcatcctgtcactcctcacacctgtgagcttgggcgacttgcctctgcggtaggaggctcagttctttgaccagaaagagtagcacaaaaacactgaccagagtttttctttggatagtgagtcttagggccacgttttttcttgaagcagaacctgagactccattggaggttatgacagagttcagaagagagagatagacaaggccaatgggctgacaagacatgcatatttcactggcatatgccttgcacctttggctttcttgtcacggtttgttcactaccacaaccacagcatgttgtttccaagaggaaatccccaccctgttttattttttcatgctaatctcacacatagagaccctcagctcaaataagaagaaaatcacttaggcaattgtgaaaaatgaatactagtgactgtcaggccgtgtcgctcttatccttgagaaacgccctcctgccttacctggtattggtttggttgtagggtggagatgaggcctgttctccctccaacataactcacaaagtggcccatgtggggcccgggccaagagttttgtctccctttaataagcacagacattcttttcattcctaaggaaaaaaaaatggcaatattgttagcaaacttaatttgtagtgaagagaatgatgactttgaaaagtttttgaaacttggtttgaatgcacatcagataagatatcagggaacagatactctctgtggctttgtttttaaatccagttgatttttttctttgttcctgcttgttaaagagtccactaaacaaataacctttaccaaaaacaattttataaaacttgtctactagaggctctgtctccattaattatttctgaggctgtgtggttatccgcacatccagagaaagatttgtgctatcgaaatgtttgaagatattcccaggccacagcagttattttcatattttctgtcaaaataggaactaatgatttacaaataattttctcatttatagaggagagagggaattgtgtggctggtgaaagaaacaggcatcgcatgagggtttctgaagctactgaattgggcatatgaatatagacatcaaatatttactgagatccttggaatgtgtggctggtggcaagctctatgacagtagctttggtctaaatgtggccacttgatccccatgcaaaccttcaaatggaggttctcaacagggtcagattcactgtgtgaataattttcacaggaaaataaatactgtagccaggacctaaagcctaaagaaatgatgccaaacctaataggatataatgaaaatcatgatacaatgaaaatggacacatagtcaagctcacatttctgttctctgtcacattaggatgatcatagggatttatttgtggttatctatttgtagaaccctctcctgtgagtctggtgcttccagggttcaaatgaatgctattataacatgatcatcagctgccagaatttaccatagagaggaaagaattgaggatgggggagttgggaaattactgggtgatttcctagagtagaccacaagggtgggatccagagcacaagtggagggtttgaccttcttttacactataatgatagatgggcattagttatatggacactgatgcaagtgagttagaagatggtgggagggcacgtgggattttactccagattgcgtctcagcgtccaacaaaataggaagcaatttaatccactaggcgtgaggatggcgaagaggtcctggaggtttgaggaaagaggagaggagtggaagagagggcagctaacgggccagcaatgtcacaggattgcaggacaggccaaaaggtccgtttgaggttagtagctgggaattttaaatgaaaaataaacatcctggtatctaaacactgttaagctaaatacaccatatcggacttttaattccccagccttagttaatccaaatatcctcttttgagttaggacttttctagttcaattcaatgaaggtgaagagggacatggcagttgagaatatatctgtagtaggcaaaataatggacccccaatgatggccacatccacatccctggaacttgtgaatataatacctcacaggccaaaaggaactttgcaaacgtgatgagttaaggtccttgagatagggagattatcctggattgtctaggtgggctcaaactaatcacatgggtactttaaagtgcagaaattctcccagctgtaatcagggagatatgtgactatggaagcatggtcagagagatgcaatgttgccggcttcaaagatggagaaaggggccatgagccaaggaatgcagatggcctctacaagctagaaaagtcaaagggacaaattcttcccaaggggcctccagaaaggaacaaagctctgctgacacctcaattttagcccagcgagacccatttcagatttctggcctccagaactgtaagatgataaatttgagttgtttaagacactaagtctcttgtcattagttatagcagcactaggaagctaatacagtatccaaaggaatgattctaatcccacaacacagagtctcaactggataagaaaggaaattaggaagtaattcaataatataaagctgtaaattttgtcattaattatctataagctgaatgtgattccaaaataaagtaccaacagaatttttctttttgatgattttactaaattaatctaaacatcatctgggaaaataattaagtgaaggtagtcaggggaaatctgataaagagataaaatggagattaaccctgtccatttattaaaatgtgtcacaaaactgaagaattaaaaatgaaccaaaatacatatgaaaatttattacgtgataaatacggtatttttgtaaagggaaaaagatgggttattattgtatttgagataatgagacaatcatcattaagaaaataataaattgatatggaagaaagatttaaagattaaaaaatgaaactataaatgatgcaccagcagaaaacataggtagatatatatttttttacactagggaaggcctacccagaaaacataaacaaagagaggaacaagtttcactacattttaaaaaaatagaattatctctgacagataagcaaataactaaactttatagcacatttgacaaactaaaggctaacttctctattgcataaaactttattacaaattaatataaaaagaaaatctaaaatatagacaaattacaggtggctcacagaaaaatacaagtggtataaatagatttgaaaagatgctctccctcacattcattaaagaaatgcaacctaaacaccaaggagattttttttttctctcagagtggcatggctccaaaagttggatgatacacttcgtggggaaacaaacactctcatacactgttggtagaggtgtaaattgttgcaacagggtgcaaggcaatttggcaacatttgtctaaattgtatttatttatttattatttccatggttttttaggaacaggtggtatttggttacacgaataagttctttagtggtgatctgtgagattttggtgcagccatcacccaagcagtatacactgaacacaattcatagttttttatccctcacccctttcccaccctttctccctgagtccctgaagtctattgtgtcattcttatgcctttgcatcctcatagcttagctcccacctattagtgagaacatacaatgtctagttttccattcctgagttacttcacttagaataatagtctccaatcccatccaggtcgctgttaatgccattaattcattccttcttatggctgagtagtattccatcatacttatatatataccacagtttctttatccactcattgagtgatgggcatttgggttggttccacatttttgcagttgcgaattgtgtggctgtaaacatgtgtgtgcaagtatcttttctgtataatgacttcttttcctctgagtaaatgcccagtagcgagattactgggtcaaatggaagttctacttttagttctttaaggactctccaccctgttttctatagcagctgtactagtttacattcccaccagcagtgtagaagtgttccctgttcaccgcatccacaccaacatctattattttttgattttttgattatggccattcttgcaggagtaaggtggtatcacattgtgattttgatttgcatttccctgatcattagtgatgttgagcattttttatatgtttgttgtccatttgtatatctgcttttgagaattttctattcgtgtccttagcccactttttgatgggattgtttgtttttttcttgctaatgtgtttgagtttgttgtagattctgtatattcgtactttgtcaattgtatagattgtgaagattttgtcccactctgtgggttgtctgtttattctgctgacttttccttttggtgtgcaaaagctctttggtttaattaagtcccagctatttatctttctttttattgcatttgcttttgggttcttgcatttttctaaattttaaatggcccaaccattctacttctaagactgtatctcacagatacatacttgtatttgttggggtaggctaaccactcagtgccttaacaccactacaaaagtatatttcttactgaagcactatctaatgcaggttggcaatggggtgagaagggcaaactctcttccaggccgttattcagggacccaggcttcttgcatcttgtggctcctccctcctgtatatccatttagcctggagatgtacacactgaataactaataagataaaatagctgatgagcttaatttgttaccccttctaaacttaacatggttcaaaaagagacttttgaaaatgcttttgagaatctggagacatttttagtggttgaaatcaggaaccaatcattttccctgtgagcccaaaattactccatggaggcaagcatggactatctgattattcaaatggctactcttggcataggctcttggatcagactatctagtttgtaaatggccaactcttagtcacagaaccaggaaacaaatgtaaaaaatagtcaagaaattaagcaaaacctaatggtctacacaaacttttcacttatttaaaacacatccaaagagcactttttgtatatcaagtagtatgttaggtccaattaatattattttggtaacattttaatacaaatggtcaaaatcaggggttagcaactgaaccatggccaaaccaagcttaccatctgtctttgtaaataaagtcttactgaaacacagccatgctcattcatttacaattcgtctatgcctgttttcactcaatgtcagagttgagtagttgtgacattgtctcagaagtttactatctggccctttacaggaaaaatttgctgatgcctgatctaaggtaaaatgaaagaaaataacttattcctgccacaatcactatagcacgttagtgtaggcattatggcttaaccttattatattgtaaaccaatatttacagttgaatggttctataagacagaaatgcatatttgtgttttctttagagctgttttcttcttgtatcagttcatttctgatatcacaattgagaaaggctttgtttatgcattttgaaaacagtatcatggaatgaggaatagctgatggtttaagaaaatatggagaagagtctcataaaagagtaccccaatgcctcaaaattgctcaattatatggcttccttataaaatgatccctcgccattatcccttaggcaatgtcaaatccaagtacacaactcaatgaaataaggaaaattacattcttgctaggccaacactgcagctgtcttcagtttgtgatttaaatgttgatttagaaaataaaagtaacctggtaggcaaggaaattgagattgggtgtttatataacaacccttgacagaaaaatttaactgtcctatttctgttattctttctggcaatgcccagttgaagaggtgatgtgctagaactgtctgccaaagccttttgtgtaagtaaaaataaggttgaaacctggtgcagaatccacaaaatccactgtaggtagaaatgccaatgggaagcaaacaccaccaaatagggatgatcacggaataatgagaccactgtgcccagaggccctcaacaaaggtctctattctgtgaactgtggagctgattgtaccttctgtgtgtccacaatcaccttttctgtgatcttcacacaaaggatggtgacttcccatggagtagggctacgtcttattggtctttgatctggaacatcatctgtactgcctaatacacaagtggccctcagcaaatctttgagatgtgaatggatgcgtgcaggcatattatttaataataagcttttaaattaagctctttctctcactcttccccatatctctaaagagcatcgatcacctttctcccactgtccccagtgtctccagtaatgattttaaaacaacctcaacacttccttactccttcacttcatgctcagtttccagctttcattgatggtctcatagggttgatgtgagatttaaatgaaataataaccataatgagcttaaatcacttcctgacatcttatatactctccataaaacttatccatcaccatcatcatcatcatcattgtcatttttgccatcaccatatcactttgtcctgtatctcccctcaaccctatgtcactgcatcattatgcttgattttaattatagtcatagaacccctacctactttcctcaattcagggcttctcctctattctatctaccacacgtaaaatcaccagagtgaaacttcaaccacagtggctactcctttgttggaaaaacaaaaagcaaacaaaaatcccaaggctccctattgtctactgatcttactatcaaagccattttatatgagatactatctatttcatataaaagaagaaatccatttagtttgcagcctgttctcagaatgcaccacagacttttatttgtttacttgtcttagaacagcaggttgcagattttttgtccacaacctatctgcagtgagaagtacattttacatctcagcccaggaaatgcatgaagccaaacagcttatctttatcagagatacatttggatattctttataatattctctcctatcctcttctatctgattctctttcattttcaaaatatgttttcatgatccactgaattttcttgatttattaataggttataaaccactattcaataacacagtcttggaaggtatatggaatagagaacagggaatcacaaaggaagcaacaaaaatatcagtatggaaaaattagttgatctttgctgtggctctcagggccttgataaggtggacgggaacttctttttccatagggccatggtgatgaacctaaggctagagccatacctgagtatcttatgccttctctctctagagccaaactgagggagtgacacccagagggcttcctacaaggcctcacagctctttcctcataataccaagggttatgcaacctgaaggagatacatatgtggggctttaaggtctagctgcgatagaggattcaacactatgtcaaaaggagttcctatcatcgagtagttcctagtcaatagacagagaaaacacagatgcatcaattatattaaaagatagagcagtggagatgatctgtccaagttgactttggtgaccctttagatagaagctgcctcatccacccactctggtaaaagccaagaatgacaaagacattatcctgcaggttattttgtaattttcttcttggatgctcttcctagcaccccagggtttttaccatgtaaagttctcaagtgtctgctgccactatatgatgctatgttggtgccaagcaggtgtgggattctttaagccatgtgctttgtaccatggtattcacaaattacttcctttatgttctcagacaatatcgttttctatccaaggtcttgtctcaactggtcatatttatacatattcgtatgtcttgttggagcagcaaccactattgcacaagactttggcatcttgaccaaaacttctgtcactgcagtttctgaaatattctggcacctttcaaagatttcaagactgcactatattctcttttgggatcatagcccaaaataaacttgataattatgaagaatatcccatccttcaaacatgaacattttgccttttttcttggtttccccatgggcaaaataaaagcaaatacgtatacgttgaaatttaatgctgagtgtattttttaaccaatcagcctttttaggtcatttggaatcaagccctcaagattacttaaaaattcaactagtgggtgttactagagctttacatatggaaagctctggaagagtagtttaacaggttttcacttaagatagatgtgggcaaactaagctcatgggccatagccagtccattgcctgtttttatatttttattaaaacccagccatgtccatttctttctgtattgcctgtgactgctttagtgctacagtggcagagttgagtagttttgacagagaccttatggcccacaagatcaaaagtatttattctctggatctttacagaaaaaaagcttgccaacccctaatttgaaattaatattatagtaattcattgttattttttatgcagttgttcaactatactattcctgttcatttcaatttcttcattattttaatttcatgatgtagtaattgtgtgctttttaaggatcagacctttgttattcttagatgttttagtgcttatattacagtcatgcattgcttaatgacagattcatactgagaaatgcatcattagatgattttgacagtgtgcaaaacttaatagagtatacttacacaaacctagatggcatagcctactacacacctaggcgatatggtagagcctactgctcctaggctataaacctatacagcatgttcctgtactgaacactgtaggtaattggaatgcaatggtaggtatctatgtatctaaacatagaaaaggcatagtagaaatattgcataaaagataaaaaatagtatagctgtatgaagcacctccattataatcttttcagaccactgtcttatatatggcctgttgaccaaagcattgttatgtggcacatgactgcatatgtgaccaaatattttttcaaggtgagatgagttcctttggtggcattaagcaaaaaataaaagtcaatatttttatgactggtttaaacaactgatgccaccatgcagtctatagacacatgagttatgcattaaatgggtaactttaataagtcaatcttcattacaagttattactttcactattactatcttgtttgatgactgagaagttagcaatattcccttctcatgtcctagaattgcaacacctgccagtgcccaaatcaatactgggaagtagaaataaatcactgggattggcttgaactaagggttcatttcccgagtttggggtgataactcatcccaggatgagttgcatggaggatgagcaactgacaaaatggagcaaggaagaattgcagtgagtaggtggaggggagcaggatagagatggatttagattaaaaactactggtatacggaagaacattgtcatcttctgccattgcagacaagtgatagagaggaaaccattcttattttatttgctttagcgtctagcacagtgccttatacatacctacagcacaataaatatttgaaaaattaaatgagatacattaaaaattcaatcatagcacatttatgtatatagtgtttccatagcatatggaattgttttgaatggctcaaaggataatcaaaaacatggaatggataagaaaaggataggtagtataatagtttcatttaattgcatcatcttttcaggtactgaatcagagagagctgttttcatgggagcaactggcaggaaattctaggcatttccaagactttaacaagtaatgataagactcccaaaatttgggttttaattttcttgagttaaccacctagaatatttattagggaaaaatgatttttgtatttttgttctcctgcctacttcctttcatttacactccaggaatgaaatgtagcttaaaaaaatgacttggcaaaagccattttccctgccccgatatttggaaactcctgtctctacaaatacagtgcctacctagactaaactaaaagtattgtcctccatttaaggactgttcaatgaaagatacaaattcaggagcctggaaggacatactagctcctagatcatgaaaagtcagcagcagagctgcccctttgagacatgtgctgaaagctttgaaaaaaaaatcttctttaaaaaaaatcatataacttgactgtggaaaaatgaaagcaagtaaaagatccttctagggcataatttgatcattagcagttcttacagcaagcagtgattacaaagaacacctagttaaggaaaaaccatagttgagcctttaaagctatggcatctaaaccatgagatcagcttccctacctcatgttttgacggaacaaggagacgtgttcaacaaatcaaatatcttaatgatttttctgtaatagaaaaccacttgctttgaggttcgaggatccagaagttttttttctcctcttgaagatgatatagaaaaattttagaactaatcaccctgccagaataatttacacaaaacagaataggtttcttcttagtgtttaactgaaggcatggtgacctccaagagtcgactttctctacagcagtgagagactcacagaatgttcttattttctgaccacacctttgataatttcaccaccacttcaacatgtaaactgtggggattagtacatttcacaagtactttggggagcctcagccctaaggagaggcatcgctattgcttaagaataccataaaacattttcttctccagggaaacatagacactttggaaagagattttggaaatcctagcccacaaagtgctagcaggaaaaagaaagtgtttaattcactgggacttataccaacaaaagtgaaccaatcaccctgttcctatctgcctttgtctatttcaattaaagttagtggaagaactgttaagtataagttaataagcaaaaactttgataacatgagtttggttaaataaccaacaatctagggtatgaaagatttcttgaagatgacacacgcgcacacacacacacacacacacacacacacacacacacacacacgtatccagcattgcctgaatgatgggaccagtttgggcttgaatacgttttccattattttccatatagattgttttcttccacaattattattttcccctctcttgaaccctggttcccacttaagaaactagcaatccactcctgaatttgcaattttctcatctttttcaccaatagaatgcttagttggtaaagggttggattataaggaatcaaacattaaaagggatagggtaatcagaaaggaaggatgtcctaaactaagctggtggaaacccccaccaaaattcaaagaccccagagagggataacttcatcccttaaggttgaactcaaacattagcctttgcaagcagaactggaagcagtcttctctcttttgtcctggcacctagtaaatgtcttctcctcactgaagcatttcttcatattgcttttttttttttttttgtcgcccaggctggagtgcagtgacactactctgtcgctccggctggagtgcagtgacacgatcatagctcactgcagcctcaacctcccaaggctcaggcgatccccctgcctcagccccccaccccaccccaccccacccagtagctgggactacaggcacgtgccaccatgcccagctaatttttgtatttttagtacagacaggatttcagcacgttgcccaggatggtctcaaacttcttagctcaagggatccacctgcctcggtgtcccaaagtgctgggattacagatacgagccaccatgcccggcctcattttgctttaattaggtttccacatgtctatctctagcactgaattttgaatttttcaaaggcagagatagcattcattcatctgggttcatagcacctagctcagaatctcacctattgatcaatcaaagggtggatgggtggatggatagatcagtgtatggaagatgacatttaaacagataactattatattgtaaataatattcccaagccaagaatagtcatcatgttctatggtacaacatccctgggcagagaatacttgcttaagaatagggaagagatccctgttttggctcccttcctaaatctctgggattcatcccaggttaactcttaaaccagagcattgcattggtcccactgttttccctttcctggtcccactggtttcgctttcctagattactattcctcttttctatcagagctgctatccattccatttcttgggatagactttgaatatgaagcaggcaactcaaagtagaaggagcaattttgaattcattccactcggggtggcaatggcagtaagtggatcctttgtccagcctgacttgtcctcaggtaacacctgttttcctatgtaaacttactgggccaatttaacttatgttgctgggattaatcattagaaagcaccaaacatggagtacaggcacaatgaatggctcccaagtgccaggggtcattaataatattgttacttctttaacaaacctcctgttccaaactggaaataaaatatctggttcagtctttctcttgccttattttttgggaggtctgtggcttgaaagccacaaagaaaagccctcaaagtgagaaataatgagatgaaataatgaattttagttttaataaaggacaaaatatggtattactaaacctttttacaggatatccacagatcatataactcaattcacatttatatgtacatatatatgtaaagagatgttatattttattttaaaaacaatattttggtttacagaataggcattggagcttaaaaatagatttctgtactaatcaaataatcggtgttcatgaatgcaaatgaaaaatactgtctggataacttaagcagaaaaaggatttagagaacctaagatttagaatcttacaacaacctaataagccacctatgaaaaaatcaccagccccataaaaacaaatctggtccatcttgttagctgtccactccctttccagcaaacaggctccaccagaatggcaaacataatagatgtttcatgtcagcttaggcacatgttttctttcagatcaaggagatgcaaataggagattatttcactagtttcagcctggcttgtgagtcacctcccttcttgtcactaaactgagctttcagttctgtggagcacttcagtgagcaatacaggcctccattttctcacatgcttgataagtgagtttccaacctttgcttgaatacatctggtgcctgggagaaaggacttatttttttttaattttggaataattttagaattacagagagttatgaagatagtatagagttcccttatgccccttacccagtttgccctgttaacataataacataacctcaatgctattatggtaacattaataccataaatgtattaccttggtacatttatcacagctaagaaaccaacattggtgcattgctatcaacaaaactatagacttcactcagatttcaccagtttccacactaatgttatttgtctcttccagaatcctattcaggataccacattgcatttaactgggcatcttttcttatctttttatttttatttttcaaataacaaacatttatcttgtaaaacagcttctgtgaatagcttagcttgggtgttctggttcaggggctcctgtgaagttgcagccaagcaaagatggggctgcagtcatcttagggcttgattggggctggaggagcagttcccaggctcactagtatagctttcagctggagacttaccccttagctttttgcatagggctgctcctgacctggtttctcacaaagtggaggggtgcaagacagaatacaaccaaatggaagccacaatgaatgatgctttgttttgaggcagctcattccactggttccatttgctggctagactgtcttcctatgatatcttcctgaattttcattctggcccatggagggctggccagtaagtctcttcatccaccatgtttagtcctctaaataaaaggaaagaaccacaatgtctcctgagtcttctctaaatgctaaacatccattcatacaactgttgactatcagagggtgttccatacctgatcctgccccacccaaggagaaaaaaacagttcatataaagaaatacaaggctatttcctcaagaaacttggcttattcccccatctgtagtcctagaaatttggtagaaagataattatatgcagactcccatttcttcgtaaattaaagaaaattgctattgtgtcccaaagtcagtgtgatacataaaggcttcataatttgtaaacacttttacattgttctgtttaaaacagaaactgagataaagtataacttgagcattgtgacaagtgggaaaatgtgaatgttttgttcacatttacatgatttgggttcatagctgctctctaagttgagttatacatagaccagtggttctcaactggagtaagtttagtccctggaggacatttggtgatgtccagagacatcgtgtgtggtcacaacagtggtggggtgctctggcatctagtagataaaggccagggaatgctgctaaacatcctacgaagcacaggactattctccactgaaaagttatctggccccaaatatcgctagtgcctaggctgagaaatcctggcacagattatatgcagtttctaaagggccacttccctactctgccacccaagtgtatctttttaaatcattttcccctcactttttcattgagctctcctcattgcctatgaatttcattggtttgctttctccgagagtcaattttattggtccaaatacatagtaaggcagctgtggctaatgaaacaggagatggtgccaaaaagcattccttcagtcttttctcagcaggatttttttcaaagctttgaataagctaggaccttccttttaggctagggtaggttcacaaactctgaggcataccaggtaatgtaagtgggtacagtggcccagggttgggtgcctatgctgccttggggcacatgtgaggaatgtgggacccagtgttgccagctcttccactttcctcaagaggctggaactctagatatgtatgtgaactttccaagattttgcattaggacttaactttttataaaactttgtgtgggctaaaaaccacctgaatagtaggggactggatatggccattttgcacccatgaggctggaaatttgcctgtgtgtgtagcagcaccagaggaggtctttgtccccagcagacatttagattcttttccaccctcatgtcatatttcagtgcaggtgatttcctttcctttccagtaatgtaatctttattgagctctgcaagtgaagaaatttaaaagggcttaaacattgatgccatatcccacattcaggtgcacctgtgaattgaggctgtttacactcattccccatgattgcctggatgagaaatgagccttagcgcttcttgcccatcatccagacttctgggagggcagagtctaaatgcattgcacaaatggatgtccgctgttttacaaacacctcctggataggagagccctgaaccatctctcatgttgcaaaggcaaagtgaccttaaagaaggacttccagcttctcctcataggcatctgggttctgctcttagccacacctctcaagacagaactgcgcttattggaaagaacttgaatttggcattgaatgtcagccctgccacctaccagttctgtgattttgagagaatttgcgttaattctctgattttcagttctctcaattgtaaaatgaataaatcaaaatgctatcccaatggatcgtgtgttgacacgtattaggtatatgatataaatatttcatatcattaaaaaaaagtacttcttccagtgccagtgcatatttagagcttggaaattgttagtttttcattcccctccctctctaactctatgttaccttgggcatgccagttcatgtatctggctcttactgtcacatccctgaaataggcaccacatttcctccactacagcgtaaggtagaggttagagcatgatatggtttggctgtgtccttacccaaatctcatcttgaattgtagttatgggaatataatacccatgtgtggtgggagggacccagtgggaggtaattgaatcatggggactgttacccccatgctgttctcgtaatagtgagttcgcacacgagctgatggttttataaggggcatcccccacttcgctctgcaattctccttgctgctgccatgtgaagaatgacatgtttgcttccccttccacaatgattgtaagtttcctgaggcctccccagccctgcgaaactgagtcaattaaacctctttcatttataaattacccagtctcagttatgtccttatagcagggtgagaatgcactaatacaataaattgataccagtagagttgggtgctgctataaggatacccgaaaatgcggaagcaactttggaactgagtaataggcaaaggttggagccatttggagggctcagaagaagacaggaaaatctgggaaagtttggaacttcctagagacagagggctcagaaactttgaaacttagaaagtttgaaagtttgaaacttcctagagacttgttgaatggctttgaccaaaatgctgataatgatatggacagtgaagttaggctgaggtggtcttagatggagatgaggaatttgttgggaactgaaataaagttgactcttgctgtgctttagcaaacagactggtagcattttgcccctgccctagagatctgtgggactttgaacttgagaaagatgatttagggtatctggtggaagaaacttctaagcagcaaaaccttcaagaggaagcaaagcataagagtttcgaaaatttgcagcctgatgatgcaatagaaaagaaaaacccattttctggggagaaattcaagctggctgcagaaatttgcataagtaacaaggagccaaatgctaaccaccaagacaatggggaaaatgtctccagggcatgtcagagacctgcacggcagcccctcccatcacaggcccaaaggcctaggagggaaaaatggtttcctgggcctggcccagggccccccggctctatgcagccttaggacatggtgccctgagttccagctgcttcagctccagctgtggctacaaggggccaaggtatagctcaggctgttgcttggtgcaagccccaagccttggcagcttacatgtggtgttggtcccgtgggtacacagaagtcaagaattgcagtttgggaacctccacctagattttagagaatgtatggaaacacctggatgtccaggcagaagtctgctgcaggggcatagccctcatggaaacctctgctagggcagtgtggaagggaaatgtggggttgaagtccccacagagagtccccactggggcactgtctagaggagctgtgagaagagggccacagtcctccagaccccagatgtcatctatatagcaggaatcatacaggctgcagcctcttcagattggcttctttcacttagcaatatgtatttcaagttcctcttgatcattttgtggcttgctagatcatttcttataatttctgaatagtattccattgtatgaatgtaccataatttatttatgcactcacccattgaaggatatattagttgcttccaaatttttgcaatgatagataaagctggttaaacactggcatacaagtttttgtgtggacgtaagttttcagttcatttgggtagttaccaaggagtgcaactgttagattgtatggctcagctatgtttagttttgtaagactatgcttagtttttgcaacatttggcaaccctattctcaatgagttgcacctcttttgaagaggtaaagaacaagcatatacttcaatgagaaaagccataaaggacatctgaaagtcatgttcattcattcatacattcattcattcacttgatatttgagcacagtcatgtgctagaccctggaaatacaaacaaacattggcaatggaaaaaatgcatgctgtaaaacaaagcaaagcagcataacaagggcagtaggaaaggctccaaatatgcaagtgacagaacaaagatggagaaattttccctgcagcagtttcaagagaggctcagagaggtatgaactagtgaagtaacacattttttacccttctcctacactgggtctgaggacacagctatcgtgaaacaggtgaccccacgcaggatcctacagaaaaacaactaaatcacgtttgtgaaactcagaactacaagctcttcctcatgatttggacaatagatgctttcaaagagtggttatttttcctatattttccttcccttctcttaatggagaattccttcttccaccctgaaaaggaaatacgaccatcagtttcccaaataaaaagagggaaatacatatgtgtataaacggtggtgaccacctagtagaattttaagcctttgtttaaggatattttccccctaaggactgcaatttcctaagttgagtcaacattcagaacttcagttaccattgtcctatgtgagatttgtgtgtcttgtatccaatgtactagttaggtatttctttataggctttttaagatttacaggtgtacctgatcaaaaatagctggaaagatctgagatggtttttactggataatttattccatgtgtacccaacagccaagcacttggcaaatgaccaaaaaatatgattttaaaagccagaatagctcatgcaagaaataagtagctgagagataaagaaaaaatggcaacgttatgctttaatggcaatgtaaactatctagaagggacatttatcagttcaacaagaattaattttcttcactctcaactcctatgaacaagccttctccttctaaaaggtaggaatgtctgccccagtaattaattgtttatgggtaactagtacatcacgaaaatctctataagacatctttctctggcacatattttatctttatactagatggaagataacaaccaagtgagctgtttgttgaatagggcacacttcaaagccaggtatggatatctgatttaatgcgcattagcaggacatcagtgcaattgttgtgtgagtactgaggcaagtaggcaaatggcggggtgaacttcactccttaaaatagtgagctaaacagacgtgaactacctaagttgtttgaatttgttccacatgctcttttaaaatgatataagacaaaagagatttaactggttaattagtgaaaatctagtaacaaaaaatgtctggttaattcatggaaaatgggaactttgaataaatttcaagataacgtttgaattaggccaataaagttaattcttgtgtttgcataaacacaaagattggagaattgctgtgtattcaccatttactctttcaaatgaccattactttatttagtacgtgtgtattgtgcacctcctgtatggctgggaacataccagtttccaaaaataaaattaggactatgataaagtttttacactctagggtaacagttcagtaaataacagccacaatacagggtttgagaggtacagaaccactaaaagagaggaaagggggcacaattttgtttgagaactaacagggtccagaaaaggtgaagaactaggtggtctttgacacaagtcttaaaagagtaagtaggcacttgccacacatagaggaaagaaagtgtagcagacaaatagaccagtcatgattattaactatcaactagttcatcttttttattttttatttttttgttcctttttgagatggagtctccctctgtcgcccaggctggagtgcagtggcatgatcttggctcactgtaacctctacctcctgggttcaagcgattctcctgcctcagcctccctgagtcactgggactacaggcacacgccaccaagcccagctaattttttttttttgtgtgtatttttagtagagatgaggtttcaccatgttggccaggctggtctcgaactcttggcctcaggtgatctgccggcctcagcctcccaaagtgctgggattacaggtgtaagccaccacacccggcctgtctttaccatttacttgcttttcattcctggacaacactgatctcagggaggtagtgagtagaacggtggttaccagagggtggaaacagtagcagggttgacggggataaagaaatgctggacaatggatacaaacatacagttagagagaagaaataagttctagggttcaatagcacactcgaataactgtagttatcatgtatttcaaaatacctagaagacatttgcgatgttctcaacacaaaaaattgataaaagtttgaggtgatgaatatcccaactactctgatttgatctttacatattcatgaatcaaaatatcacatttactccatacatatttacaactattatatatcaataaaaatcatgaagatattggtaactaatagctaacatttattcaacatgtaccatatgtctaaccttctcaccatcattgtttcctgtgacacagtaaccctctgacacagataccatcatcactgttttacaaataaataagaaaaattatttcaatgtgctttgggtgagcagcactgagagagccctgattcacctggataagaatgcaatgtgcggcctggctcaatttgacatctcagagcttttgtactctgagtgcaataaatcaggtgtatgcacagaaatcagggcagacttaagctcctcctaaggagtgagtcaagtattttgtgatttgactggatcaccttaatttagatatcttcacaaagatataagcctaggactccaagatgaaattttaacatcagggaaatgagatggtcctttccctctgctatcaggagaaaccctctccaagaggcagggaggcaaaagactgtttctcttcagtttcagttgctgaaataaaggacttgccactggtctgtgggcaaaatttcttgggcactgtctttgcatatgacctctgaattttgttcagtacatcactgctctaaggatatatttagtgcttttactttgcattttaacattcagctgctgagtgagacaatattaggagacatgatgctcttgatatcagccattcttcaaagcgggtgtttattatggaataaaagaaaatacgtgcttcagtctagaatttaaaagcactaactgcaatttttcaagcatatgtatgtaaattaaagttacctgtcttaccattttcttgagaaaagtgtatctttacgtttgttttagtgcgacttgtttctgatatcctaacctaaaatttcatggtcacaaatatataaattaaacgttatcttaatgaaaaaataaaacaggggctatagcacaagagatgtgaggaaaatagtcacacacacacaaaaagtaaccaagagtgaaccctgaagtaatctatggacttggggtgataatgatgtgtcaatgtaatttcatggagtgcaacaaaggcaccactctggtggggtacatggatagtggggaatgctatggtggcagaacagggggtaaatgagaaatctctagaccttcagatcaatttgttgtgaactaaaaacaattctaaaaaacaaagtcatatatatgtgtgtgtgtgtgcatatattcacatatacgtatatgcatatatatatgcatattatctatatacatacatgtatatgcatatatacatacacacacacacatatatacgtatatacacacatttatacacacacacacacacacacacacacacactcctaataacttttaaggtcaaaaactttcttcccttcagaatatctgccagagtgacttcaagtacacagttactcatttgaggtactaaggggtgacataaatatcaacttttggccgggcgcggtggctcatgcctgtaatcccagcactttgggacgccaaggcaggcagatcacgaggtcaagagattgagaccatcctggccaacatgctgaaaccccgtctctactaaaaatacaaaaattagctgggtgtggtggcgtgtgcctgtagtcccagctactcgggaggctgagggaggagaatcgcttgaactcgggagacagaggttgcagtgagccaagatcatgccactgcactccagcctggtgacagagtgagaaagactccttctcaaaaagaataaaaataaaaataaatcaactgttccatcactaaataccttgtggtgtctttctcatccttccactgtagaatagtcagatagcccagtatgtataatagaactctcacatggacctctgcagtgcttattttgcctctgtaactactgaaagagatctcaaataaggatcttcttagaaacttgaagtagtacttagacttacacatcaacacatgctttgggtaaaaggaaaatcctttatgaaaatgcaagctttaagaattaaatgctccccataaggattcacttattcctgtataagtgactgtaggcagaaaaacagaatctgaatgaactttttttttctttaacttggaaaaccttgaaaagataagagtggtatataggggccaattaaaatgaaaagaacaagggaaaatgagagtaagtctctcctctcctcccaatgagggtattgtgttctgaacaattcatgaatggaatttcagaaactcagcaaaagaatacatttaactgacttattccaaatatattctgaatttcatatttactaaagtgtttccaaatgaacattttgtatgttatgtgcaaaaactgcacattaaaaaggaaaggtaagagagttcatcatacaagattttagatgcatgcatacttaaactaacttccacatactccacaaatactaaacttaaaaaacaaagcaccctacataatttaccttgccatagatgtgaagtaattgttaagcatacataaatgttaataaaatactttgaatcaatgctgaggggtggtatcattgaatggtggaccaaaacaaactaaatggcattttgatgtctttggaaatgacatacccacaagccaatggctcagcactgacatttatatatcctgctcagttgtctcaatcatttatagtagtttaatttttttcaagaacacagatgttaaggtaagtttaataattttgaaaggccatagagtatatctattttttgaagtcatactttcattggaattgtctctttaacctaatgaataaatacaaagaatgcacagataaaataagttttgtcttcttttattagagaaaaatgtactgttccatgcctgtgctttctacagttttggaacggatacagatccacagaggccaaacctaaaactaaattatctttaatgttaaaatttaactgaccatgtatataactgtgcaattgctgctttctcacagaactgtctagggttcattcaacagatcacagtaacgaggtctggcatttaacaaacaaactaatgatagaggagatacactaatttatacgagaattaactaaatactgtcatgtggtttagtgtagctcaagttatgcttgtatcatataacataggttcaagttttttcatcagccatcagaataacagtggttaaagagacatctgaataagtgccaactcttactgcagttgtctcaaaaaaagaaatttaagtaattgcaatatacatttctacaaataaaatattccagtgcttacatcaatcctgagtttttaagattaaatatgcagtacttatggtctccgacacaattttattttggaacacggtgatgtattttttaagttgactttcttcaccactttcttcaccaaaaagagggctttcattatactcttccaagtcctcaatactctaaaacaaaaagtctagttcactgacaaaccatcactttacatctcaggttttaaacagggtaaattagatgtcaaaggaaacagcttttaatattcaaaggatgctggttatttatttcaaatttaaaaactgtaatcaatacatggagctccaaatacttaaattttttaattccagatttcagtgaaatattattatagcaggtccaacagtcatgtagtttgcttgaataaaatggcttgatgaacatgttacagacaagatggaccaaagacagaaaaagactgtcagtcttatatcatggaataccatattttttcaccaggtagtgaccatttgttatcactaatagtccacataacgtggttttcattgaagggataaaatggtctgtgatatgacctaatcaagttggggaaaacataactacgtatgaaacatatactagtccctcaacaaatagttcagcagttcatagtccctaaaatgttgtatgttaatactgaggaagacgtaaaaaatgagtacacaatctcttccgtattcctgtgacatgagcaaatgcacgaataaaaaaaaaagtaatacaaaacttgtgttactgctatggaagagcaactcactcggacatgtagccaaaaatggagactgatgtcgacttagttggcacaagatttcaatcagtcaaaaaaaaaaaaagaaaaaagaaaaagaaagattttaaaagcatttggagggaagggcatgagcaaagcatgggagtaacggtgagttccttcagggaaggctgtcaatctggagagttgggaggaaagacagagggtggcaaaacaagcctaagagggggtcatgtaaaggggagagtctctgaatatctaagaactgagacatgggcaccactgacaggctgggaagagggaagggctaggaagcattttagaaaggggagagtgttaggaagatagtattgcccatcagtgaaggatggctcagaagagaagagataactcagaaaagagcttaataatacaagcaaggaagaatgaggtcttgaactagggcagcctcagtagggatttaaagaaagaaattaaaggaccattacagcggtaaacgtgcctcgcaataactgcatgggaaggataatggactcagaggagtccaagatgataccaaagtttctaccctaaggggtaacatgtagcattaacattgacaggataacttttctagtttaatgttcataccaattaataaatagtttctgaggaacattatagcaacatgttctcttctcgtgacttctatgtaaataactgtttgtgtacagatcatccttaagttgcttgaaaattttattttcaaacgcttttcctagtttatttaacacatctcagttagtgtagaggagtgacatatgagcatgtcttttcacaaggttattaaaaagaatacctcccaaaagaaaattacattgtttcctaaataatatacatctacatgaagaagaggtcattgtccaataacgattagctaatatgctatatgacagcagataattcacaattcacaaagtgttaataatctgctggctttcacattctgttatacatctgaaccatctcttatgattacaaattttcatgtaaaaccattactagtcactaatagttttgaaagggaatatgccataaaacactcctacattccagcaggaaataaaagagatactcagtagtcaacacttgcctacttcctatttaactaaaactgtttaaacaagacaagtaaaaaagacatccagtaaggatttatggacttcctgcattccactaaagatctgtcgctgatctcctaaaaactgaatatgaaatcttcattaatgtattcataaagtatcaattttatacacaagatttatatttccaggtaaaatttccaatttaccttttcctgttttaaataactcccacaaaactattcatgaatcctaaaaatacacttaccaattatgttaaatctggaacaatacaaagtgaaaatggtaagtaatttataatgtataaccaaaaggtctgtccacttggaaccaacccaaatgtccaccaatgatagactggattaagaaaatgtggcatatatacaccatggaataccatgcagccaaaaaaaaggatgagttcatgtcctttgtagggacatggatgaagctggaaaccatcattctcagcaaactatcgcaaggacgaaaaccaaacaccgcatgttctcactcataggtgggaattgaacaatgagatcacatggacacaggaaggggaacatcacactctggggactgttgtggggtcgggggagggatagcattgggagatatacctaatgtaaatgacgagttaacgggtgcagcacactaacatggcacatgtatacaatgtaacaaacctgcactttgtgcatatataccctagaacttaaaggataattaaaaaaaaaaagaaactctcggggccaactgaattttataaaaatgaatttgttgtttggtgaaaaaagtaaaaactataaatcctagaagtcagttaaaggatacctgtaaagctctgtggaacaaatattaataaagtcaaactgatcaaaaaaaaaggtctttccatacattcagaaacaagcagactgtcttctatttttgttcatgagttgtattttataagaacgtattgtgttaccaaatagaacagacctttgtgaattgctcatgtggcggctcaatctctttcagttcctttcccatcttgttgccgtctcttttgttgctcttgaaatattctctagaagcacaaaactaaaaagtgattaaaatcggataaattttaatacttacaaaacataattctgcattagctttaaatggatactctttaaatcaatacttctgaacactattagacaacatttatgaccaattttaaacagttgtgttcaccactcatatgctaaaacaacataatctttctcatcagtcatggagtaaagaatattctttcttatatatattcaacatgtatgtcctaattcttggtttcaaatgaagagtatttgatgacccttcctacaatttgttgaccacagatagttaatttctaatacagatctttcttacctaagaaacattcttttttactaagattttaaacacttggtcatttcagtatgcacatagatgaaccttccaacaatgattgcctttctgcaccttgacctaatctccaacaacagtgttctcctctcctctatgtggcactcactcacacagtcatcccctagattttgtcattcccaatggctgcaacatctcccgtaataataataatagcaatgatagcaacgataaagagcaaccatgggtgagatcgcatcctgaaaattttaaataaacccattacataagaaccctttaatccttcaaacaactctgaggtaggtactcttaccatgtctcctttcatagataaggcaactgaggcacagagataaataatttgcccatatttccaagctagcaatggtcaaactggagttggatcccaagcaatgtggctgcagagtcccagcccctgaccactccactcagctatttctccatcttcccaacatacacagccactacctccctgtcactgtaggtcactcacttcagtactacagctcaggaatctgtagggacccaacacccaatggatggagcacttttcactgcccaatgcccacccccatgtgctccggtaactcagtcccagctgaaattccacagccagtcatcataaccgccccccctccaccaacatatatgccctgcccaactctccctctatcaatgtgctcagctacaccccaacccaggaaattccaaccctaaagttactcttgcacaaatatgccatctgggctgactttaacttcttaatccctatgacactgacctcagttggacccctaatgctgcatggcaattatattcccctagtccatgagtccactaatgggccccgctctctgggttcatgctctcttccttctttgctggatttctgcatgaaccattactacctgagacattgatacaataggttaattgtaaagctaagcctgataccaacaattagttcttctccttcttctctcttcttcatctttctgctcacctgtgatgtattcttcaagggtattcggctccttcttctttcttcttcatctttctgctcacctgtgatgtattcttcaagggcattcagctccttcttctttcttcttcatctttctgctcacctgtgattcaaggacagtcagcaacttcagagaacgtccataactacatttctgcctgtaacacataataagtaacacggtcatatgtcatagagagatgaaaaattaatcctattcaaaccaaaactgacttcacataatttatactataaagtagcaagggagtaatggcagctgaaatcttctttttgggaaaaggtgaaatgagttactgtcattctgaaaggatcccttcctaactgactactagagcagctatcttacattctttatgtgctgaaaacaaaggagagtttactgcactataaatttcccagaaacaataattttctctaacagcagtttacttttcatttcctcaaactaaataacatgtgggttctcataagtaggttcaagaatatcatagccattcatcccgtaagatttcccaaaagaaatacttcacttaactctctctccactttggtacaacaatgattttctaaaaggaatagtgaaaacaatttaactaaaatagataacctatttacgacataaggttgtccctttctacataacttaatattgttaaggatctacagactaaacgttgaagacatttatcttatatgcagctgccatatttctagaaatggataaaaattaattttacaggaagactatttttatctggaaggcaaaaagaggtcatcttcattggctttctagataatatacctcaattctgttaaacttaggttataaaacaaagaaacttacctgcttaaggaacaatcaagtaaacatattgttcactacagacaccaatatgtacaagatagtttttgaaattatttgcaccaatgaatacaaagaaatgatagaaatatccttattcaaaaaagccaacaatcatgcatttttagttgtattgttctcaaaatacgtttaattttgttgtttgtttcgttgcaagcttttgcaacgctttcaatcctttttctctttgcagcaagaccctttttaatgtcagctagacagtaaatgaaaatgcattaaaaattaatgttgaaaagtagtttatttgcagatattgaaatcaatatgggacatgatggttcagcaatatcagaaggatatttaaaatgcaaaatggaaagatcgtttcaaaaaagtaagatttaatccttttctgtaaaacctttcaggtattaataatagttttccaattccaattggtataacagcaaatcacttaattgacagatgatgaaaaaaagcaaataattaaaatagtttctattttttaaatgtgcagaaagggtaacaaacacagactttaatttctacatcataaaatgtccaacagttcaaacgacatgtttccatgaaatactgtcacaactcattaagtaaagcacataaaagtaagaccatcaaaagggtagacataacataatacacaataaagtatttttaagcaatctagtgattgatgctattaactgtattttaataaaagaagcaatgtccatgggtataaaaatttaggtttaagtagataaagaaatacacttaaaaacacgtttgaaatattttctgggagctttttatatgacatttttatccacaatgctgtttctgaaaactgtattactgcaaggaatgctttcctaaacatagtttcacatcagagatccaccatcaattgctaagaatagttttctgcagtcataaaagatctgcaccataatacaaatattttttacatacagtatccatctatagtggtcgatgtattaggcagctcacaaaaccagcactttgtcaccaccaagcagagcaaagctttccaaatatactgcttatatgaattattgctatagaagaactgaaaactaaagtaagctttttaaaaataagagtgttgtctccatcgtctctacagaaattttctcaaacttttttgaataaatggtcctataacagtcagtacaactaatatttcacatggcaatataaagtttatgagtttttggatccaattaattacatgtttctcactgggtagaaaagttgtctttacttttctactacacagtttattactggaataataatagaaaataatcattttagagaattcaattttttctcatactttaaagaaaacaaaatcagaaagctgtgacaatagaatagctaaattaggaacatgaaaaactcatattaaaaattctgagtacatatggacaggaagaggggaacaacagacaactgggcctacttaagggtggagggtaggaggggagggtgaggatcgaaaaccacccatcaggtactatgctataacctaggtaacaaaatacaaaataacaaaataacaaaagtatctgtataccaaaccactgtgacacgcaatttatctatataacaaacctgcacatgtaaccccaaacctaaaataaaagctaaaaaaactgatatgtgacttaatgtgtgtacactaaaaggaacgaatagagctgtttctcctccagtgtcctctaatatcccccaaacattaaatttccacgtgtatgaaagaaaagccatccctctcacttgcccattattagaagcattctcacattccacatcaacaataaaaaaggaagtaatacagatttatcaaacagactatgttaaatgctatatatgagaagaaggcatttaagacagtcttgtccactaattcgtacagcctattgtaacagttgtatgattgaaaacaattttcataaactacaaatagctcctaaaacatacctgcaatatcttctagcttctggatatcaaccctgtaaaaaaaaagttacatcagggaaatttatagcactaaatgcacacaggagaaagcaggaaagatctaaaatcaataccctaacctcacaattaaaagaactgcagaaccaaaggcaaacaaatgcaaaaactagcagaagacaagaaataactaagatcagagcagaactgaaggagaaggagacatgaaaaactcttcaaaaagcaatgaatccaggagttggttttttgaaaagattaacaaaatatatatttaggatagttagctcttcttgttgaattgatccctttaccattatgtaatgtccttctttgtctcttttgatctttgttggtttaaagtctgttttatcagagactaggattgcaacacctgcctttttttgttttccattggcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgcttgttagtcgatgcagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttggctgtaaagtattttatttctccttcacttatgaagcttagtttggctggatatgcaattctgggttgaaaattcttttctttaagaatgttgaatattggcccccactctcttctggcttgtagggtttctgccgagagatccgctgttagtctgatgggcttccctttgagggtaacccgacctttctttctggctgcctttaacattttttccttcatttcaactttggtgaatctgacaattatgtgtcttggagttgctcttctcgaggagtatctttgtggtgtaaaacagcatggtactggtaccaaaacagagatatagaccaatggaacagaacagagccctcagaaataaggccgcatatctacaactatctgatctttgacaaacctgagaaaaacaagcaatggggaaaggcttccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcagtaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccggaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaagtaccatttgacccagccatcccattactgggtatatacccaaaggactataaatcatgctgttataaagacacatgcacacgtatgtttattgtggcattattcacaatagcaaagacttggaaccaacccaaatgtccaacaatgatagactggattaagaaaatgtggtacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggaggggggagggatagcaatgggagatatacctaatgctagacgacgagttagtgggtgcagcgcaccagcatggcacatgtatacatatgtaactaacctgcacaatgtgcacatgtaccctaaaacttaaagtataataaaaaaaaaaacaaaatagactgctagccagactattaaacaagaaaagagacaagaatcaaatagacacaataaaaaatgatcaaggggatatcactactgatgccacagaaatacaaactgctatcagagaatactataaacacctccacacaaataaattagaaaatctagaagaaatggataaattcctggacacatacaccctcccaagactaaactaggaagaagtctaatccctgaatagaccaataacaagttctgaatttgaggcagtaattaatagcctaccaaccaaaaaaatcccaggatcaggcggattcacatctgaattctaccagaggtacaaagaggagctggtaccattccttctgaaactattccgaacaacagaaaaaaagagactcctccctaactcattttatgagtacagcatcatcctgataccaaaacctggcagagacacaagaaaaaaagaaaatttcaggccaatatccctgattaacattaatgtgaaggaaataagagaggacacaaatggaaaaacattccatgctcatggttacgaagaatcaatattgtgaaaatggccatactgcccaaagtaatttacagattcaatgctatccccatcaagctaccattgactttcttcacggaattagaaaaaactactttgaatttcatatggaaccataaaagagcctgtatagccaagataatcctaagcaaaaagaaaaaagctggaggcatcacgctacctgacttcaaactatattacaaggctacagtaaccaaaacagcatggtactagtaccaaaacagatatatagaccaatagaacagaacagaggcctcagaacaatgccacacatgtacaaccatctgatctttgacaaacctgataaaaacaagcaacggggaaaagattccccatttaataaatggtgttggggaaactggctagccatatgcagaaaactgaaactggatgccttccttacaccttgtacaaaaattaactcaagatgacctaaagacttaaacgtaagacctaaaaccttaaaaaccctagaagaaaacctaggcaataccattcaggacataggcatgggcaaagacttcatgactaaaacaccaaaagcaatggcaacaaaagccataattgaccactgggatctaattaaactaaagagcttctgcacagcaaaataaactatcatcagagtgaacaggtaacctacagaatgggagaaaatttttgcaatctatccatctaacaaaaggctaatatccagaatctacaaggaactgaaacaaatttacatgaaaaatgacaaccccatcaaaaagtgagtgaaggttatgaacagacacttctgaaaagaagaaatttatgcagccaacaaacatatgaaaaaaagcttgtcattgctggtcattagagaaatgcaaatcaaaaccacaatgagataccatttcatgccagttagaatactgatcattaaaaagtcaggaaacaacagatgctggagaggatgtggagaaataggaatgcttttacactgttggtggaagtgtaaattagttcaaccattgtggaagacagtgtggtgattcctcaaggatccagaatcagaataccgtttgacccagcaatcccattactggatatatacccaaaggattataaatcattttactataaagacacatgcacacatatgtttattgcagcactattcacaatagcaaagacttgcaaccaacccaaatgcccatcaatgatagactggataaagaaaatgtggcatatatacatcatggaatactatgcagccattaaaaaggttgagttcatgtcctttgcagggacatggatgaagctggaaaccatcattctcagcaaactaacacaggaagagaaaaccaaacactgcatgttctcactcataagtgggagttgaacaacgagagcacatggacacagggaggggaacataacacactggggcctgtcgggggtggagggctaggggagggatagcattaggagaaatacctaatgtagatgatgggttgatgggtgcagcaaaccaccatgacacatgtatacctatgtaacaaacctgcacgttctgcacatgtatcccatataacttaaagtataataaaaaaagaaaaaagttacatcaaaattttaacataatgctacacaaaatgccatgtttgtttaagaagaagaaatgtcttatgtgaaatggtgaaatgttctgcatagaacagtgattatatgatccaaagctgacttctctgcctcccagattcaagcaattctcatgcctcagcctcctgaatagttgggattacaggcacatgccaccacgcctggctaatatttgtatttttggtgagacagggtttcaccattttcgccaggctggtctcaaactcctgacctcaagtgatttacccacctcggcctcccagaatgctaggattacaggcgtgagccaccatgcttggctccaaagctgatttttcttagaagacgttatctgacaggcaaaactgacttaaacactttaccccttgtcttccgcatcgatttcagcaaaatggtctcttttccgctgcttatcaattgctggagtctttcctgcattaaaataaaaaagacacaccttttttttttttttaagaggaagacgctgttgtggacatttttttgtggagaaatgtactatttgtggacccttttggctctctgcccattaaagctttaaagcagcgctatacatggaatcactgggaccctgaccattttacagaggcatttttgcaagctctttgcggtttaagtcccagtaaacaaggcactacgtgtcagatcccttggacgtcaggaccgcatccatcgagaagagctgctctaagagtatctgtaaccctggtatgagggagaacctcccatgggaaacctaaggctcttgagcctgctttgaaaagcttgggcatcttagcacgtgcaaggtgaactccaaagcaacataggggctgggggcctcgggctgactgtctgctgcctgtgtgccccccgcgcagagagcagacaaaccgtccccttgggcgtgcaccttcttccggctcccctggactgtttttaactccatgctccatttcctggttggccgtaacctgagcctccactgggtgaggccttcgcaggcttctccatgagcttcctgcccacgggctccatggctggttgtcctcggatgttagaggtgactcctgaaccttgtgagtgcaaagatacagtaaggaaacagggtgtgtgaaaggagagctatcgggatggtgggttcaagaagcgtggggctggcccgccccgagtctcctgtgggagcaggagggatcgcggagaatatgtcagcatcccctcctgtcctggcctgtacagcctgtccctggggctggccgcagagctcgcagctgccgcgcacacctgaactccgcggcctctgggggatcctcgcggagccattgagacagagctcggccctgctcctgggtcccccagcgaccccgtgtggccggaagagctgtgggatgacagaggatctccccagctatctcagtgggagtcacccggtgtgcacctgtttcggacaatcaagggtgggcactgctactcgcccgcctggatgcccaggggacctccggtgaccccaagtgtcctgtcctgctgggcagccaggcaggagggacccacaccgactccccaacccctgcacatatgcacaggcccctggggctgctcctgggccctgggaaccacctgggcagctccagctctcagccctggcccaccccggcctgccctcagggccttgccctgattcaggccccagacaacgacactggggccatttcctcacaggtcagcctggggcagcccggtgcttcacacggtcatccccaaagggcctcatgccggctttccccgcctccccaccatgggcacaacacctgagggaccccccacattgctccctcagtggacctgcagacgctggcaccacaaggctcctctgagggcctgggtcctcggttctcttgagagcagccagcctgcctgcccgcactcctcgctgattggtcgactcagtgcacatgtgggtggtgggccgctggggccacgccccctgcaggcatgccctccccctcagggaccacccatggtagctgtggactcagggagagggtggctttctgaggtctctgtccccacgatattccagctcctcatcctggcaaaggaagcaaggacccaggagtggggagtgccaggggaccctgccctaaggaatggaggccaagtgaacggggcctaggaccttgcccccaggctcgttccagccacccctacccctttggatgcaatggccatcaccctgagggtggagcccaggctccctcccatgccctgtgtgcttccaacatgcccaactgcattctttttatcaatggattgtgcttttatgttttatctaacaaaattgaagttgcctttggagggtaaaaatatatatatgtatgtgcacacacacacgtgtgtgtgtgtgtgtgtgtgtgtgtgcttaagcaaaggttttccttttatattcatagattacattgcagaggtataatggcatactttttatattcatagatattttatatccttttatattcctttgtatttccttttatattcatagataaattgcagaggtataatggcataaaatgggcatatttaagcctttgggtacttcagttagagaatattcctaaggcaagaattaagatgtattcatgcatcatttctctttataattctgttgtcaagtattatagaaatgtttgtcggtttcatttttatcaccaggaatgattttaaccaaaagctttcaaaaaccctttaattttgacccagcaaaatcaaacatttattcatgtatttatttatataagtttaagggctacgagggcaattttggtacatggatctattgtgtagtggtgaagtctgggcttttagtgttcccatcacctgaataatgtacattgtatcctttaagtaatttctcaacactctcccacccttctgagtttccagtgtctatctttccactctctatgttcctgtgtacacattgctccgttcccttataagtgagaacatgcaatatttgtctgtgttttacttgtttcacttaaaataatggtctatagttccattcgtggtgctgcaaaagacatgatttcattctttttcatagctgaatactattccattttacatataaaccacattttctttatccagttatccgttgttgggcacctgagtgttgattccatatctttgctattgtgagtggtgctgtgataaacatatgagttctggtgtcttcttgatgtaatgatttattttcctttgggtagatacccagtggtgggattggtggattgaatagagtgacatatgctggggagaaacatttagtctatagcagggagtcaacaattttcttagataaaacataaaagcacaatccattgataaaaaggatgcagctgggcgtgttggaagcacacagggcatgggagggagcctgggccccacccacggggtgatggccattgcacccaaaggggcaagggtggctggaacgagcccgggggtgaggtcctagggcccatccacttggccttcattcctcaggacaggattccgagcactccccattcccggctccttgcttcctttgccaggatgaggagctggaatattgtgggaacagaggcctcagagagccacccttgccccctaggtcctcagctaccatgggcatgcctgcagggggcgtggccccacacggccccactacctgcatgcacactgagccgaccaatcagcgaggagcacgggcaggcgggctggctgctcttgcaagaacccgggactcaggccctcagaggagcctcgtggtgtcggcatctacaggtcctatatatatttttttatttaatctttattttatatatatatattttctcaaagtatgtaattttgtggctgaatttaattttatctttgtgcatagaaatctatagacaatcataatgcagggacactttattagcatgacctaacctttgaaatcttgtctaggtgagtcacgaatttagttcattatcagtcagttctctcctagctgggaaacgttcatgcagacacacatggaactcaattagactgggtcagtgtgatatctgcaggggctctagtgatgtgtgaaacacacagggagacggagatctaattttatgatcttcactgtcaataggagagaagaaaaggacttctgaataacatcaccgtcaactgcctcacaaaatctctgaaagcagtgctctaggagttacagtgattgcatcaggagctgcagttttgggggcaattgagaaggaactcctttctctgtataggctgcagagttcctgaaacttctccccaattagaaacatagaaaattattagccttacttaccagtgccatatgacctgggactactcagaggaaagggctgattagttaaagaaaatatgtctagaaagaaaccaaagaacattactcccaaaaggcaccttcaggaatccaactataacatttttgggtagattaatatataatacatatatagtctaatattctaataatatagtaaaacggatgaggtttagaacaaattaggagacacattctgtgtcagatgccaactgcatctgcaattttgggcaaggtaattaactacctggagtttctgctaaattgaggttggcaggggcactgggttgattaatttgatcttgaaagtgccatgaggtcatggactatcttcttatctttattagggagctatttcttacatttataagactcctttactaagttaaaggtgttttccttcctctaccatatacaatttttaaaaactgttcccagctgggcgaggtggcgcacacctgtaatcccagcactttgggaggccaaggtgggtggatcacgggtcaggagttcgagatcagcctggccaatatggtgaaacctgctatctactaaaaatacaaaaattagccaggtgtggtggcgggtgcctgtagttccagctactcgtgaggctgaggcagaagaatagcttgaacccaggaggcagaggttgcagtgagctgagattgcgccactgcactccagcctgggcgacagagagagattctgtctcaaaacaacaacaacaacaaaactgttctcataggccaggcgcagtggcccacgcctgtaatcccagcactttgggaggccaaggagggcggatcacgaggtcaggagattgagaacatcctggctaatacggtgaaaccccgtctctactaaaaatacaaaaaattagccaggcgggctaattagtgtggcgggcgcctgtagtcacagctactcgggaggctgaggcaggagaatggcgtgaacccaggaggcggagcttgcagtgagccgagatcgcgccagtgcactccagcctgggcgacagaggaaactccatctcaaaaaaaaaaaaaaaaaacagcagttctcgtaatttatctctatttctgttttgtatttgaatgaatgacacttaattcatcgagattttttaaagagcattgcagaactctcataagatgaggctggttgtatcatttataaaatatttacagcatctcagagagctctgaataataaatgacttccattcaaataatagacttttaacattttcaaactcggcttttcagtagatatcaacactctcaatctcattccatttgtgagtctactttaaaatacctttaatcaaatgtgtaacttaatagttctattgatagaaatataatttttctctatatgttttgttttgtttttcataataatagtagcaaaagatacaaaccaaaatcaattttctagattaatgttggaatctcctggtttcacttttgagaaaccactcctagtctaaaatgcattattacattgtttgtaatgatatttaaaagctggaggaacataaactccgcaataactgcttcatttttaaatttgacccatcttcggtttgtggaacgtgtctgaaattgcacagctgtttttatttatagtctaactggggaatttcacttgtgaaagatgctgtaacaaaataaatgtccctgtgtccgttgcattctgtggcattctaagccaacaaaatgtcaagaaataccattcaaatcctttcagctacaatgaggctgaattatcattcttttcaagttcttgtttttgagggactgttatagcagaaattcacatgcaaaagaattgctttaatttatgtaccatgctactatttttaacttagaaaaaaaagtcagactcctctttggacctcaatactgacaactttcatcagtaataataggctgtactgttattctgtactacctttattcagcaggaataacaggctgtactgatggatgtactacagtgatgcaaggactccagtaaactggcaggcagtgaagaggtatgcttcaggagtgtcacaaaagtggtgatgactttgcagagaacagagccacccgtttatcggcctgcctctgcttaatgcatgttgctcaaatgcctctatgaaaatactgccccaaatacaaaactatactattggactgcccttcctttataactttgagggatggtcattgccacttgctaattgccaagctctcttacaaagtacatattcaatttatttccctgcctgcaactgtatgatgtatagttgtttccaagaaatgatgactaagaggtactgagagatttttgtcattttttcttcaaaaaaagtcaactggtttcctgctcattctttccatttaagttggccatagaaatcccagtggtgaccctcaggttgtcaaaggcctttcttcttgttgctgtgaggttggcctgctgatagtaacagatacaccccactcacaattatttcaggatcaagtagatccattggccatggagtgatggtcttttcaagtaaggctattttgagaggtaataaaatattcatacacttaatttttcttttgtacttgcttgttttaaaatacagttctgtacataaatatttttgacaagatgagcaatagatctattttttcacattataaaacaaaattattataaagataagtcaaaaatgactaagtagaacattctatttggttattaattttcactggactttcaaaacacttttctgtataacatattcatatattttgaattcagcagtgcagtcagatgtttcatgtaagtggctgggcacagtggctcacacctgtaatcccagccatttgggaggctgagacaggcagatcatttgaggccaggagtttgagaccagcctggccaacatggcgaaaccccatctctcccaaaaacgcagaaaaaattagccaggcatggtggcacacatctgtaatcccagatactcgggtggctgaggcacaagaatcacttgaacccaggaggcagaggttgcagtgagcctcgattacgccgctgcactccagcctgggcaacagagtgagactctgtctcaaataaaataaaatatgtaagtgtaacatgtaagagtaaacataatcttacgtagtgattatctgaattattttttctttacttttattctacatgggtattataaagagttgtgtgttcataataaaggctcccttttctacatagttggtcttcccttcttccctcaacattttaaaaaaattctacagaatttacacaatcaacattcttccttttaagctacattattaatttctccccaaaagaattacagtttttcagcagctgggaaatggaaccaaatgatgtttaattctcccagcagtgaggtgaggaaacatgcacagagcattgctgcccagggagctcccccaaccctggcatccagtatggttttggggcgtgtagtcatggcagactgtctgcatgactgaactcagttgccagcccctccagaggtcaagactgatacaggtggcccaaagcttccactataaatcacattgttagcattaactatctagcataactcaaagctccaggtaaacaaagacattattatcaggcaggatattccaagggcttagaggttatctcctggaaggctgtcaaagagcagatgttctttggaaagtgcagggtttggacaacacagatctgctgagctaacctactactgcactcttattcagctcttattctgaattctctctctctcttcctaaaatgtgcagatccttacggatggatgggaaaatctgggaaacacagcactcactgtaaacacaccatgcctagaatttggctcctcttcaacaacccgggcttttgaactgggtcgaagtcactatgccaggatgacatttttttacgttagaatgaattcccccctggtggctcctcatcctccaggtatacaaggctcctggatgacccatggcctccacggggcacaccacagtctgaatcacagctgattttctggattgcccttggactcagcaggatgattccacatcttccaaattctagatatcctgatatcgcaatattttttatccctgtttcttaatgaaagggtaaatggaggtagaggtgtttctcaacaacctgcaacaacacatgtttctttcaattattcagtacttaattggaaatcaaagcccctttctaatgtatcgataacattgggaattgatgactattgtgtagttgtacttaatctacaccatgctaattcctaacatgggctatggaggcagcagagcggcaggtgacaacatatgcacttctctccctctctgcccaaagctcctggtaactgtcaaatgagcagaggacggggagacaataggaatattttaaaactgtggttttcaggttgggaatatattaatatcatacaacctaattatttccttactttgtctatattgttgtatattacccaagcttcagagctgtcagagcaaacctcaaagatgaggagccagctggcaggtaaaaagcaaaacaaaaacagcccgttgctcaatgactaggatttttagttcaattacatttccttgccatctaaatagccagatgcaatgacccatagatagagccagtgtagaacagatgcagtgacccatagatagagccagtgtagaacctaacataataatgtctaaaggggttagtaattgttctactcaatttgtttcagccattctattggaattcctattaattggaattgatggtaagtatatggaatgtcatgtagtgaaacaaacaaacaatttagagcacaccaagtttcatggacaacaaataacaaatcactttttaaaaatcaataccaaccaggccaggtgtgatgactcacacctgtaatcctaacactttggaggctgaggtgggaggattgcttgaggccaggagttcaagaccaacctggccaacatagtgagacccccatatctaaaaaaaaaaagaagaagaaaaaaatgaataacaacgagtacagtgagatcaaagaacactagctaccatctacccttggtttaatactcttgagaaggctggcatatgtggagtctctccaggaagacatttgaggcagaaaaccagaataggggcaggaaatgtattatttcatcatctgaaatggggactttattaactctcctgagtataaagtcaagaaagaaggtatttttcaggactgtttaattaaatgtcattctgtttatcaaaacagagaaacctggcaggcatttctaaccatatgggatttttggaaatacatgagaaacatgtgattacgtgtttagctgaatattatttaaaatgtatgcaaaatcctgagagggcttttgaactaagttcctaaaatcatcctctgatgcatcctatttgatatgctgctgtgtgcctaaaattattccagtagaaataaagcagagcctcaataaaaccagccccttttaatgagctgcttcttgtaattataattatccataatcatttattttgactgtaagtaatataacaaggcaaaacctataattttctaaagtaatataatcaatataaaaacaaaggtgtttcatactactaacggaagataaatgtatcctgcaagctgaatgttggcagatcagcttgtgctcttctaaatcatctaaatatcatcagtgcctttgattacagcctcgtgcccagtgctttaaaaatcaaagtttgcttttaagaaatgtaatttaaaaactgctgatcatctaaatcttgggaggtcaagggcactcttatttcctttatacttacaagtttaatttgatgttttccaaaatagacttgggtataaatttcacatcaatatgctaagcagagccccatgcagaatatttctgagtgggatttattgaatataaggttatttttatgactgggacattacagttgcaatcatcaatgaataaaaaataaatttaaacaactgtctctagcatcaagttgaaactcaagtctcaatagagcaagtttcaggaagaggtgggatttcaggtaacatggagaacagcagctcagatccttttcttaaaggacgattcccccttgacatgaagccagcaactcactctgcatgcagaacatgcaacacatttccatgccggggagagaagcatgtgacgtcattcattcactcattcagtcattagtcattcccttattcgtctatctaatagctgtcaatactcctagtatgtgttgggcattgtactacatgctaaatatatagaatctcttttctaaactcaaaaagttataagtagatggtagtagtggtcagggtaaaatacatttgtgaaaggaagaaattacagtgacaagtcctataatagatggcaagtgatgtaggatccataaggaagaaggacaaattatttatagtatagatagggaagactttacaacaggagaaattatctgagattagtttggaaggataagaacaaaaaggtactccagtagaaaattgggacaaaaagtagaaaaatggggcactttagtctgggagtcataaaaggtggggtatacttggaaagaataaactttttgtagaactataagagatttcagggtctgtgtgagttatagtttcaggagattaagttgaagatatttgggtacaatatattgaggtatatcataagccaagagagaatataggttttatttttgcaggtcagttgttctcaactgggggcaactttgtgccccctccctgggatatttggcaaggtctatattttgctgttacaactggagaagggggcaggctactggcatctggtaggtggagaccagggatccactaagcatcctacactgtacaggacagtccccacggcaaagactctgccccaaatgttgacagtgctagggtgagcaaccttgctctagataatggagagtaactgaaagattttacatatgggaaagaagtaaagaggtactttctaggaaggtgatgcaacacctcctaggaggtttgccacatcacggtggtcatcaaaacactgggtgtcaataagagaaaaaatattcgcctgcagggagaaagatcaactaacttcttgagcatctactctgtgctggacattcaacgtattataccaatctccccatgatattggcaactgctactttctgcagcaatggggactaccagatgaaacaggatgagactagaggctgggagaccattatagatcaatgttcactctcacatggaaacagtggaggtctggactgtagcagtgtccatggagatggagatgtgagagcaaagaggaaggtcaaatcaaaaggagttttttaccaattaaatgtgagaagggtttaaccaccaaatggaaggtttacagaacgactttgaggtggctggttcagaagactaagtaggtagctggagagactgcaaaaggaagtctcagaggacaggtacagggctacccatacttgtgacctttggggtgcccatgggaggttcagatgtagatgcctggtaagcaaagggaaaaataagtctccagttgtaaagagacctcaaacagatatgtgtttaagagtttgcaacatcacaatggtcatcaaaacactgggtgtcattaagagaacaatatttgcctgcagggagaaagatcaactaatttattgagcatctactctgtgctggacagtcattatgttatcgtctcagtctccccatgatattggcaaggagactgaatgcagacaggcccagggaggtgctcaaagtcaggcagccagtcagaggcagagccaagcttggaatagtgtctcaccaaaaccaatccccatccattcattctttcaagattatttataaagtgaattgctgcgtggagaagagaagccacagaacaggttgagaaagaagaccctgagataggaaaagaaaaagtgaatgatatcatcaagtccaaaggaaggaagagcttcaagtaatagtttcagttctcaattgtaaaaagattcagagtcagaccagaggatgcttctgccataaattgctatccaaatgatatcaagtcatgcacacacacacagagtttatatcagagttagaatgtgtacactgcattagacactgagcatcatcagggtcttgctggagggcaaggagcaaaaaacagaccataattggtagaaaagtacttagagtttgaggaagtagagccaggaagaacagaaggaaggtagggtggttgctaaagggaagatattttacagatgaagattcagacttgagcgtagatgtaggctgaaggacttgagtggaaacaccaaagtttgagtatgtaggagtgagggtctaaatgagagaatgaaggagtttggccttggtgtggagaagggtccactgtttgtttaaaatagtggtcttcaatcttgttgggccagtagactctcttgagaaccttgtgaaagttttagatgtcgccccagaaaaacatctgtaaacatttacaaaactgggtatgatcttagggagttcttgctaaaatctcctaagcataaaatttaacaggctctccttgagagtgaagaggtgctattaatgttattacagaggacaacagcctccatctaagcttcaagcaatcccagattggtgaattggaagtggctggagaatgtgatgaactggatttcctctgtgccggcattgattattgtggcgtgactgaatcacagtaagagttcccctgaaaagagcagtttgagtttgttagaaaaatggcactctggaaattgatttctttcaaacaattcaaccctgtgaaatccttgcaatatccttgtgtaaagccagggttatgtggatgacctctgaaagccattgatgtggaaattcctaatttagaaaagttatcagaaatgtttctggaaatgtttacacctagaagagcaatttggtatatcccgggggaagtatccagagcgaggaaatcaacaggagcccaaagttttgcattctatttattgagtaaaaatatattgattgctagccacatgacaagacctgttccaagtgctttatgaatgaattcattaaatcttcatcacaagcctactaggtaggtacagttattatcctccatttcacagagagggtaatggaggcacagtgagatagcagggttgatcttggtttgggtcagggagtagatttggaacaaggctgtctgtttccagagtctgacctcccacttttactctatattgagaaagtttacatattataatatgttcacacatttactcagtcagttcttttttttttttttttttttttttttttttgagacggagtcttgctctgtcacccaggctggagtgcagtggaacaatcttggctcactgcaacctctgcttcctgtgattctcctgcctcagtctcctgagtagctgggattaaaggcgcccacaatcacacccagcaaatttttgtatttttcatagagatgggatttcaccaggttggccaggctagtctcgaactcctgacctcaaataacctgcccgcctgggcctcccaaagtgctgggattacaggtgtgaaccaccatgcccacccaattcttataagctttcaaatatcatatttgtttaaacacctgtattctttagtgttgtaaaggtaactatccatcctctgacagggactgtagatgagaggaaatgcatccaggaatctaatttatcacaccagggtcctatggatagatttagggttatgggaacagtacctcatcaccggttatagattttgagagccttcaatgagccacctctgaagcctttttaaagatggctggacatgcttaggcagaaggtctctgatttgtgtgctaaagctccttcaaatgaagaagtttcaagtgaacagaaattctcaggtgttaaatgctgctacaactccggaaagactgccaactcctgccaggtgaccagaaactcagtcaacttctctgctaactgacctccaagcaactttacccataatagctaagaataccagccaatacttgctgagtatttcctgtggaccaggctacacacacacacacacacacacacacacacacacacacacacacacacacacacacagatccagatgctcagtttgcacacagtggtacagtagtggagggtcataaaaataagcatgcaagttgaaaccacctgatatggttgggttatattccccacccactctcatcttgtattgtagttcccataatccccatgtgtggtgggagggacccagtgggaattaattgaattatgggggcagttacctccaagctggtattctcgtgatagtgagttctcacaagatctgttggtcttataaggggcttttcccccacttcactctgcacttctcctcgctgatgccatgtgaagaaggtagtgtttgcttccccttctgccatgattgtaagtttcctgaggcctccccagccatgtggaactgtgagtcaattgaacttctttcttttataaatcaccgagtccgggtatgttcttatggcagaataagaatggagtaatacagaggacctgctttgacattggatagtcctgtgagcaagttctgaatttatcatctcacagctcctgcccatgtacaagttacttactctgtcctaatctcagtctccttatctgtaaaatggaaagaataataatattggcttcatagaattgctgtgaggatgtaataggattttggatactaagcacttagcttatagtacttactcaataaacactatttattactactgtgtgctgtatcacagggaagttgtggtggtcagatgagatcattggcattcagatatttagaaaagttaaacacttcagaactttcttctgaaggactttgttgctgagttttcagccccattcagtgaatgtaactaactctcatattagtgcgtttctgcaaaaatgatgaggtcttttgttattactttcattgaggaataacatatatagtaatgtacataaatatgaatgtgcacaaatacagctcgataggtttttaatatgtgaatggcatgttactaccaaccagatcaagatgtagaacatgctcagcaccccggaagagtccctcataccctctttcaggtaatatttattcctcaaaggtaacccttactcttccttctgtcacctaaacaaatctttccttggacaatatttctattattatctctagaattaattgtaatatggaaaatactgttttataagcctcattctctgaatctgatcactttaaaattaggaggtatgcacttcattgctcagacccaacccaagagttccatctgacttcctggctttggacagtgctgacaagtcctcagggcatgccccatgctgggctattcacttggaaggagacaaatgcctaggaggcctggtttcaccctcagagagctagtctaactagagaaagaagccttaaaatggaataccatccctaacagcaaatgaatccataaaaatcatgtctcagggagcaatctcatgttttcttgttttcgaccgtcctgaagacactgtttggtattggtctttcccaagaggatgcccagattaaccacctcccacacagttgggtcctttgctttggggtcactaggatgtggaaagcttgctgccttgccatctgctattgtgtcacaggtgtctgtgaggtctctcatgtaggacatggtttcctcttgacacattagtgaggacttccacaaaagagggcaaagggaggccaatccctatgtgcttattccaagatgtattctatcaggacatgttaccccagttgttcctgcaggtcactgttgtctgtaagacagtgcacacactgggagcagttagcaagcatgcactcatcaccatatgcaccatgaaaacacttctgtgcagtattggtagttgtggagcttgcatttctttaaaagacagaatggcatttaaccacacttattgccatccaaggagctggtggaacataaactgttctgtatggttgcaagcacataagcctcttgagcaagttttctatgctttatgagaacaaaagatgagacattttattcttcaaaaatgggggactccaagacaaaccacagattaatcacaaaggagaagaggaataagcagttgcattgtgcatctctggtcattttgctgaggattttaaaagagaaaatggtgtgctaaagcaatgcttcatttcacattattgcacgtcatccatcattttgtatagttacctattcgtaacattcaccgctatctaattaagtgaaaaaattttgttgtaagtaattaagtgttttttaataggccagcattctcaaagatcatactttgcctgtaaggagacttcaagatgttgtctggagttttggagtttaaagtatatattatccttgtgagattatgtaaactctcatatttgtgggaatacaaatgagcaaaactattttgaaaagcttgattttaccaaataaagtctgagattgcatatacacagatccagcaatgcaacttttacatatacaccctggagtggtggttccagactttaatgtgaaccagactttaatgtgcaccataatcccctgaagggtgtgttcaaacacacattgctgggtgacaccccagagttccagatttagcatatctggagtgggaccatagagagtttgtacctctagcaggttcccaggcgatactgatgctgctggtcccagaactacattttaagaaccaccgtctcagggagacttgtgtacatacacgctcataagaagacatgagcaaaatctttcaaaaacattgttcctaataaccccaagctagaaacaactcaaataccatcaacagttcaatgaggaaatgaactgtggtatattcataccaaaaacccctactatatagcaatcaaaaggaatgatctacagctacctgcttcaacaggatgaatctcatgaagtgttggtgaacaaaataaacaaggcaagaaacagtatccataatgtgattccatctgtatgcatcccaaaacaggaaaaacaaaatcatattctttacaaatgcatgaacagatggtaaaactatgaataaaatctgataattgatcattgcaaaagtcagactagtaattatctggggctaggaggagggaagcatacaggtagtttctcaggtactagcaatagtctacgtcttaacttggcttaacttggctattagatatgttggagttggacttacgattattacttagacagaacatttgtatttatacacatctacatagaatacataagttttaagtatttaagaatcattttatcttttaaaaataatgtcctctatctggtatgtattctgacttttggcaacttgtttgaattttaggatctgcccattggttatgaaaaatcaaatcttttaagctttaatagatggtttagttattctgctgggtcaactattgaaatgaaagaatttttgttactgccaaatacatttgagatatgaactagctatgaacaaagtgttacagagtaaaagacctgtaaggcctaattggagaacagattagaatcttgtacagttagcatgtttatggtctgtgtaataagtcatgacaggccctagtagatcatcttttagatgttgttcatatctatgaacacatacataatgggagagattgacggctgttgccatcaattacattacattaaaactgatttacataatttccccaatacaaattgcgtgactacaagagtgaagattcttatgaactattttcttttggtggcaggagagtcatttttgaaatctttgaaaagaaggaaggattgaatgtgcctgttgattatattgtgatgttctttttccttccaaaaatgaggagtgggggacatctgtaactctgtgaggataccaggaatgctcatttctgtttcataatgcttactctgttttatcctgatattatagtcttgcttttaaatgtattgggctgaatctctttctttacatttttagtgtgtcctgtacaaacaattcttaatcatttttttcaccatatgtttccttgtggcatggtctgcatgtcccctatttgatcacagtgtggattctgaatttgcacctcccacatgctaagttgacagctgcataacctcaaaacgcattctggcaatgatgaatgccaatattttatgatgacagcccaagaatttgattgcagctgcccactgatataagtggtatctttattatttggtgagttaagcagacacattaagtacatttgttgcaaatactagactgtaaaagaatgtatttctgacttattatagtaaacagtaagaaacaaccaaaatgttcatcaatggaggaatggttaactaaattgcagtatagctataccatggaactccccacaaagaaagtagcctgaactgtgttagactccctatgaagagctttatatgtgttgtttcatttaattctcacaacaaccttgtgatattcccattttataaatgaggacacaaagacttgtccaaagtcacatagtaaattgtgcagcaatagttagacctaagttctatggacctccaaatccattttcttatccagttatactctcctagctcgtaaatgtcaaagctatacatgctgttgattctcttctcatggagattaggttcaagatgaacattaagttatgtaaccacagagaagaggaagagacttagataatagtaaaattaaacctatctaaatgtcaaagctaaattacttccaaatgaggtaagtttcctatcattccatgactgaaaggaaattcaagaatatacaccaaaattctggtaatatgtggtatccaagtcaggattttcatgtattctcagagctgttactctgcttaaaatgtcaaattataagtgaagtaagagaaaagccatgcttttgctcaaatgtaattatcgatactgtaaaatatcacttatatgtttatctttataacttctccttttaatatttacagatggacaaaagagaaagaaatctttaagaaagaaactggattcactaggaaaggagaaaaacaaagacaaaggtaaagggtaaagtacccaatgtaaatgcatcttccatggagcataatggttaaatttggtggggttattgaattgcatagatatacgtggttcaactctgttatgaaaactggatttctacagtggaatgtcattaagggctgttttggtctactcttctgtgtttgagcagccctgtactgaactgatgaattcagctggtttgaggagagtgtgacctcggccaagtttgtggttccaattattattttgaccaatcagctatacataaagaggacctgggttgagaagctatggagagcatctctaatgctaaccagctgtctggcaaatccagacaggcagggttagtttaatgagagtttgaattcacctaccaccactactggaaagaaacagtctcatcctcatgggttactgaagataggccattctcagcattttttttttcacccagttgaaaaatatttatttgcaactaacctgaatgcttacattttactttgttacattgcctcagccaagataggttaaagcaaatgcccttaatattttgggggtcacagagccctttaagaatcattgacaatgatgatgctctatcaaaggcctgaaactcacccaatgcccaccctaccaccccctaaattaagaattcccagattagatattcacttgagttaacaagtattttcctttttaaagatccaggaactttagggaatagtcagtggctattagtttttttgttttgttttgttttgttttgttttgttttgttttgttttttgagacagagtctcgctctgtcacccaggctggagtgcagtggcacgatcttggctcactgcaacgtccaccttccaggttcatgccattctcctgcctcagcctcccgagtagctgggactacaggcgcccaccaccacaaccggcttttttttttttttttttttttttttttgtatttttagtagagacagggtttcaccacgttagccaggatggtctcaatctcctgaccttgtgttccacccgcctcagcctcccaaagtgctgggattacaggcatgatccatcgcgcccggcctagtatttttttttaactcttgttttaggttcaagggtacatgtgcatgtttcttatataggtaaattgtgtgttgcaagagtttgttgtacagattatttcatcacccaggtaagcaccatagtacccaataagtggtttttcaattctcactttcctcccaccctccaccctcaagtaggctccagtgtgtcttgttcccttctttgtgtccatatgaacatgtttagctcccacttgtaagtgaattctcagcatttttatgttagatcacagtatactcatcttttgcttcatatgttttgggaattgtttactctcatcttactgttttgtgtccccttgtgcatatatttaggaaactaaaactttagccactctctgaggtatttatggtcatttaaaactgatattcaagctcacataatggacacctgagccccattgacgcagtccaattttttgtgccttttttttttttcaagacagggtcttgccctgtcgcccaggctggagtgcagtggtgcaatctcggctcactgcaacctctgcctcccaggttcaagcaattctcttgcctcagcctcccaagtagctgggattacaggcacgcaccaccatgctcagctaatttttgtattcttagtagagacgggctttcaccatgttggccaggctggtcttgaactcttgacctcgtgctcctcccgcctcagcctcccaaagtgctgggattacaagcatgagccaccgcactttttgctgcttatttttatagtctgttatgaagtggttgctgaatggtatggttgtatgcatttattttcactttatgtgacacagtcaacgagtcttgaatgagaacagccatacacatctcatcttggagtccttttatataatgatagaatttctgctttaaaagtaatggaaggcgatgaaaccaagggtattaaaacatgcattgggatcagtattggacaagagctattccataccattgatctcagtctctacacctatatcttgaacagtcatgacatttggttctttagactaaaaaaaggtgaagaattctaaagaatggaaaaccattgttttacttcctttggagtgaggttactcaaccttgctactgttgtcattttagactggataattatctggggtaggggctgtcctgtgtattgtgagatgtttagcagcatccctggcctctactcattagatgccagtgacaccaccctcaacccaaatatcttcagacatttcaaatgtttatctcaaattggaaaaaagaaggtgaaagtgtcagtgatccgcacccctgactacacaatagaatcacttgtggaacctttaagaagtccaagacccacaccccagggagtctgagttcgtgttcttcagggatacctcaggcatgggtgtttttaagagcgtctaaagtgcaacttctagataagaattttgatccatattaactaggatactcaccaggccacattctgtcacagcagaatctgctgctggaataatgagggctaagggttgtccagctagctattatagtctgataaattgtgttatatttaattgttgatatgtttgtgcccttatttttgtaatgacctaaatattaatagccagcattgctcttttaaactagagtttttgctcattctattcctgcagtagagcacttttatgtctccagattagagcaattttccatatgtatagagcatattaaagggatcactcaggttggtattagtaatgtattctcttttaaacttggtttattctaggatgatgatattgatattgggattcaaatacatctaatgtggactttaggtgatttttcagaaagtgtccatttggctagactaagcagaatgagcatttttgcaggaggttccctcaacagaatgatgagatgttccctcaacagaaggagatgtatgtttgcttgcatgtattatatatacaaagcagcaggaagcaagaatttgaattaacatggaaggaagggctagggaagtaatcgaacaatacatactgggccattatagattttttaaactaaatcatatttacataggctcagtgaaaactctgaaatgttctatagtgcctcgaaggtagctaagtgggaaaaggaaggcagatcctggtggttccaaagaaaagacatatcacccacccaactaaggggagaaatatcaggcttcatggcaaaacaaaacaaaaaaattttaagtagctttaatgtttaaaaacaaactaacctaggcttaagtgaaggttaattacatggcatcttttcagaacataaagccctgtccatgtcaacactgagagtcattacatggatatcctgggaaccagggtgtgaggaggacggggtgccggtctggcacagatgtaatctattcacattatttccttccagttgcgtattagcatttggatttgtaacagctgcacatgtgaaaaacgatcatttgaatccaagagtaaaagaaggaaaacaggaaactctaaatgatctcttgagttaggtcatctaaaaataaatagaagcagccttttagaatcgaattgctctcccaatagtgattcataaatggttgatatgctaccatattaattgatttcatcagaatgaatcatatcctgtatgttatttaattgccttgatatacagcagatcttgtgacactcctatgttcctcatgccacttaggcagtgcccatgtgacttttgatttacatatgggaactaattcaagattgacactgatcagaaaacatattttcatacagaataattccaagtccttaatttctcttagttatatttcttggcaaccaaaagtgtttttaaaactttcagaacttcagaaaatttctgtgtcaaaagtaattttaaaattaagtaattttaaaaatagctactttgttttattaatgtgcttcctaaactgagcacatggggaataggttttactatgatgtaactctgggagattgtaccccccacaacccctgccaggacattttcagattatgccatatatgtatctacatacaatctggaaagagttcaattctggcactgttctttttggtgaaagcatattgtatcatgttttcttttcctcactgtctaggtatgtaactgtatgtgagctgtgaagtaacactatatacaaatagctcatacaacttttaattttgctccacattaaatagcagaataatcaagttatcagttatcactatgtagaaattctcaaagaacatatattgaatgttgtcattgagtgctagtacttctaggataagaagagaagaaagaaccagggagtgtgtggtttctgagaaggttaggaaggggccagctcacacagtactgggccacagcatgacttctgatttggaagttcaggagaaagataatggtaccttaggctagggtgggagtgatcgtggaagtggagagaagtaaatggaaaaaagagataatgtgaaagtgacatgataaagatttgatgacggagtgaaaatgagatgtaagaaggaatgaagtatcaaggatgactctcagatttctggttctcccacatgaagaacaggcaaacttttggaaatctgagtaagacctgataagggaagatgaagaataagaaatgcctttgggacatccagatatgaaggtggaagaagtggttggtgctcaaggaaggggtctgagctagaggtagcaatgaggtgtgaaatatctatggatggaagtttaagttacgggcatcgtgctgtcacttacagagagagaccagagtgatgaggatggttaagattgagctctgaggaccttccacattgaaaacccaggtagaagatgataagccagaaaaaggggcaagaatgtagccagagaggtagagaaaaacccagttagtatatccaggatgcaaaggacagggagcatttcaggaaatggcgatcagggttaaaggctgacagaagggcaaatgaaacagagctgtcaaaaacactgaatttaatgaccctgaagacagcaatgatttagagggagctgctttagaatctaatggaggtaccagctagacgggatgaagtgaggaaagagtggtaggtgagaaagttataagctagaaagtaaagggaacactttagacaattttaactgtggcaaaaggagagggggtaaaccatggagaaaagaaaagagtgggtcgaaggttgtttatttttttaagaaatagctgcttgaataaatttagtacaaaatatctagtagaaaaaaagaggttgaagatacaggcacaagaagatgtaatttatagcaggggtggcccaccagccgtctttgtaaataaagctttactagaacacagccatgcctattcatttacttactgtctgtggctgctttcctgctaaactggcaggtcgagtagctgctacaaagactgcaacctgccaacagtgcggaggctggagtgagacaaattgagcccctaggctacagaattgaaagaaatgccaagtctgcatgctgactctgcacttgccccacgctgaatgcgagcaccttatcattttgcatcctagccattctaagccccagccgtatccacaaagcctaaaatatttactatctggccctttacagaaaattgctgaacgctatttatacctaagagtattaggataatttttttgagctcttgagtgcagtacaccattatccatggtttaaagttatccatagttgaatggcaggtgggaaagcatgggaaccagggagaggcagaaaggctggcaggatgccaagtcacacctacatctcatgcaaaggagggtggtggagggcacaggtacagcaggtgtgaagagttggagcctttgcacctgctggttgctcttctcctgaaacaggaggcagaattatttgctggtggggaagatctgccccagaggtataagaagtctctaaacgagtctggttggttttccttagatggaaaaaaatgactgggaaagggctcagtagtccctatcttatagtaaatccctgccatgcatatgcccacctgagcagacatgtcacttgctacatttatcaatgttcttttcactcttattatcccctctgtttctgttatttcatgtagctgtcagccttaccatccacatgtttccagactcttccaaccttttaaaagtaatatttgatcatttctacagacaagattatatgtatgtgtgtgtgtgtatgtatgtgtatatatagagatatatctatatagatatatgtatatatatatatatatatatctcctcagggtacataacaggaggtctggtactatcccctttggtttctaattttgctagtagtagacacagcctattatcaatagtgagaattacacctcactacactgtctaaattgatcactcaaaggagaagtacctaattattttttattaccatatatcacctagcttgttgctaaagaatggcaagcatcctctgaaaatcccgaaatactaaagttttgacttttttacttcaaaacaaattgcatgctttgatagaaccagaggtgcaggcttttcaagtagcatttctgcttttaatgtagacttggtcattagcccagtgatgtttgaaatattgccatggatcaaggaggaaaaccttttaaagtctctttctacctgatttaatgttagctttttctttcaaagaacaaccaaccttagaattattttcccttgatcattttagtttcattcatagggcttataaaaacaatggagaggttagattccaacttactgctgctaggagacctaatttggagtctaaaaagaataatacatttgattacattatttagtgcctttcagcatgaatctaaaatattgccaataaaactcctggccctaaggatccaaggtacatgtatacaaacagatttacgacagaaattcagaaaggaactctatgtatgtctccaaataaagccattgatttctgcactatgcccctttccccaaattctccttactaaaggatttaacaaattgtttcctgggcctcccaccagatatttagtggctgagtccactctgcatgtggccagtagaatggcttgagtgtagatcacgagagtgacagccccaacatagctggctggaaatagaatgtagggatgaggaacacaacgaaaacagagtggacttcttcccaaccagttcccaagctgctcctctgcctgtcaggttatcatttcacatgctaactcttactgggaacctcaaagtgtattcagttaactaaatttcagccttagtttcatgcatctctctaacacctgatactcactctgttatcatgatttgcatttctgattatccactccttcaccccaacccacactctgaacacctcaggagaaaggactgtaccttttataagctttgcgcctcccattgcctagcttgttgtggcatgtagtaggcattcaataaatgcctgttgaatgaatggatagacttgaaacatggagaaaaactagagacctaaatgtctaagatgtgtgtttataaatactagttttctttattgaaatggaaacttgggccattctgattaacacaaatgtcacctttttgattgatgagtcaattcttcagaaaacattcctttgaatatgtctgttcttacttaggtctgaaacataaatgagagtgttcactggaccagtcagtctctgaaagtgaatgtctgttttttgattccagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggagggtgaggtggccagtatttgctctgacaccagtgctaggaaaactgaagatgtacagttattctttgcgtttttgttcatgtgaaaactggatatgtagttggtgttcaggtatctgtcaacaatgccattaatgaagaatgtgcactgggcacgtggcaccttgcatagcctcagaccttgtcctgactcctcttgaagctgttgggtgtccctcctttgtcacatctttgctccatgctctcctaaacattcggcaatatcaccattaattctggtctcttgtaatctgtcagtcttgccatacttgcccactagactgtgaggctcgagggcagggcctggtgttttagctattaatactttcttcatcaccagtctgagaacatgcctggccaaatgaattggcggtgggtcttcataaacaatgagctttttctttatcaatggagcatttctttttctcaaacagaaccatagaatcctctatatatcctctttcaaatactctaactatatggtaccaattgttaagtactatgttctaggtactgtgctattatttgaattgttcatgcaaactggttggtgattggctgagtcagttgataagcatctctaaagcttccaggtcactggaagatcttctctcccttttgtaaaacaaatctgcattttatttttatcttttattttttgactcagggtcttgctctgttgcccaggctggagtgcagtggcatgatcactgctcactgcagcttcaatctcccgggctcaagtgatcctcctgcctcaacctccccggtagctgggactacagatgcgcaccaccacgcctagctgttattattattatttttagtagagatgtggtctcattgtgttgcccagactggtcttgaaccttcgaattcaagtgatccaaagtgctgggatcacaggcgtgagccgccacgcctgaccctctctccctttttcctctgtcacgtggagacctgaaatttttgccacctccagctgttgaagactgccctagttaaaaccccagacacttcccacttaaaaccaacatttttcaatcagcccctaacatttagggcttgtccaaggtagagggggacctgatccattgctgtttttgcagtattgactatgtttaaaaatgaagaaattacaaaattatggaattcctgaagttgcatgatggaattgttcttctaattctgtcattgtgtctcagactgtgtattgtcgtacaacaataacactaaaactctaaattttagctttctgggaatgtaggactcaggcaatggttttcccaaatgccctctcgtctgtccaggcctggctagccaactgctttctcagtgcttcatcaagtatgggtgcggcaaatgcgactggtgccctgctccctttccctgaccctttaccattcctagcatgccagctcatcttccatctgccaacaccttatttatttgctgagggctttctctgatgccagaggcacccagcctatccaaatggcaggctgtaagtacttaggagataatattatctctctgcccccaccagaggctacccttaagcagtgattcctgaggcctggtgtataaataccccagctctctcacttgatagggatagctctaaggtgcatgatctacagctgtctcctagagctccccagaaagattgagctccagttgcccacaatgataataggcttgataatgctcccttcatcagctgcctttccttccttgtctcatttcccccctcccctacaggtgtttcccaggaccacttctctaataaagcactttgtgttgtttctcgggaaaactaagctaaggctgttttgtggaatcattctattttaaaaatatacttcctagagccatagttgagttttttatttacaagacttctctgactacctcattgattgagtatgtaatttttttcttgtttcaagaaatgaagtggttgggccaaaatactttaattatatgtttcccatcgcttgttcttccatttggaaaatgttgtctattgttgaaattgtaactgccattagcttgaggaaatcttgtagaggttttctaactttttcaaaaggcatcttttttcttttaatttacaaacagaacaattaaagaaatcaagcagtagtatttcaagtgtgataaagagtcatgagcaaaagtatgtattggttagcatctgggggcagctgggttttttggctatctgtactttatgttcacggctctgtgtcacttgcagggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggtaagtagacttgtctgtctaaagtactaaggactttcatttattcaagcatcattcactgaagtacccaatgtcaattctgcttgatcaaatgatcaagctctgaactgaaatttactgtgtgaaagtgtacagatgtgagtgtttgcttaagagattgtggggctaaacaagattggagaagagggtgaatcaacttgatgatattcagactgcttagctcccagtagtcctcagaagttaccttggaggccaagcagtttagggaatgatcagatctgttgggctgggtttgtcaccaggacctctttcaaacagaccagagccacttttattgtttatacataaaagtagcctaggaggttactcacaaagtttcctttaaaaagtaagagtccaacttaaaaaaaaaattggggaatcattgcttaagtgaatagaaaatacatcatttttgacaacaggtttacatattgctatttgcatttttgtggaagctgtccacttaaaatttctccaagccaccctttgcaactcaattctagttactaagttgacttaagaatgatatacagttcttcaaaaatgtttctgaaatttagacttctggcttattaactgccattttcataaactaagtttgtatgctatagtgtttgttagcacgtgttttatatacatgggaaaagcttaattactttttttaactgtaaaaataatatgctcattgtaataaaaaagtaaacgtgaaagcaaagaaaattctgaggctaccatatagatataactactgttaacattctcatctatttccttctaataaaaatggaactttattttaaaatcattaaggatatatttaaatttcttaattcattacaatggaaatcataggataacatatggatgacctaataaaactaatgtagcaaaatcttatttgtttatacaaaattttaagtgtaggttcttttaatttttttcaccttatctttcacttgcctgtgtatcacctatgtatcttgaatatacatctctttctctatacacacacatacacacacacacacacacacacacacacacacacacagtcatgcaccacataatgacattcccctcattgactgactgcataggcaatggtgattgcataaggttataatactgtatttttactgtacctttactatatttagatacacaaatacttaagattttgttacagttacctacagtattcagcacagtcgcatgctgtacaggtttgtaatgtaggagcactaggctctaccatatggcctaggtgtatagtaggctataccatctagggtggtgtatgtacactctatggtgtttgcacaataatgaaattgcctaatttattgcttctatcactttggaagcttgaaaaccggataatcacactatttagaataaaatacaggattatatttcttcatctgcaaaatgaacgtaagtacccacctcaaaagttgtgcaatgattcaattaattaatgtgcatacagtacttagaatagtacctggcatatattattatatagagagaaatagactctgagtgaactgaatgaatcttctatgtacgaaatagaaaacttcaatagtaggtcacagtaattttaattttggctgcatttatttttttattttcacatggtttctgaataattaaaatttctacagaagcaagatatcacataaggacattttctacacaggtgggactattctctttctaccaagagatagaaaacacaactaaaacaaattgagatgtttactttgtttctggatgtaaagaaataatgttataaagatttaaggctgggcaccgtggctcacgcctgtcatcccaacactttgggaggccaaggcaagaagatcccttgagcctgggagtttgagaccagccagggcaatatagcaagaccccaattctatatttaaaaaaatacaattctttctgatttaattatatattgtactagtcataaatttttcagtggcaagagaaaggaactcagaaaaaactagattaagcaaagtgacctcccccaaataacaacaacaatctttatatactgggagcgtgatctagatttaggcacggctggatccaggattcaaacgatgtcatgagtgtcctctgtttgctggctttattctcagacagttctcttcatgtggcttcaaatggcggttagcagctccaatatcccatcactctcataactgattgtctcaaatgaagagaaaatgagccaccaatgaaagaattaatatacatgatgctcatcaatggcaatgatcaatgactggcatagaaaaaggagagccattcagacgtttcatgctcccaaaggaagtacacaatactttttgtgaagtattcttgccctataaaatcacaccgcaatcagagtaatgtctggctctagctatctctttacagaaaataaaagagggagaagaacatacaaatgacactatggagtgtccaaatccaaacaatatgaagatctacagtaggaaatcactgagatttcttcaccaaaacaattataaggaaaaaggagacagagggaggaaacacagattaagagactaaaaggcacatcgaccatatgacagtgtgtgacctttatgtggatgttgactggaaatttaatgctattaaggaactattgttgaaatttctaatatgtgatagtgaaattacttgtgtttttaagagacctaattttttagaaatgagtttctcaacctcagcactgacactatattttcacatctaggacatgatcctaggaaaagcaatcagaaatgtgaacaaaaacgtgtgcacagaattgttcacaatagggtcatttatagtagaaaaataagcatgtatattttggggacctgtgcaccattcagaggggaatatggagtaaattatggcccattcatacaatagaatattttgcatcttttttatatctccatagattttgggggaacaggtggtatttggttacatgagtaagttctttagtggtggtttgtgagattttggtgcacccatcacccgagcagtatacactacacccaatttgtagtcttttgtcccttttaagtgacatttataaggaattgttactagcatgagtgaaaattcatgcgacacgatagtgagggaaggcagtaacattctctctgtcaatagatattatatatatgcagtgtgatctcaactatgtaaaaatacctacattcatgtagaaaaggctggattttaaaaaatgaaagattagctaggcacagtggctcacacctgtaatctcagcaattttggaggttgaggcaggtggatcgcttgagcctgggaacatggcaaaaccctgtctctccagaaaatacaaaaattagtcaggcatggaggcatgtgctggcagtaccagctaccctggacgctaaggtgggagaatcactgcagcccagaaggtcaagactgcagtgagccgtaatcacgtcactgtactccagcctggacaacaaagtgagaatctatctcaaaaaaaaaaaaaaaaaagaaaaaaggaaaaaaaagaaagaaagaaaagaaaagaaaatgaagagtgattatttctgcatcaggtatttctaaaagtatattatttttacatttttccgcattttctagattttctttaagaagcacactttaattatgatcagacgaacaagaaatatcttttagaaattaataaagagttagaatccctataaaatgtgtgtttaggtaataattctggataatggacaaaagctcattttctctgataaggagaagattagaaatataaaatatcacaagaaaaatatttgatcagaaacatttaacgtaaaattctggtgcttaaagggctgacctttaagtatctggataatagaaatagtgtgagatgaaagaagcattactgtatgctgtcaagttactattgctctacatgttacggcactgtgctggcattctgctctgtattttgatttcctccagggtctcaagccatgaaacaagactgttcattttgtttgcttatttgcaggcctccagacagtggggatattccgagttggaagctcaaaaaagagagtgagacaagtaagtgaaaagtaaagattatattttgtttcacatgactttcaattgaattaccttttgcaaagttcaagtttatgcaaattccattttgattatctttttttttttttttaccctccaagctattataatataattgaattccaggaggtaaaaggcaacaactcagaaatgttgttacagttaggatcaaacacttgaaagcaaaatgtctggatgtatctgtgccacgtgcagccaaacaaaactaatttataaacatcttattgaaaattgcaaaagcaggaaattcagagtgactgatcaataaatgatataaagttgtatgtagcacccgcttttactaaaatgtgatatgaaaaatgccattaacattcccttcacataagatgctatgtttatagctttactttatcaaaaataaataattcttatgaagtttccatagaaccattgacccccagtttgcttttcacatagagactgtgctcctttgtttccttcagccctgtgcaacattcctgcaactgaagtttgatattagaccttcaacaataggttcctgtgatgaggcaggtatttgtgttcatgatggcttcataaaaggcaaaccatcctttgagaaaagagttcatttgttggtgaaggaaaattaaagcattattttcttcctgttgttttcaatggaaggagataaggaactcagcaactcaaaaatgaattcaaatgaaaataaattttagttggaagaagctgaagaaatgatatttgttcatattattgaaagtaattgaaataaatacctcatttatcttttttgtcaagacaaaaaaggctttcaacagaaatatgttttctgattggttggttggtttttattcttaatagttacacaagaaacattaaatggatcaacatttaatgtttcacaacagaacttgcaggaagaaagatagtacagtaacatttctgtgcagaattgcagaatatttttacaaatattatctcactgaatctgccaaccggctgtgagtgtagcccctttgacccacttctgtcaaggcttatagagattaagaaacataattcaagatcacacagtttaaccagtcaccattaacttcataggccaaactctttgcatgttccattctttctgcatgtacgtatactcagaaaagaagcatggtgtgtttgaatgatcacaagttggaggagtgccagtggaagtcttctttgttttggctgcctgacacacgctgatggcgtgctgtctggaatcaatgagtagttcaggacagtgatgggtattcattctcatcaggtggacaggtagcgagtgccagaaattactcatcagttatatcgggatccattaaaggggaaacctttgcatggagttgtatttaaggattacccaataaaaatataattagtgtttacttagaagtagatttcaagtatgaaatatgccctaactcactcatcattttactttgttatataaccccttagcaccctgcactttttccttagatcactagccacaatgttaagagtgaattatttgtgggattacctgcttatcacattgtttctctagagggactttgcctctttactcactagtgtattttgtgagcctgtaacagggtctgacacaggaaatgcgtagtaatctttgttgaatgaatggatggatgaaagattgaaaacaaatgaactcttagagaagttttttgcatagtgtaggtttatgaagttacataattatttctacagcagagaacaatgcatacgaaaagttgagctgctagagataaaagtagggtgtggagttattactcccttgctactgtgttttcttgctgctgcaagtgataatagacctagtataatgattaaggcagggaatccttctggtaattgttaataagactactttgacaaatctaagacagcttttatttagttattgtcatcttttaagtcttagtcataaatgtgttatcagggctcttaatttcatttttgcagaaaaaaaaaatctctttgctttcttatagagtgactcagtaaaatatcaacatccaaacatggcaggattggtgacacacagaaatgctgtgtaatagattaattcctccctcccacatttatagctgacctaaattgtcttctacctcttaggtgttcctcctaacctggttgtcattaccaagcccttctgcatacatcattaacaataaatccacagatagttttatttaataatgcttatatatatatatatatatgtatacatatacatatatatgtatatacatatacaatacatatatatacaatacatatattgtatatatgtatacatatatacatgtgtatactcatatatatacatatatatgtatacacacacacacacacatattcatagctggactgtgtcaactcggcagatcaaggtgaggatgttgtttgcttccccttcttggggtctgtgcagtcttaattccagatgctacgtgtcacagcacttctcctgctgggcactgctcattgaggtatggtgttatgtgactgccactcgaaccattgttcttccagttacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctctgtgcgtaatacagccatatgtgggaaagtggccctggaatactaagatgtccaactcattcatcataactttatgcatatgtttcctgataactttttgtccttatttatcaatctctaaagagtgagctatttgagggaatttctcagatttaccctgggaataattagcaagaagaaagttacaataaaacaaatggaaatagccaagaagaatttgagatgctttcaaataacccaagaacagtaaaaagtactatgagttagtgcttagagtaccaacaagagttcacattgagtctgtgcctaaaaatgagtttgtgtttctggtacgaagaaggagggaaccacgagaacccagagtgagaaaggagggcagcaacattccaggagaagcaagatgccatagcccagtgccagggctttcaacatagctgcttctgggctgtagctacagatcccatgaagaagaaaaaaaggaggaggtagaggagagataggccaaacctgggtcaacctccatacatttcttcctccaatgctgccattcaaataggatcacaacggagagagaagacattggctttgctgtatcttggttattgccaacaaaatatctgtcccttgtgaattgctcaacagaaaagagccttaaatccattataaactcaaatttcagaatgttcaccaattttcagccattgttaataaatatttaccaaaaatggaagactgaaatccttaaactaggtgatgagtaatgccagggaaggggggagaagaaagtaagggaaattgagttaccttttttttttttttacctggattacagttatttttctaggtattacacttctcgaggtctaatttggctttatatctttcatagaatcttgctggtaaattgctaaagcaatgggcaaatgagtgaaggcatgaaatgggaattgccttgataatccctttcttaagacaattgagaggaggcctttcctctgtgcctgaatagtatgggctccccttttatttgagtacctctttttgccttgcttagtgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtaagatgcctttgctgccatagatgccgtgactcttcctctcccctattttaaaagggcataccaccaaaatggccattttgcctggaggtaatgatgtctccccttctccaacctagctgtctctgtaggaagagactaatgcagggccttctctggaggcacagttcctaaaagtgcatgggccatgagcctccttatatgtttcaagtatgcttccaaatgaggctgtcattttccatggtgaggctttactcaagactctgaacttccgtttgtaaagaagaaaaacagtgaactacagaagtgcttgcaaccatgtaaaagtggaatgatgggggtgggaggagattgttatccttataattgattttacctgcttctataacttggagcccaaatatgatgtcacctctttattcttccagtttatccctggagctcccatctgcactatgagcaagaagtctagtgtctccctttcaagggatcctttcctttcttaaactctccccccaaaacagggacttgctcgatgcaagggagggtcagtcctgcttccaaaccaggtgtggaggaaactgggtctgatctgctgaccattgccattgtgtcttgatgtcacatggtatcaactgctcaaagcaggttgtacatagtcccacagactctttagaaatgttcttgttggatctgatccccactcaggccccagtgtgccccccccccgcccaccaaatctaagatcttgggttctggttctctttggttacactcatatatttcaagatttttttttttgtttcacccttggacaaatgagatgctggcttgaattttaagttgcttacttatgggcaacgtatttaatcttcaccttaacaagagacacccccttccctctttgataccatgcagttatacctctccctgacctcggattcctcaggaggttttagactccttaataagctaacatgcactgtaaatcaataagaaggggccagaggcattccaaacttacttaaccacagaaacttttttgtaaattcttgttaaacaaagctcagctgcactgcagcttcagttctgtgtttgtcaaatttctttcccaaagaacgtggttatgtataatttttttcactctaatccagaaaggcaattctgcatttcttctcgtcctcctccttacgggtgtgagaatggaactctcctgacttagccatttatctctatagcagttataattagtgaagccccagatggcttcaggtttcataatgtggcactgacaccttatttcagcatacacagctctttgatgggcatactataattctcataattgttaagtagttttattactcatttggatgccaacctctatcaactacagttataacagaagctgtagcatgatctgcctaattgctgggggaaagcagagctctgtgtttaaaggtactccagttacttctctgacatttcttaagtactgtgtgagaaggagaaaattgggtctcaggtaattaggaaggcattgaggaaagcaaaagttccaatcgaactcattgttgcccttttagaatcattttcagacattctttccattcaattgctgaacaagtctccattgcctatgccaaaaagaagaaaatattcttggacaggtgtaaatgaaacagcatgctggaatattagctaccatttatgtctctccttccatgagctggctttgtgctaggggagatatatatatatatatatatatatatatatatatatatatatatatatatgcatgcaaatacatataaatatataaatatatgcaaatatatatatatatatatatatatatatatatgcaaatcctcttaacaggcaaaagagatatcactgtctccatgtttcagaagtgaaaacttagggccaggggagctaagtaacttacctagcaacccacagagagcttccacttaaggttgtacgagtggcatattagtgcatttcacaactctaggggaggtgccatggaccccatagtcactggagatttgcagagttattaggacagtatcccagtggatgatagaaaaagatcttgaagaaggacaatgtcgttatactggttaatgggttgggttggtccccttactagcaaagtccaagctgtgcatagaacctgagccagtctaagagaaaagacgtacagaataggaattagaagaaaaaaaaaatgtactggggtctaggtcatggtttctcagcctctgcacaattgatatttggagctaggaattctttgtcatggggccgtcctgtgcattgtaggatgtttagcagcatccccggcctcttcccactagatgccagtagcagtacatctcctctcccaccaagttgtgacaaccaaaaatatctccaaacatttccaggtctcccctgaggagaagggttcaaaatcacccctggttgagagcgcttgatagctctttaattcactgaccatgtgttgttagaaaaatctattaaccttcctatacctgggtctcctcatctgaacttgaggaatgaaaattcttcaaccagccttgaagagtggttgagagacctagtttactgtaaggaatatggaattatcctggtgacagtgaagttgtaaaaggaagccagggtttacgagggtttctagacactcttgacctgaacattgcatcaaaatgaaagactaatagccaaagattaaagcagcaggagaaatataaggaaagcattgcttccgtgaaatcgttagcagtgacaggagagcaggcagctctcacagccattgtgaactgtagtaaaggctacggagcagtgaagtactgagggagacaatgggaaattgggccatgttcataaattgctgaatgcctctgtgcagggcaggtggttgattcttttaagctgtgaatccttggaaggattcaactaatgggtgatatgatccacgttgtagattggctagagacaaagggagagtgagttaggaggcttttgtatcaatagtaatatggacaacagcaattcctattataaacatttccatgtaagaatggccttggcgggccaggcgcggtggctcacgcctgtaatcccagcactttgggaggccgaggtgggcggatcacgaggtcaggagatcgagaccatcctggctaacatggtgaaaccctgtctctactaaaaaaatacaaaaaaaattagccgggcgtggtggtgggtgcctgtagtcccagctactcaggaggctgaggcaggagaatggtgtgaacctgggaggcggagcttgcagtgctccgagatcacgccactgcactccagcctgggtgacagagcgagactccatctcaaaaataaataaatgaatgaaagaaagaaagaaagaaagaaagaaagaaagaaagaaagaaagaaagaaagaaagaaagaaaagaaagagaaagaaagaaagaaagaaagaaaaagaaagaaagaaagaaaggaaggaaggaaggaaggaaggaaggaaggaaggaaggaaggaaggaaggaaggaaagaaagaaagaatggccttgggatttgaatcatgcatgtcctgagcatctaccctaggttcctgtaaaccaacgactattgctcagaaattttctaatgactggcctcaggatacaatggcatctaagaggtggaggaggtgaggacacaaggcaaatatagaattagggaatgcactgcagagtcattgcagacattcggagaagtgatgagcatgggccagaaaagttaggaatggcttcatggaggaggttgaatttaagatgcacatcaaagggtgtgtagggattgagtacatggaccacataagcacagcattgggatgggagttagccaaaccccttctgttagaagtcaagggtagagggagaggatcaagagaggagttatttattattttttagttgatttggcatgagcaggtagagaatatggaatgggcagactggagtaaaactaaataccaaattgtaaaatatggtcaaaaaccaatatttttcaacttcttctcttccctatttttttagtatgtattatctatttgttagggtgttgtttggggggattgcaacatagatgaaacctgaagcagattgtcaagaagcttgaaagctcacacaggttctgccagcaccttgctgcataacttgtctttatgaaagagaggaagaggaaggaaaacagagttgggatggggggtggtcttagcttcctcatctacaaaatgaacataatattttctctttgatatgtgcttaaaattcaatgcatcattcactggtgagaccttaaagatgtctaaaagaagggcatgagaaaaattgttgaccaatcagtgcttttttgggaaaaaatagcagtattttattgaattgtggtgttttgctatcttgtgtttgttttgttttcttctattttgtttagtttgctatttgctttgctccttagggaaaagagaaattcccaagtgtaagaaacattgcatttcttcaagaaagaatatagcaggaacaaaattgaaacctcctgagcagtggtttttcagagttcaagaaccccctggcactgcctggaaaatgtggtgtgaatatgcacttgtttggtgagagtccgtagctggcattgagttctcaaagggtctatgaggcaaaaaaagaagttacaaatcaccagtgtagggccatgattactaatctctgaggaggtacatgcctctaggaaatggtggttggctttggaacttagcaagacctgtgtctcccctcaccctcattcagccctgttttaaagctcgttttcccgtttccccatgccatggctgggtctgcccagcaagaggaaacaggaagagatgtagcaatgggatgaagagagtagggctgcctagagtggggccaccagcttcgcttctttctataccatctcctggctctgagctttggacatcacttccctcgtctataaaatagggacaacagcagcagctgtttcttaagcttatagtgagaaagaattgaaatggccagtggaaagcccctagcctggtacctgtacatattagacttttaacagatatgagctattcatatgaagcttagaaatgatctaggatgttcatttagtgaagataaaagttttcttgaattgctagctaattaaaaaatgaagtaatggcctggctcgagtgtacgttgtattacctagacacagccgtatagtatatatataaatatatgctgaaacacatggagaaaaggtggatgttgcctgggagcaactcttctttccctgttaaaaaacaataaaacaaaagaaaccccaaaagtgttaacaaaccccagcagcttggtctgcagctggaatctgtgtgcagttttacagatgggttgtattccattcccagaatagcaacaggagaaggaaagagcggaaacagagctctagattgttctcgtatgaaacattcttttaaaagaaaacaaaatcttccatttgttaatgttttttttaaaaaatgagaaaaccctaatatgactttacaggggtaaggggaaacactccaaatacctctgagttctaaagggaggaatttgaaaatgacacgtatttgattttcaccttaaccatgaatttccaggaaaagaaaaattaaatgaaaacttgtcaatgaaataaaaaacttaccaatgaaataaaacaaagaaaaatgattggacgatcctacataaagggcactttctttgaaattgtcagtgtttatcacatgaaatgatatcccttggaggccaatcattcacctgaaaacagccttgccttctaaaaataatacaactcgtgtaccaagctgggattgcagggcagggcagccaccagctcatgacgccacaggatgagagtggggttcagagggctttgtttcagctgttcattgggactcctgaattctatgctgggcacccaggtgtttctcaaaatctatgtagatcttcccaggcaaaagatccccaccaagcagacgcagttcccatacttatcctgactctcaactgatattgacaagagaaataaaaattcacatagaccagtggttctcaaccaggagcaattttaccccacaggggacctgcgaccatgtctagagataattctggttgtcacaactgtgggttgagggcaggggtgctcctggcatctagtgggctgaggccaggggtgctgttccacatcctgtaatgcacaggacagcccccacagcaaagaatgatctggtattacatgtcactagtgtcgaggtagagaaaccctagcctagagaaacttactcagactctcccgttcacctgaaagaaagacaagtagaaaaaattcccaaacctttgaaaacgttcatattccttattacaacaattcaacttgtaggaatttactcctaaaaagtgctcacccgagctcacaaaatatcttttcaaggatattttttgtaccattgcttataataacagaaaattcaagacgacatcaatgcctattagttgactgtggttaaaaaacatcatggtttattcgtgcagtgggattctaggggccaatgaagcctgaagacaggattttttttttttttgtagtggaaagattattgtagcatgttgttaagagatagtaagcaagttacaaaataatatatggatgtgatcccagttttaaagaagaaaatatcaggtgtacatgtatatatgtgcacaggaaggcataggaatggctgattcttggcagtggtgaaattatgggcatttttttttcttttggcttacctgtgctttctaattattaatatattgaatgtgaataattttttatgcttcaagcaaaaaatagttcccttccttcaccccgtactcccctttagctcctcctacatttcttcttcctccttctctgtgatatcttttgaagaaagtgtctacattcactgtttccacttctgcaactgtggctcattcctgccacaccactgacatgactcttagctgggacatcagaaccatcagagagtccattctggagggaagggtcacatctcgatgaccctctgccacagttgataactcacttgaaactcccctgtcatttcttcttggacacaggtttcttttatggtaacttctcacccattattggcctccttcatcagctgctccttaagggtgctggagtctccaggaaccccttttcagcccttcatgttcctcacttaactgtccttccattttttcatttgttaaaacacaagatccttaccctctgcattatcctcttcaccccctccgtaactttggaagctgctcttcatccctacttcttccttcctagttcagatgctagctgctgtggcctagactgttgtggtatgtcccaggtagtcctacttccttgcatcccccatcccctgttccatagattgctcttcctgaaatgcagattccatttccattctgctctgttcagaatcctcttgcccttagatcacagtttgaattccttggtctgacacatgaagatcatctcacctggcccttgcctgcctttcctgcagaactccctaccacactgagcttcctggggctccatgacgtattttagatgtttctgtctttgcatgtgtggtgctttctccattgtaaaattaccccctagcccagatcctttgcttttcagcctagcaaactctattcttcttttgagagtttgtgcaaatgcttccgcctctgtggtagtgaccctggggcctttggagttgagagctttatactttgtactcattacctgtaagtgataggtttatttcctccctagaatgagagacctttaaaataaggactatgttgtaatcattggaaaaattttaaaataattacaatatatgaaaaatgcccagcctatgataggtgctgagtggatggatcagtggtgagattatgggttgatgaatgaagggatggatggagaaatggatagatggatggatgggtgtcaatatttcttaagtgcaaacaggatagaaattttatgtagtacccattttacaataaacaacttagagttgcaaatttttattcaatatgctattgagatgatcactgaactgtgagcttcaatccaagatattaaagcaaaaggaaaataatgatgccctccatggattctgacagagaggatggcatccttgcaggattaaaaaaaaaaaaggagagtaaaaggtttcattgattgttgaatcacccagtatcttgaaaggcaaacataacaacagtccttgtgttctgttctcttataggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggtaggtggcccttctgtggcaggacatcacagcaaactgcctattggtttcctctggaggcaggatgaaattctagtagaccaccctctggggtgcagtgctgctcactgaattcattggaagtcaggcagtttcagcaggagtagaaatttgcacaactatgatgtcattttgagtttgtgactccatgtttaaacaaacatgccaaattataattttcattttgttgtcctctaaaccatggtcacattttggagtcacttaattataaagcagtgtccttgctcaagacattaataaaacccttctttatggaattgtgtccctcatgaattcatgtattcataagcatcctcagtggtttcacctcctccaaggtcaatcttgacattttacctcctacatgaagcttcacctctccttcctttgtccttcccatgccacttctctgtcccctgaactccattactgttcttactgatgtttatcttgcccaacattgtgtatagtaatttatgaccatttcccctagtagagtataaatgcatttaaaacaaggactgcaccattgttatctcctctccatatcctctgtacacttttggaaagccctccatctggcaggcactcaataaatatttttttgatttgtattgaattaccagttcctgttttccttcatcaaactgcattgcttgctacaacttcccttgaaacattaaaacaaatgccaactctcttctatttctgttcaccactaatattgcatgtcaaaatttacaggaaccttcttcatgttttttctcccatttctcttgtcaatttgcaaacgctataaagcctgcctattccactagagccttttgtggctccttccttcaaccgagaattctagttacctcttttaaatttctttagtagtttgtctacacttatcaagtgctttgcattagatttatgtccatgcttgtcttatactaattactttttgtaaatttgagacccagcagtttagagtatttgccctctgtgtcttacctatgtgattgtgaccaagtaattcaatactcattatgcatcaattctagctttagaaatgggaaaaacaaaatgatgatgtaattctcagggtggtgaccagaatcatttgatacgtgaaagtattgtgcaaactgtagcagtttatgcaactgttaattagtaattatattagttgggtaacacgtgctgcctcaaaagtcagtactttaacacaaacataaatatcactctgacataaagtttaatcaggtgttaagtggacagccttccaggtggtgatttaggaatcccagctccttgtattttgaggctctgacattttttagagttttacgggcaaccccagaaaggtcatccatcttgtccactcaaatctcattggccagaacttatgcacaagccacacttaacttcaagcgaggcttgaaaatgtatcctggttggatccccaggaggaagagcaaatgaaaagttcactgaggtagaatggcatcttgttcctgtttgtgtctctgaagcactgtccctgggttgcacatgctaagctctcaaaaaatgttgaattaataattgactctatataaaatttacacatcagcctaaatcctcataattaactacatatttggatgaatcaaatgtctgaacttttcaacattttcatcaagtttaagtcacatatcatcttgccaagtagtcttggcattacttcatgttctctggatttttttaacaaaataatacttctcatcaaacttaattctattatctaagcaaagttctcctttatatgaaaccacatatcatcgagcatttcttttcaactcagataccaacaaaagttttcctggcttctttgaaaatatagctgctgccattttaattgtgccatccctcttctttccatttcctgccacctgaattactaagaacagtataaaaacatcagtattctaccttttccagcttttcccaaatctgatctttgtttgccattctctgtagggattgatgtcggcattctctcatatttttggtctccagttatagtctttacttctcatagaggcctttcctggccaccttgtctaaaatgcacctccaccctccatcacacacacacacacatcatcactccctatttcctttccctgctttttccccttagcactcaccactgttaacattgggtcttacaaatttctcgtttatgttcgccactccctagaaatgtaaactacatgacaggatgatttttttggtccatttctatctatagtactttctttactgcattacccctgtgcctgggacatggtaggaacacaataaatattggttgaattaatgaatgactcaatggttgttctgtgacatatgatttccatattaccaagccttactccttatacgtatgaaaagatttgggcatggagaaattaaggatacctttcttggagtaagttaaccattaatgtaatcattcttgacctctttagaaggattctggtaatcatatattcagaaaaataacagtggagtgggaggaagagggagacaaatatctcaagtcttggtctatgaaaagaaactgactctggaaccagaaaatttactatcgtcctgtccctgttatatattggctacatgacctcatcttcttctatttctttagttatcaaatactagatttgaatgaatgatagccaagaccccttctagttgtaaaatctgcatggtgctatgccctagcactgacttcccttccttcctttttataaagcacaggagaaaattaatctcatcacattttagattatcttggcatatttggcagttgagaaactagtcggctataccaaggctggtggtttgtcagcaaagctgatctgcatgggtggacaaaaatgtaatcttgtatgtcgctatgttgttttgttttgtttggctttttaaagaagctttcagaattattataattccaaacaaagaaggatgaagctagtcagggcctgatggttaaaagtagttagtaattgtgcagtttcacagtccttgggtttaagagctcggaaagggaggtgtcacttctattagcattagaaaggaagacttgttaggaaaggtagctgtgagcttgtcctggaaggcagaacagacctggaggcagtgattccataaaataactggtggaagggatgtagaagctcacagaggcctggcagggacccaaaatttgttctgggtgttctaacatccttcatttcctgatgctgagactgcctctcccaagtggccactctctgagttaatgggaaagggcggaaaagaacctggcttcgtcctgtaatacagaagaggaacctagatgcagaggttgacacacaatttaagagtctggctaggacagtcttttgcattggttgtttgcttttcaggtactggtttggaaatccttgagctggaaatagatcataatagcagatatcatgaccacagatatcaaaatacgaaggcagtagattataatggtggttctcaaacttgagtgtgcagcagagttgcaaggaaacttagacattcagattcctaggatgcactcccgagaatcagattgagtagcactgggatggggcccagaaataatctgcactttctagtgaagacctccacagagttctggtagtttcctaaccacacctttggaaaccatatcttgggaaacactggtatggtagaaagaccatgtgcattggaatgagctaccaaaattcaaatccctgctcagccacttatttgctatgtaatcttgggccccacagttaacttccctagccaaaagatgaaacaatgtgacctaatttacaggactgttataagaattagaaatgacattttaaggcacctagaacagaattaacatatattaggcattaaaggaagatttctgctattattacattaaagggataaggtgcctgctctatcaaagcgtgtttgggtgttttcttggaaatcaagcccactctgcccactgtgtataatgctgtgacctgatcccacacatatatactcctaggcccttactctgctctttttattccatagcatttattaccttttaacccactatataatttacttatttttatgcttattgaaacctaacagaatacaaaccttataaaggcagagatttttgtttgttctgttcactgacattcataccacctagaaagtatatggcaaaagatgggtgctcagtaattatttgttgaataaatattgcaattctgtattactagaaaaaaaatgtatttttgtttcgattttgtccagtgtccatactgcttatattcccttacctttaaatcatgaccctccacttctgatatcaacacctgttgaaaaactggctaacataaaatgatactctgtgggagcactggaaatcaaggataagaatcattaatatctacacaaagtcattggtattatcctaaccagaaagttctcactgactaagtcattgatacatgaattgttctgaaagttgttacttctgtaactaatattgggaattccagagaaaactcatcattgctcttgggattagtaagaacttcagagcagaatggagaaaactgtcagcttcttctaagggctgatattaaacgattcttactaggacttcttcttaggagaggggcaagaaagagaagacaccacccttgtaagctgatgaaaagtccggagtgcagtggagacgtgggaaagccagtgtgttcccaccccactgagttgtcagcctgaactggggaccagcttagtgcacgtgggaaatttcaaatgagcactactgggagcaagggtcagaggctgtgatgaggattccgagtcagaagccaagctttgctttgtgttctcttcattccctgatgaaaatcgcattttcttaaagccactttgcacaccaagtcaaagagtcaagcattcatccaggtcatcaagcaagaaaccacccctcccagtatatccacataattatatatgatttccatttccttttctatatatcacaaataccactgtctacgtgccagggttgggctactcattacgtacattattggcttgtttaaatctcactaccatttcatgaggagtaagccaagtttgtttgcccaagtgatgcagtgactaaatgaattatttctacagcatgatgcctccttacacaaaagaagaggcattttgatgtggtatctcagatatggagtccatttgtggggaaagaacaagaaaatatgttttagccaatctggaaatgaggaatgaagacctttaacagcagtaatactgctggactaatcatagcacccctgatgttcaggccagcagatggcttccagagccagcaaatgttctgctatagtctgctcacttggccctgtctgtaaagacagaacatgtgtactgtttgtgtcccacaaaggtggaaggaagcagaagcaaattatgcctgaacctttcccactccctttaacctgttgccatggagcaaagactgctgatttctttcatctttgcttgagttatcctccaacatcgttccatgagccctggacccttccactgtatttgttcactaatgtacctgaattgccaaaacatgctgcctgacatgtatcaagcacttgagaaatatttgccgaatttaatgcatcttgaccctcccgtgcacccagaccccttaaattattaaaccacctgtcacaacagagccacgccaaaggttctaagctgggcctgtccttgtttgagcttttgctcccataaacagccaaagtgatttcttttagtgtgtttgttaactacaaaatgccatcatgatttccagtgctatttacttttgctgggttttaaatgctaaagcatccttcttggtcaagtgcaaagtggtggattggtgtggaacatccagtgacaagtgcagtagggctgggtcctgggaatagctcttcaaaaagcccttaatggtttattgtggtgacttagtaaatggagaaaactcaactcataccacttttctctctcagtggtttatggaataaactacctcatagcagttataccccaggcaataattcaaggtttcatttttaatttgatcgggtagattttaattgtgacagttttattctttcatatgtgcagtgtttacatttttttctctgaagcaggaggggccaaagttcttttgatttttggaacagcattatgctttgaaggaactcattaaaatctaaggagttgagtctccagataaacaagaccataaatggtacccttagaaaatatctagaattgttacaaggttgactaaagcccagtagagattttgatgtgaaacaatgaattgtaaatgaagaatcactttgggctgggtttcgtttcttctttttaacatgcagaattgcttgattttttaaaaaatgtaatatgtctttcactacccttctccttagttcccattttgctatatacaaaaatcccagaagcagaaaatgaaaacgttgtttaattattgagctatctttttcaaaaagttttgaagtttttgtattgataagaaaaatagcttaagaacttagaaaaaatctgatgataatcagttgggaaagaaaatgtattttcccactctagaaatgaacagcaagaagactgtgctgcagcatgacataggtaccactgataagtagagagaaacatctagacaagggcaacgtaacacatgcagtccataatcctgggtgattttagattattattatttttagccatttcagcaacattcactgcacatccactgggtagaaatcaccaccctagcttgtattctgaaagagcataaaattgagcaagagagtgtgtaagtgaatgacggggtgagggtcatagaagtgcaggtaagaccttccagagaggaaagagtaggaaggcaaagttagaggaggaaaatgagacatcatttaggaaacatttgactggcaaggagaacaataatcaactgcaaatggctttcgacatcagcatttattatgtgacacagtaaatatgggggggggggcacagtttcagtagctgggtagcactttgctctctctctctctgctctgccatcttcagctgcaaaatggctacagttgataacagcatctcttccagccatcattgcatcaattaatgaagagatgatgtttcttttcatgtacccattttcaatagggaagataaccttttccagaagctcctacatgccccacttcaggtaccagcatgtgcatacgtgatcttgccctagctttgagggaggctagctgaaagaaaactacaaatttctgagcctgtttcagttctgggtaaacaaatcagataatccctgccttcaggaaatttaccttctaatgacttgaatggtgggaagattcaaggtctagccaaaggaactggaagggtgaggctacacagagtctgacttcaagaccattgcagttgaagggccaagaggtcataggctgtaactccagaaattcagagggggattagaagcagaggcatagcaagagaaaatcccataactgagttacccaaaagaagtgttaagcaaaagagaagagagtgcttcttctctgaaagcgaatggatgactgttaataaaaactaataactgcagaataaatattgtccatctccatgttatctgcttttattttttcaagtgtttaacttacttatttcatctatttctaataaaacattttattactagatctctttgcaattggtaatctattttcatttttttttagcgcttttgattcccgtaacaccccccattaagtaaaatgaatatgcatatgttttcagatgtgggaacagaatcctaaagaaggtgattgatgtgtccaagtttatattaattataaacagcagagccaaaactggatttcaggggctgttgcctcagtcagatttttttttacagcatcctaattcctgaaaaggtatgcttaagtcagtggtctacctagatatttctttcttacttatttcaagctgctgtttcctatcagtttatttacttgacttttatttctccattaagtacctaaattaatagagaaataagtgttcatccaatataactgagccagtagtttgaaatttttattaaatgttaggaaacgaaatgtgcagttatagccaaagattagaagaattataggaaaacagtactgggtgctgttgtatgaacattaaaaaatcagtttcaggcatcatttcaaattttttacctcattttcccactgactccaattttctgaatcattcctttattttttagaatgtggtttaatcacatacattttgaagctgccttaaatcactctgtaacaaaatggattataaataaactaatgaattatatacaactgtagttagttttgcataatacataggaaaatattatttgccttcctgtaatacatggatctacaattttaaactatgtcttttttatgcatttgtaaatagtgtctccaagccaaaatggtaccatgggccttttaaaaggaaactgtagatagatttataactgtgacccttcctatttgcatttgttaccaagtaagagtcacatatgctacataaaatagacctcagtaattatgattgctcgcctagttgaatgaggaaaacctctgaattgcagactagcttgacaaaaatttatggaaagttattttttaagtaatgatacttctgaaacctattctaataatgcatccaagttgataatttatcttagacatactacatactctcaaagaattaatattgtcatgcttgcaccactctgaagggcttgcactctaactgtttattctttaattaaatccaagaatggattagtgcttggagcgaaattttttttttttttttgagacagagtctcgctctgtcacccaggctggagtgcagtggcatgatctcggctcactgcaagctccgtctcccggattcacgccattcttctgcctcagcctcccaagtagctgggactacaggggctcaccaccacgcccgactaattttttttttttttgtatttttagtagagacggggtttcaccatgttagccaggatggtctcgatctcctgacctcgtgatctgcccacctcggcctcccaaagtgctaggattacaggcgtgagccaccgcacccagccacgaaattttttattacatgtcaaagcctagcaagttttaaattaaactaactggatgaaaatgcaagtacttttcctaatttgtttatggaattttcttctaaaaaagagatcgggacatacatttttgtcctatattattttttgctctgctgttcattaaaaaaatatgagttctctttcctctcattttcaccctttaggtgttacgtttttaaaaactgttataatagcacatggctgttgggtgatgatctttggaaaaaatacagtaaaaatgatgtctttctgtttaatttatacagtaagagaataatctcacccttgacctaaatatcctgccctttcccttctccccattttcatacccaggccactgcagctggtcacagggttttaaataccatctatatgtgcctcttaaatgtctatgttcaacccagacctctcctatgaactctgaatccttattgccaactatctacaagatacctccttcatttggatgtcttgcaaacctctaaacattatcatatcaaaaccacactccaaaacttgacccccaaccttctcctcctgcagcttctccaaaccagtcaacagcaactccatctttctagttgcctaggccccaagcattgaggtcatcctttcttctccctctccctctcttctctctctctccatccaataaattaatgctattacctctatcctcactatgtccactgtggaaatatttctcatcacctcactgccctggttcaggacccatcatcttatctgggtagatcagcaggccctctctgctctccttgctttatctctggctccatgcattctactctcaactcagcagccagagtgatgctgcttcatgttagtcatctgttcaaaatctccagtggatccccacccactgcaagtaagtgcagaagtccttattatgacccataagactccatgacacctggtcctggccctatgaccccttcctaccacccgcctcctttcctactctcttccagcctcacagacctcctcatcactcttgactcaagacctttatcattggctttcttttccttccttctacctggaatgattttctccaactccttcatcagtttgagttttctgctaaaatgtcagcttctctgggactgacaatcctattgaaaactgcgtcttcccaagcatttctcattgcccttctttgccttgtgtttctctatgtttttcttgtatgtttgtttaatgcccgtctttccatatttgttaccagcttcatgaagacaaggattattgtctgtttggtttgtaactgaattcccagcatccaatacctggcactcaggaagcattcactcaacatttatgcaatgaatgaaaggaagggagggaagagaagacctgagggagaagcacagtggtgctgaagtagagcttgtgtggaatgactgctaggggagaagatgggaaagacagattgaggacagtatgcaagtggatggcttcagccatgggaataaaaagagtttccagtaaatgagtgtcttgaccatggcattctgacaaccacatagagaagaaatgtgctgcacatgttaaggaaatagcagacaaatttgaaagctgttgtatcaaaggttcatcaagtacgtatttttctttgcaatgcaaaactcaaactagcttaagtaatttgaaggctcacatagctgaacaatccacaagcaaatatggcttcagacatagcttgtcccgggactcagatgatatcaagacatcccttttatctctatttcttggtattgtttgctcaattgtcagcgcaatcatcaggcctcatatggatacaggccctgtatcctctcttagaagtctcagggaaaacctccagggttttcattgcctctgatggagtcacatgcccattgctcaggcaactatgatgatctgggaatggaatgctcaatagactttgactacgatacacacttcacccttgagctaaggcttgggtagcagttggtttaccagagggaacgtggggtataactattataagaggagggaaatggagacttttaatgatgaacagatgaccactacaaaaggctaatgagggcttgaacttgagtctctgcagttggaatggaaaagggagaaaagaagtaacagagatgaagtctagtaggcctcctggctctgaatggagagaggatgcagagaagctttagtacaattctgagatcttgagcttgcgtgattagaagttggcaatgtcattaatgaaggttcacgataaagtaggaggaacagatttgtaagagacagaacacatttccttgctttctcatccctgtttttattaataaaattgtttccagattctcagagctcaagaactgtagagttctgcaagaggcaagaagcaaattcttccaccaaccacttattttcagaagacttaaccctgcagttttaaaaagtcttctctctgagctcatgtgtgagagaatcagactgaaattttattttctctcaatagttttgagtttcctttggttgagctatcagcttctatggaataagaaaccacaagtcagagctgggttcaatcatctcttatagaacatttccacacagatgacttagggttgtgaggccatcttctaatgtactgtggatggattaggcttagagaaatatatgatgctcatctatagaactctactggatgcctaacaaattacaaagtgagaaacttttcatcactgatggaccaggtgcaagaaaggagtaaaggcaggcaccgaataataaagtgacatatgcaaatgtagtagccagcaattttttgagtatttaccattgaccaagtactgttttaaagtctcaacatataataagtcatttaatcaccatagcaatgcttcgtggtgagtactgttgttatccccattttacacgtgagcaaactgagatctaggaagatccttgtcgatgtacgttgtcaagggtcccacagctagtgactggcgtggctaagattcaaacccaagcagtctggctcaagggcctgccttcttaataaactgatcatatattccagaactgcccaatacagtcatcatttctgcctgctgccttggcataattataaatgtgaactctagaaagtgcccccattgggcaataaattatggacactatttctctgaaccatgatattttccttattcaaaaccaagaaaatctaacctgagcaataaaggcatccaagtggttcagttgtatctccaggcatatgaggggtgacattttggattgaatatgactattggtaatcatccagttggtcctaagaattaaagcagctgcatgggttggcgtaggtttggttttaaccagcaaatcattctgctgtcttgcagcttttagggctctgttttgtgctacagtaaaattgtcagtgaccatatgttgcctgtttctggaatggttttatttatgcctcaacatttggctccttcaggttcccccagatctccagaacgaagtgctgatcagcctgttagagaccgatcctgatgtcgtggactatttactcagaagaaaggcttcccaatcatcgtgagtattccagtgttccatcttctaaagccgcattggagatttctatttccatttctgagaaattggaaaggtttacataagtacatgcagggtgacctgaagtggaattttggcaactctttggcaattctgatcagtccatctaaccagaaaatgcttcgggtcccatcaatccacttaccaaattagaaaccacattacaagatttttctgttttattttcagctttctctagcctctcagggtccttttgacttcatttacagggaaaaagcacaaattactggcaagggactataatacacgtcaatgattctacttctagaattctgataagcgtgcataggggcccttaaggctgcgcctggatgcatcttgcttgtgcagctttaccagtgggattaacccattatcaaaccacaagacagaccttagctgaggcctaggtgcccatttgaaattagaggtgtgcaccttcttggctctcccactttttatagctagtattattttgataaaaatgcacatgggtttctacatgcactcatgtttgcaattagtaaaatgcaagccatgctgcaggctatggcttgctgccatttttgctcccaaaagaggagcacagagtttttgcattagtcagattttatggttacttccaatctttgctgcagaggcagagggtgtggggatgctgagcatttggcataaccagttaagggcataatatagcatcattaaccaggagtagtatcatcaccaggacaccaaacaataaatttgtgacaggaaaagttgttgctatgctcttacaaaattatcacttttgttatacttttaacctactaaatttcagcaattctaagatacgtttctcccatgacctatgatctctgaaattgagactaatcttataaccaatgataagctcctaacgtaatcccgtacctgtaaccccagcactttgggatgccgaggcgggcagatcacctgaggtcaggagttcgagaccaacctggccaacatggctaaaccccctctctactaaaaatacaaaaattagccaggcgtagtgacaggtgcctgtaatcccagctactcgtgaggctgagatgggagaatcgcttgaactggggaggtggaagttgcagtgagccgagactgcaccactgcactccagcctgggtgacagagtgagactctgtctcataataataaataaataaacaaataaataaaataatggcatgtcttaatcgatggtgtcttataaacagtaacacatgttaagttattcctgtatattggtgttgaacttgataaattaattttcactcatgattattgcagatacttaaaaagttatattatttagaaaaatttggtgaaaaggaattccatgttgttcaacctccttctttcccaggtcattacgttgatagcacagctaaattcagcttcactccatttccagcttagcagggaagaccttttaattggattatcctttcagatctactttaaaaaatctgtgtctgggccattcattatcaggccaaattctgattcaaataggaccaaattctgttgaaagtaaggcctggattcaagccccaagagccatgagtgaataaaattatattcaaattgtatagatgagctagtattttatggtcttgcttttcatatcagagaattaggcttacatttaaatttttcctagatttctaaccctcatcaaggtataagtcctaatttatattaacaaatggcttttcttttcagcagatcatgcaccaccataattttgataaactcatttatttccctcccttgtacagaaaagagacatgctggcatttccatttatgagcccctcatttaaactgcacttataacatatggttggtactgtgtgggaaagctacaaaacacacacttttgaggaaaaccactgatttttgcctggccaaatttctgcttttgtgtggcattatgagatagataaatactatactttaaagaacagttgatagaagtttttttacatggttttcaaatacactctttgcatataaatgctgtggtaaaaagcgaacctttctttctcttctattaggaaaaggaagaagcacacatattaagcccattccaagctgtacaattgtccagccccttctgttccctatccgtaagagtaagaagtagaattttaaagtgtaggtgagcagaccctagaccaagatcttaggtgagtgtcagggcttccaagaaaatagcaaagacttggaaccaacccaaatgtccaacaacgatagactggattaagaaaatgtggcacatatacatcatggaatactatgcagccataaaaaatgaagagttcatgtcctttgtagggacatggatgaagctggaaaccatcattctcagcaaactatcgcaaggacagaaacaccaaacaccgcatgttctcactcataggtgggaattgaacaatgagaacacatggacacaggaaggggaacatcacactccggggtctgttgtgggatggggggaggggggaggaatagcattaggagatatacctaatgctaaatgacgagttaatgggtgcagcacaccaacatggcacatgcatgcatatgtaacaaacctgcacattgtgcacatgtaccctaaaacttaaagtataataataataaaataaaaagaagaatgagcccataggagctctgtgtatgtcagagactagcattatcagtgaacagaaaacactgggggaagacttacttaggagaagaaagtgtttggtttttgtttgtgttcctctaggtacaggccaaggaacagcccagaaggcagagaatgatgtcatgaagtaaaaatgcatatgttaataaatgagtgtttacttttagtggtcttttgaggcttgagctccagagtgctacccctctagctgtagttgcctttttttttttttttttttttttttgagatcgagtctcgctctgtcacccaggctggagtacagtggcacaatctcggctcactgcaatccccacctcccgggttcaaacgattctcctgcctcagcctcccaagtagctgagattacaggtgcatgccaccacacctggctaatttatgtatttttagtagagacggggtttcactatgttggccagactggtctcgaactcctgaccttgtgatccatccgcctcagcctcccaaagtaggtggtctttttgtgttttaaactcactcactcatgcttctcaaactttactatgcatgggtatcaccagatcttgttaaaatgctctttctgaatcagtaggactcggggaggtagtctatgaatctgaatttctaacaagctcccaagtgatcctgatactactggtccatgatccacactttgagtttaaaaagcttaaaatatcaaagtatattcttgcttttaggagctttcagacttgttggaggaggcctccaagggtagaatgccaaacaataggtgctggcccactggctgtcagactcaccagccccttggaatcacctgggagcctgaagaacaactatgcctgggccacccctcagagattctggttcattttcataggctgcaatctggacattcggatttttgtttaaagtctcttgcatgattttaatgagcaaccagggttaagaacctctagcttagatctaccacgttggatatcacaaatttactatcatgtgggagtttgagctgggtgatttttgacattaaaaaggcatccttgtgttgacaaaggaagggaatcaatgctccagaccatgaatccacttggagtttggagaaggaaaagaggtgtgatttgaagtctcagagatagcttctgagaagaggaaggatttgcagtgaactttgaagactgtggaggatataaacaagcctggatatttggggagcttgcaccaggacctggacataacagtaaatatgttggctagctggggtcacaataaagaggctggccagcagtgaaggtagaagcccttaaatggcaggctgaggggtggtgcttaagtcaagaagcagtgacaatagattactgtaaggctaaattatagtaaattacagtaccctaaactgccagatggtgctggctgcattggcaagtcaattatccatcagtaacacatgtttgtgtagtcagttatctgtcaataacacatgcttgtgtagtttaatagactggttaccatttcagatccagagccagattgcctacgtttcaattccatttctattgctattatatatgcggtctattagttaagagttaatatctgttaatacatagatagatctctctctctagtttcctcatctgtaaactagagataaaaagtagcaccaacttaaatacagaattatgctcttagtgtatagtctggtatatcataaacatcaccaatttgctcatttacaactacttaccaaaggcgtggccatcactagattctactttggttttcatgagatagcaaccttccaggcaatatgacacaagagagaacccgttcactttaagttatagcattgtgtctaaaagcaaacactatatttgcttctaaccctttgatttttttttcctgaagcttctgttctctgccaccagttcacatacctaaacaaagctttacattcctgtgaggccaagtggaaactgcacaagattttatttggaggggaaaagaaacaagtttcaaaagagtgtaaaaccaagaacaagaaaatattataatttctgttttgaaagagcaaacatttagtgatatttgggaacttaatattttgttttgatttgggtttttcacttctttatgcaacatcggtattggaggagttaaaggataattccttgttttttctcgtgcttgtctgcttaagtatttggcttcaaccaaaacgggatgccagagggggattagaagagatttttatgactaagaatgcaagaccaggagtctgtgaccagcctggtcaccacagcaagaccccatctctactaaagaaaaatttaaaagttatctgggcatggtggctcatgcctgtactcccagctactcgggaggatgaggcaggaggatcacctgagcccggggttttgtggctgcagtgagccaagattaggccactgcactccaacctgggcaacagagtgagaccttgtctctagggggaaaaaaaaaaaaaaagaaagcaagactttgatttttaaaaatatatacttgtcaggtatgtttactagcattatatatgctcttttcttcaaaggtacttaaaatagttcccctaccctttgatttaaggatgtgaggaaatagggaatgagaatgggaggttaatcaaacaggacaggatatgttgaatgtgaatatttgcaacaaaacaaaggaatcacagtaggactgggacttagtgagaggcaagtgagacgcttgcctagacacagaatttaagggaatgccagaaaactcagtcagcaaaattgattatattgcaatgtaatattttttaaaaatccaagctaatgccaaaaatgtttgataaagaaaatatcaaaattttaaaaagactagccatgcttagtcatagaacctgaaacaaaaggtaaaatatgtgctgctgccttaaatggaagcaactcataagtcatatttattttttgagacagggtctcgctctgtcacccaggctggagtgcagtggcacgaccatggttcattgcagcctcaaccgcctgggctcaagcgatcttcctgcctcagctcccaaagcaagattttcaaaatctactttgtttatcttggttccaactgagagaattgctatgtttgacagtttctcttgaccaagtgacaatcttaaataagttctaactaaattaacctgaaataaaataataaggaaattctgtttgggcatacataaaacatttaaatttaatataaatattataggttcgaatgtatcttcttttcaatttttcaattttttcaactgctttgatgttctgggaaaaaaaaatatacacaaaaccatgtatatagaggtacacagttttcttttgcctgaggcatctcgggcccctaagttccgcataagggatgctttgcagaactaagcatgattaatgtgaaaatcccccataaatccagagctcaggagagctcagcagagctcagatcatctgtgacacagtaactagtttcagcaacaggtcttgtaatttttaaatataggcttgaggaaacatataaagatttgctcttattctatcaaacctcaggggctccccagaaatagaatattaattaaataaggctaagtaaagtatcttcccttctatactctggaaacaagatcaaaatagaacaaatttaactgcatttggagagaaggcagatatggatgaactaaactcaggtatatatatttaaatttcattgtggttaattctattagtagccttcacaaagtttttactggaaaaaaaattaaactaaaattaattttaaaaattagcaaaactggtgactagtgtatcaagagcatggttgaagatctgtactagtctgaaaaaaaataaaatttcagtactgaaaaataattgtattgtttagctagatgttcatcttattgaatgacaaatctgccttcttcattctgggggagcattaggctttcttctaatttaaaggtatcacatttaacttaccaaatatcacatagatcatttcttttaatctttcaaagctcatcattaaaaatatcttttttcacaaacatggagtgttatgtgacagattataatttctgtttttcttttactaggatttttcatatcagaaagggtttcaggaaattttcagacaagaaatctaactttaccagtacaatgtaacagcaaagagtcctattgagtggcggtagctgttggcctcaataccctggaaattatgaagcattaactgcccctgcccccctcccccaacacacatactccattcaagaaagtctttccagccagatagttttagaaaaagcttatgtggaatagagaattccataatgaaaaattctaaaatgtgtgcatatatgccttctatggaaaggcattcaagatggagggagaatgtatcacattaccccttccttcctcacaccttcactatgattcacagcttctttataaatttgcagaatgttaatttgaagatgtttttatcaggccctctgtaaataatgaaaacaacactgtctgatcttcacctgtcataagtgctccatttgccagagacattaggagggaattaataaggactaaaaatgaggggaaaaatttcaccaaaggcttatgcccagggtgttagcttcatcatccagtggagagtttagagccatgtcagttcctctttgaagtggggtacctttatccctagcaatctgtcaaagggaggctttgtagaactgatggtgattaatgtgcacattcttcatgattccaaagctgctccagcagtggattcctttcccagtaccattgatataatccaagatggatgatacaatgctttcagttccaacagactggaacttatcagtcatatgattaagccaaggatgaagccaacacacatttgaaacctccacagttcttcttgctggggtagctcagcaaggtgctgggcgggccccatccggtgattgaaccggagttttccatttgtccccagaacaagttctgtgcttccggctgcagtgcaggcctgcccacagtaccctgccagcatgtttacgccctgacctggagggaccagctaagggtgagaatgtgactcgctctccatgcccatcccttgcttgtctggttagctgagattggccatgcatgctgtatgtagatggtcctggggtttgggggtctaacggggaaaccctccatgcatggaggcaaacccatgtagactggtgacctgtccacccaacctcaatccatgatgctctgagactggaaagagaagccaccaggcacttttggatgccaacttatgtcaactggcaactcattcacccaacattctgaacctcaatccatcaaactccaagacatacaaagagatgtcactatgtgcttttagactattcctcatctagtgaatcactgatcagagtaaaaatttcatgtaaatagatacatgagtattttaatgcctttatttgggaccctgaactcaaaactatcttcttagggttggattatcctagagtcaaatctgagagaaaacattgtggttgcttatctcatttttcggacatatccaaaagatggtatggttttctagatttgacactgagtgtcctgtggaaaatcactaaaacctcccctcctgggcccatttctccaccagtgttcagaaattagagtgctgccaattggaactggtttgtaggaaggtaatgcccactcaagaagctcccagagctgactcacaatgatgggttttagccaccatcaggcaccctggtcctggcagacaaccacttctctgacagttgtagcctgaaaggtagtttttctttcttttctcacttttatctctaggtttcagggtcagagaaatttcctttcctataaacttttaccatccacatttccactacactacacccggatttattcacaccctgtcttcttgcagaatttctggattataagaatttgttttttgatttgtgatttttatatggaaaatcttacagaactttatagattttacctgatttataaatttgacaagctgcttttacaatagcttccataaacttagaaatgtttcagaaactgggatagaatagaaagatttagaagtggaaaatggaaaatggacagacacaggaagcacaggtgtgtaatgaaggtatccacaatgactggatgcccagcccccattacaggagagacatgctctgaaaggccctcacaattctgcttccaagtctctggaaatttctccggactccagcctccattcagcaatcctactctctctctgttctgtgtctttacttccaattgtatcacctaagtgggtgtatgtgtatatgcatgtgtatatagttgcatttatgtgtatatgtaatatgtgtctgtgtatatgtgtacatgtctatgtcatatttgtgtgtgtgtatatgtgtttatgaatatgtatatgtgtgcatatgttgatgcatgtatatgtatgtgttcatatgttgatgcatgtatatgtatgtgtttatgtctgaatatgtatatgtatgtgcgtgtgtgttgggtatgtatgtatatgtgagtatgtgtatatatgttgatcctggatttgcttctgacagatataaaacaatagaatgacactatttttttaaaaaatctatgaactgcctatgttgttatgagagttctgaggagtgaataaaacagcttttttttttaatcggtgtgctttcatgtgagaagataattcttggacataggttcttaggcaaatttggctgccacttcctgacctctgctaagacaataaaatgatagggaaatattttaaacattttaaaaggctattaactctaagtaagaaagagcattttactactgatttgtaataatgttgaacactatctaccaaataaattctagaagaatcccaaccctaactgcctctgctgctagagagcatggtattcagcattcagtcagctccttgtttctttcactcaatcccagactcaggtcaggaaaaaggagagttgttaacagtagcttagtacagtgcctgccacataattaactctgtataaatattaacttttactctcctcacaggccaaggggatatttcacataagtatatttcccaaactgcttgccatgtgtactcacactgtatctcctcccatggctgggatacactggggggtggggaaactgtgaaaagaagacatcgtctctcattggatgccccctctgtctatgtccctggctgtgaccccagccatcccaaggaggttcagagcctgtgtctactatgagacacctcatctacctctacctccagggattcgcttcagccacccccactgtttcctccctgatggagggcccagctgtggtcactttgccggcttgacttaggagactgaaccagaagagcagagaacactacactggtacttcctacccccctttcacttcaaaatgttctgatccacaatgggactacactacattcagttgtctggatcctgcttaaggcagacagaggaggtccaggaatcggctgggatggggacacccttcctccttctcctaactgtggcctcagtcaccccaaggtcaggaccaccacattcactcccagggcagccaatgctgcagttttggctaccatctttggtttccctcctgatttggctcttagcagacctttagcccactgtcacatctacagattgagagaggaaaataaggtttggttattagaggttcccaaacatccccgtgcatcagaatcacctggagggattctttaaaaaatttgctggccccaccctgagtttcccttttaataggcagagctgactttcagggctgtgactccacactcagaagaagcccacatttggtttactgatttgcagtggccatcttgaaatgcttaacgctttttaaacacggggcatcacatgttcattttgcactgggctccacaaatggtgtagccagtcctgtcagtaggtccagaatggagctgtagaattggcattgccaacaagttcccaggtgagacagatgcagccaccctgggatgcacttcacaaccactcaatgagatcttgcagacctggaaaatcatcctcatagcagtcctctggctccttcccataagattacgtgatgagagttcaaagaggaggcaaggaaggggcttctttattccatgttggtaggaaatgtcctcagcaaaagggttcaggcccgtgtttgcctcagttacggctgtggcagtatcacagaagctgggatgtttttcccggcgatattaacccctgctggaaacctcagaggaagctagatccctgtgaatgcacttcctccagtttgcatgcacaaaaccatttggttaggaaagtgttgttcaggcatgtgtttaccttctttaagaaataaaaaggatttgttttgaaaaattaagccaaaagagagcaaagactagtaaagagaagtgaagtaagggggaaaagatgtaggttctggaacttttaatcaatctgtgattgtttcccttcaagatgttgtcagggccagttttgaggagggtagaaaagaaagatgtttccaggtaagacttcccatgctcttttcacgttgctcaagttctcatttttctgttccacatacattttcactgttatttctgtttctgtgacaactcatgaacacagaactatgataatggtatactaattagtacatcatatcagtttgtaaaagcactagtgccttgtagaatcattttagatgtatttgaataaaatggagtctagtgagggtcatatatttattgtttttgtcactactttatacatgaaacacttattcccaccggtggcatcaacatctttatcacatgaaggatggatttatttacactaagtacagtaagtattttggtgggatggaaaagttgtccagaaagccataatgaacttcaagcaaagtgtcaaccatagttttatctgaattatttttaatgcaggatattgaggaaagtgaaagagttatctactagtgtatccttacctaatagatagtgagcatcagactttcacttaaaaatggaagcaggaatgagtccctgaggcacttagcgatgcccattggcaaatgcagggctccttgtcggtttcattctcaccgtgccttctccatcattgccttttcctgttatatctgttgggttttactgccctctgctggtcatatcgttgaaaccctttcacgtcatggatgtacatgtcttggaacattgctcaaaatggtctttttgtttcagcccgtgtccacgcatactcctccagtcatttgtgtaatagccatattgtttaaatctggtcactacttgttaacaaactcacgcacctgtaattgtctcattgtgccagaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaaggtaactggagcctggccagcaggcgctggccaaaacaagcgaccctcctcttgttgcatgtggcatggtgtggggctcttcggaccttctcttcgtctctcccttatttgatgtttctgtaattcaacctgcatttaccgagtacctgctgaacgcctactctaggaagaggaaggtatggcgagcccagtcgttggctgggagggtccctgcaggccacactccaagtctcagatatctgggaaataaacgcatgcccagaggagccactcctattcccagctgattctttttccctccagcatcctaggaactttatgtatactggatttgggttgcatatttgctagtctgaggtgccacccaattactgctgttacatttctaaagaaaacaagctgaacctactatatgtatgaagacaaccttccagaaccaaatagtgttagtatccaatgacaagagagcactatactgggagtcacaaacctgctctgccactttcaacctgcaggatctccagtgagcgattgagcttcccagagtcccatttcctcctgctgtgaaaactcagaatgataacagtatttaattcattgagtttaatgaactaatccatgtaaagccctcaacgcagcacttcaaatgtaatacgcactcgataatacttgctgtgtaatcttgtgtgcatttcttacctgctccttacgctagttgcatcgtctgtaaaatgatctgctgggaacctcctagggatgaagtgagataacgcatgtgaactgctgaacacgtggaggcacccagtagacgtctgctgctataaatcgtaattataatcccatcatgggattgtagtgaggattaaatgagatggtgaaaaagcctaatgtagtgccttactccataaatattgatggataagctaaggggatttatgagtgaatgcatgcatgaagaaatccagtgataccaatagcaaagtattcctgaggatagtacagaaactctattgttcctctagttctgtgttaatgtgtttagcacctataaagctgttgtcacccatcacccttctattcatttcctataacatgcaaacttattattttatggttctggaggtgagaagtctaaaatgggtccacagggcctctttcccttctggacgtcctagggcacaatcgttttcttgccttttctagcttctagaagctgctgcattccttggctcgaggccccttcctccatcttttaagccaacagtctagcaacatcttctctcctacccctctcttataaggacccttgtaattatattggccccatccagataatccaggaaaatctccccatctcaagaaccataatttaatcacacctgcaaagcccttttcgaaaataacatctttgtagatttgtgggattatgacacagatatctttgggggggcccttattctgtctaccacgagcatgatatagaaagggcctttttgtaaatcccaagtagaatgaacacgctgaaaggtggatctgaattgtattctgttttgtatacaacaggatcttgaatacaatactttgcacagaagagatgttattaaaatgttcattgatttttaattttccttttgtgttatatacctttttatacactttttccctagatctgtcagaggagcctttcgatatctggggaacttggcattcaacattaaaaagcggatccaaagacccaggaatgacaggtgaagtattaattttaaactttattgcatttacttttaaaattattttctaaagttttctttactatcattatattacatgcttgtcaaacattacttgggaaatgctgaaaatgggaggggatgaaactatccttaggctttccacccaaatatgccaatctttgactatatttttttccatttcctttgcaaaggttttcatagttacagtcactctgtctgtgcaactttgtattattttctaacttccattttccagttactctccattatcctttttaagggccaggggtattccacagagtgcataatcatagcttacaaaccaatactaagtcatttgaaattttttgttattgttgtaataagttacactttcaggagcctcttttatgtaattaatttttcaaattattaatagattcacaaaattttggaaagcaagtcaaaggttataaatcccaaacagggaagtgcgtcaaatataacaaggctttccaagaatctggaggtacagtcacctcctgtgctgtatgggacccactaccttacattctgtaaactgtggatggcaggagattttacactgctgtgtgcaaatctcatcagtattgcaagttagtgggttttcacttttgctaacttaaaaaacaaaattgcatttgttaatttgatttgcatttctttcctaccagtatttttcagtgtttctattaatttgctgaacttccccccattgaattgttacttatatcatttcctatttatgtatgccagtgttttttaaattcttatgaactctttatataataaagatgttaactctttttccatattgtttacttacttgcattttctttttttacataattaattttatcactgtctcttctctgtgaattctttcataaaattaatcttcagttcagcgttggatagtcagtcatctgtatgcgtttctttttaatgtcatttcattgtttcaaccttaatttttttaatccatctggaatacatgttatatatggtataaaatgtgtaaattatttgtttggttgttttatatttatatttatattccctttctcattgttttgtaatatctcccatattacattttaaaagcacagtgcatttttaaatgtaatgccctctagtgctgattccttttctaactatatctcactgtatcctgtgaagagccttactccattttccttttccagtttcagctgtcacctgtttcagctatcatttgtttctttgtaaatactcacatcccccactcccctgtccccaacatggccttgttcttgttccttgtctgctttttaagaagtggagggcagagcagattcataggaaaatggtagtctgggtacacatgccccaaggactcctcctttgccttgcaaaatgcactgttatttctttcccttcagtttcctaaagaaagttgtatcctttagggaaagctaactgctgtaacaactccgaaatggggcagtggcttaacctattacaactggatttctccctcactgtcccagtacagtgtggactgtgaggggtgaggaggggcgggagtgtgtgaggggagggaatgctgtcttccacatagtcactaaggggcccagcctaggctccacatatccagtggctccaccatcctcagagccccgggagtcttccaagagtttcagagcctagagagtcttcatgctgggctggtagttaagggaagggggaaagcaaagatcagtaggaaggcattcgtttagttttttttttttaatttttttttttttttttgtgacggagtctcactctgtcacccaggctggagtgcagtggcgcgatctcggctcactgcaagctccgcctcccgggttcatgccattttcctgccttagcctcccaagtagctgggactacaggcacccaccaccacacctggctaattttttgtatttttagtggagacggggtttcactgtgttagccagggtggtttaatttttttttttatttttttttttagttcaggcctagaaatggcttacatcacatctgtccacatttgttgcccagacctcatttctgtggccctcctaactgccagagaggctggaaactgccatgtaggaagtaaaggggaacgattgggtgatcaccaagtcagcctttcctgcattgatggtaggagaatatgcatagtggctggcctgccttctggcatggaatggggtacttgagattcaagtaacttcattgatgcaatagaaacatgaaaacattataatttgtatctctcctggattacagattgcattgaacaagaagggaatgcttctttcaccttctggattctgaaaagttttcccagccatgtagaggggccctttcctgaaacacaaattggtggcaaagccaattattaatatagtctgacgtctcagctaacctgtcagagtctaggcatatgaattgagccgataatcaaaaagcatttgtctttttttgttttgctgggaaggttgttttcttcaggtagcagcagctaagagcatactgtgctgtttcagttttagaagtccggggggacgtcgtagaagtgggaaggaaataacaggatttgaatccccagcaaggattctacaaactgattccatttcttgggctttctctctggcttccaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacatttggtaaaaggcctacagctttgtacttacattgtgccaaaggctgaggaaatgttttctttcgtaattttatgtgtattgtaaaatgttctaccgtactttagtagtttgaagtttttcaagtgcataactatttttgaccagcagatggcgatacgcttcagtattttatgcaattttttttcacttctgaagggaaagtgtattataaaaaaagattttttttttttttataaaacatgctactcttaattttcatgttggtgatgaaattcccagtggtgtttcttaaggttctatcttgtgccatgatgaataaaaagttaagcaaa

SEQ ID NO: 3023 - DNA, 207522 bp, human
ctactctaatcacttccaacgccactatccagcaggacgagatggaggggaatcctagaggaatccttctctagccttcaagtctggggagagcctgccctgttcctggcctggctcacttgggtcgactgttctcatgtacaggatatttgtaagttgggtgtttctaggtcacgtgtatttagttatatgatatgaatgtttattttaatatagtagctcttgatccaggcacaaatatattagaatgtaaagttcatttttatttttaaaagatttttcttcattttgactaatttcagttctgattatgatctcctgcttctttaccagtttaaaggcatcatttttatgtaaataaaatgggtgtgcatgattgtagtaaaacattccgttttgtggttacaggaggaaatgagagaagtgggtggtgcactgtgtatgcatgcgtgtgtgtgtgtgtgtgtgtgtgtgtgtgtgtgtgtgtgtaatttgaatatgacctaaaggatgggggtgtttgttaccccaagacatacttcaaggaattaaaaattgtgttgtactaaagggaagtctttttcactaataacttagaagtattgcagaccatttaggtttttttgttggtcagaagtattatagttaacagatttttttcccccgggagctctttgaatacataatttctttaaaaagatttttaaagactgaccagcaacctgaaaattattttctgctaatcccaagtaaatgtctctgtaatgtaagtgctgctttaaagttatcttatggggtacatatgacccaaagggaaaataacttgtttattaagttgattttctttcttttttcatgattcacaaattgtcaaattcattctgtttgggacagtagaaatgtggaaacatgtaagtgagtaacaattttaaagtgtaaatcaactaaaatgtatatgaaaccctgctgggttcttaggcagtctcttgatatttctaagctacacttctctcttctaggattctgttttgggacatagtcataaacacaaaaggaagatttcagcaccaaattatattcatctttaaaatattggggcccttcagccccttccaaacactggaaaactctctggagtttggtttgccaagacatgggaaactttttttccgaatatttttaagggaaaattatattttagggttatgaatgtagaattataacacagataatttaataagcctctatagctaagtctaggttctctttaaaagatcttgttttttcacccagccccatagttacatatttgagggagtgaaactgagcatacaggatttttggagtggcaggtccatttgaaatcattctcgtccaatgttttcattttctagaaaagggaactggagcccagaggggttaagtgacttgagcaggctactgttggtgatggcaatagtaggagtggccatcatttactgaagatcttctttttctgggtttccttacgttttattttaccctcacaaccaccttgtaaggcagggggccatattccagttttataagtgagaaatctgaagtttgggaagtcctctagctgctcaaagtcaacaggtactaagaggcagagcaagaatccactgattctggatgcctggtggcttctgcctcagggtgttttccattgtaccagacatttcccaggcctaagtagaaatacaagaagcattccttctttatacatgtttacttctaatatatcaagagcatctgtatctaagcaatcaccctggttactcaatcttttggatagtagtctggggtattgggtctccttaccttagtttttctgacaaaaaataatcttcctcctactggatttcataatattccaaaatttgtcttcagtggatgcctcaacatatactttgaaatgtctattttatttagatctgaagaagagtattctttttttttgctctcattcagtgattcattcatttatttattcagtaagtatgttttgaatgcctactatgtgcagatgctattctaggctttggagatacagttctggacagaacagacacaaacccctgccctgatggtactttatttctagagggccaaaggatggccaatacatacacggtaaaaaataaggtaagtgagatggtgataaatacactagaaacaaaaaacaaagaaatttgtttaatgagtggaaggagacaccaggaagatggggtaggacttactcaaaaataactgagaggggaaattggggagtgcttcttatcacattgtcaattcagcaaaaaatgccagtgtctattttgttcagcaaattcctttccaaaaatataagttttcaatcccccaccaatagtaaaatgcttatcctaactctgtctctatccttatgatatcttcccatccaccctttatggaacccattgttatcactattataccaaaaaaaaaaaaaaacaggaataacaggagttatccacatatctaagggtaatacaatttgagagtaagagaagcttagtgcctggcctatttttcccaaacatctaatttatggaggagaatcttgaatctcagaaatattgaaatgttgggaggctggggcaggagagttgcttgagcccaggagtttgagaccagcctgggcaacatagtgagaccctgtctcttaaaaaaaactttttttaattagtaggtgtggtgcccacctggagtcctagcagtttgggaggctgaggcgggagaatcgcttaagcctaggaggtcgaggcttcagtgagccaagatcacattgctgcattccagcctgggtaacagagggagtccccgtctcaaaacaaaacaaaacagaaaaataaatgttcaaatgactaaatgacgacctcagatcaaatggcaaggtgcttattattttatttccagtaaatgatgtgctgagttcccatggtgagctaagtgattgagctggatccaggggcctcagcactgacttcagaggagatggtctgtggcctggaggcacagagaaagaactgatacagacaaagacttctgatcccaacccagtgctccttcccctatcccatgatggggactctttgctgttttccagggtctcacaacggtgagaatggggttcccttttacatttgtacttcccactctgtacttcacgtatgtcataggttaaatgagactacttgagctgacctacgaaccaaaaccactgtatctttatttctatgggaaaatgcatgtggactttgaaatatccagctatcttaacagactttcagaattgaggagtgtctgagttggaaaatataagcaaagatcatttagtgttcagtgaggcaaactctagctgcccagcctctaagatactgactatctcctagagaaaacacaatcctctgcagtcctgaaggaagcatcagatgagatacaaataagtagtaacagtttcttccaaattgtatggggaaagttttcttctcttcactatgaagaaaacctgatgatcataaatagtgaccattttttccacaaagtggcaatttgtgagtgtgtataccagccattctgtagtttgtcatagttcctagggctatggggacctatcacaggattgtagctcatttaatctggattcactactttgtgggctggacttatgtttctattaatggtagtagccagtatagtgtcccaaatgcatgttgaatggcgtggagtggaaggacatgttctcttagctattctgtatgctagcaagtgtcattttcctgtctgccttccataatgggaatgccatggacatttcagttcgtgttctacattcctatcatcacctgattgattggaatgatattgctatataataaggatttcgaacatacataagcattctgaggaaacatgaggttagattgaactgcagtggatgctctaccacagttcaagggcaagattattacagttgccttgacaaccatagctctgcactctctgttttattacatactcttttcctatttgggaatccttttgagaagaaacaaaagaaagaatgtcagtaaggtctcattttcaatttatgaggcttctggaaataatagagtcttatatagctacaaaaacgtctccatttcttaaaatttccccaaacattggaaagtccaggcatatgaaatgaactaaaaataagcttttacttatgtcaaaacacaaatatcatctttactccctatagaagtaattattttgtaaggactgaaagaaaagattacttttctatttttctctagcgtacagctgtgacttctatttttctataaaagggaaatatttttgcctataaattttcattagtatttttacctgtattacagttattcaactgcaaataggtatataagtaaaatagtcttactctaggaaatggctaggttgagagactatcaaacagtgatattttaacaatgtgttacattattaattatcaacacatcctcttttaggtttcctttgtagagcacactagtttgtttgtttgtttgtttgtttgtttgtttgtttttcaagagaaaaggtgacaatatttgggtctttataattgttttttctgtattaaagcaaaaatgtagtataaatgtatactactgtgtgactataaaagtcattgagaaatattattttttattttgtccacttgttattaaatctttcttttcttttctttctctctttctttctttctttctttctttctttctttcttttctttcttcttgagacagggtctcactgtgtcacccaagctacagtgcagtggcatgatctcagcttactgaaacctccacctcctgggttcaagtgatcctcccacctcagcctccccagtagctggcactataggcacccaccagcatgcctggctaatttttgtagagacagagttttgccatgttacccaggctggtctcaaactcctgggctccagccatcctcccctctccgcctcccaaagtgctgggattacagtggctctatggaacaaattcatatgttaataccctaggatgggagttagggaacttttctgtaatgggacagatggtaagtatttcaggcttttgaggctatacagattttgtcacaactactcaactctgatgttgtagctgaaagaagccatagataatatgcaaacgaatggactgggctgtgttaaattaatactgtattcacagaaacagacagtggactggatttgtcccaggggctgtagtttgccaactcctactctgggagaaaaattgttttgcttacttatctgtccacagtctacaggggagtgtagtgcttcaggcaaattgcttcttttataatatatgcctaaactgagcatggtggtgcacgcctgtaatcccagctacttgagagactgaggtgggaggatcacttgtgccccaggagtttgtgtccagcctgggcagcatagagaaaccctcatctcttaaaaaaaaaaaatgtgcctaaaagtccatcttttcactctgacttttgtgtaaaatgtccccattgctaccatattggttctattagagagaaaggcaggggttacacacttttgcaactcattagggagagtagaagcagatattgataataatttccttgttttaaaagctgttagagcacatgaaaaaaaaattcaactactaagatttccttacaccctagctgaactgctcagttagaactgctcttgaatatcaaaggctaacgtgccctgcctgcgtaaggtggcaatataaactgaggtagacactgtgggatgcagccccttggcccccagctggcctccccatccccatggggtctacatagtcacctggcaccaagaaaaacgtgcttttttctttatttttctttgaagtattcactggtgctttgttcaaactgattttagcatcctctttgagtttgaatcagatacttcaaagaaaaatatagaaaaacgaaaacaagtatctatgtatttgttactcagatttagtaactgttaacatttgttcttatttgctttggatatttttatcttttttaaaataaagaatccctttcattgacacaattgtaacccaagaattttccccattctttctaaagaggctattgtcagaggaatctgaattattttccacttattaaaattggttattgagaggcaaaagaatagaaagaatattgattttatagtatatattcagagcatcactggtgcatagtatgaacgatttgatccaatttgtatggttttctgcccatcgaagactgaataatatcatgaatctactcccaagagagacatagagaatgcatcacatctctttcctattgggaatgggatatgaatctaaaagacagtaaatataaaccatcctaattcataatagagagctggatatatttttcaatttcaatggcaactttgaaaagtacattatttttctctgctgcctttaacatactaattgccttgtggtataaatgctttcataaatgctctctcatctgatcttgtgtgatagttacaatagatggtattacagctctctcccaggtaagggtatggatgcactgggatgtctgtacagtgtttggcagtcttggctggacctttgtatcacctaccgagctttgaaaagatactgattctgagcctatccacagaggttcaatccaaccagtctgagcaacagtattcttttcttttcttttctttcttttcttttttttttttttttttttttttttgtgatggagtttcactcttgttgcccagactggagtgcagtggtacagtctcggctcactgcaacctccgcctcctgggttcaagtgattctcctgcctcagcctcctgagtagctgggattacaggcacctgccaccaccatgcccagctaatttttgtatttttttagtagagatggggtttcaccatgttagccaggctggtcttgaactcctgacctgaggtgatctacccacctcggcctcccaaagtgttgtgattacaggcgtgagccactgcgcctggccgggcatcagtattaattgattctactgtactgctgaggttgagaacccccaatggaccgaccagtggttctcaagtagggactatttgcccccgcaaggggacatctgacaatgggacattttttattatcacaactgagaaggggcatcccctggcatctagtgggtagagaccagggatgctgccaaatatcctatagcacccctacaacatagaattatctggccccaaaggtcaataatgcttatattgagtaaccctgatttaagctggactaaagtccctctgactctaagccatattgtttccccagtctcaagttgctagattattcaaattagtcatcctcttattattgctgctaataaaatatattttaattaggttgttcttcaaaacaacatttacaatgactttttagtttatcaggaaccaagtgatcttgtgtcataaccatactgggataggcaaaaatccttatattaaacattttcaattacttttatcagaatacaaaacaagcaagcaaacacacaaaaaacaacacaccatcaaaaagaagaaaagagctatttctcaacataaattgctctgtatgtattatcccagatgagcaatgtgtattatataaagcagtggatttcaaacttgagagtgcattgaagtcacctagagggcttgttaaaatactgattgccggcctcatctccagagtgcctagtcagtaggtccggggtggggttcaaacagttgcattttgaataagtttccagctaagattgacatttctctcctagggactatactttgacaatcattaatgtaaagaatttctctatattagcatttcaaatgaatattaaccctggggaccatctattaaggcctcaagttaatattcctaaaagttaaaaatcattttatcatagtatacaaataacttaaaatatgattcatcaagaaatatagagggcttcctaattctatagttacaatcaggacagccctatagaatcaaaccttttgctcccacttctaagagcagcaagagctagcaacagcaagctttgcttaagaacaagcctagtagttttatgaatgcacagctctctacctgatcggaaatgaagggatgccagttcactgagacatttttaaacgcatctggtcaatgagaaagttgatattttctgtttcctgatgtgtatccttcaaattatacataagtgcttaagtgaaaatgacttgatccaaattcccttagctttggatacattaacatatgctcatggaagggtggatgggatatctaaaattttattgaagtgtattgcctctctataaaataacaaaaccttaactccttaagtaattaaaatatttggcagaagtggctaaataatgttagattcaagtatggaatctgaagcccatttcaggtatttcaagaacaagtcaattattcatccagtctatcagccaaagacacttgacagagagcagtgacatggtgttttgtaaaaggcatttccatagtactagtgctctcattttgttgtcatccagtagaaagaagtgtacacatttgtgaagaaatgcatgaggtaataaaactatttaaaaatccacattttctcaatttagatggacttttcttaaactagtataaagttaggtgttaccatatattttgtaggcataaaaatctaaacctcaaagtggcagaattcaagagtacccatcccttattttctacaggagttcatctgaatcccttgatagtaaagattttctttctttctagaacctgacataattcctagtacataccaagtgataatgacactttcattgaatttacttaaatagctatatgagaggtccatgtatttctatatttcatgaatttcaaattatatatttcagtcccatttaaagttaggatctttataaagaaaatcctgaagaggatccagactatagcgtccaatgtgcaaatttttaattgtgagctagagattgagaataaaggaaagttattggaaaattttccaagaactaagcctttctgttgtgctggtattgatgatatatgtgtcagtcagcaataagactaccaaaggtgaactaaataatccggtgccataaaatgtcttataaaacttaagctgctaagaaaatctaaggattaaaaaatgtacctattcgcatacttctgctgttgtgtgtttaagagcaaactgagaggttgctatggcattacttatgcgtgcatggcaacagagcgaacttagtgattcagcttgataaaagaggaaattagctcaccatttcccctttccccaaatcagagtcagatatccaaatatttcattttgaaatggtatatccatcaacacgttctaatggatgaaagtcagtgggggtgggggtgggggaaatgtcataaggtgaaattcgtatgtcatgtgcttactttagggaatgcaacttgtgtctaaacagtctattcatatctctgcatccttctttccccctgataggatggggtttctcagtggcatctgttgggtgaatatacgatgatgagtaacactttggcaaaagacagcaatttatcagcccgtataactttgttctaatggaagtggatcatcccagaatttgagaaagaaacattgttcagctgtgaaactccaattccctgtgtgtaacagccctccagggaaggagtagattttgtcagcataatatgtgaagtttagtcattatcaactgcacaaagcagaggtcaggcgtgggcgtacatgtgggaggcactattatgaaatcaacccacagccactgccctgctggggtgatccaatacaaacagagccaaatgtcatgaataaatgctgacattttatcacatgattagtttaaatattattttactactgtgctttttcttgtattatttatctttcacatctttattttgtttccggtttcctttctttaaactgataaatgaaaaatagggaagtatgttttgagtcagtactttgaccatgaacacaggaagttaactgaaccctccaccaccagaacaacaacaacaaaaaaactctaaacctgtgaatcttggaatcttagatttgttctgggttgacatgggttttggaatcataattttattaatttattttttaatttacatagagtaaaattgaccttctggagggtatggttctatcagttttgacaaatacataaagttgtgtagccaacatcacaattgtgatacagaagaattctatatataccaccccccacccccacccccaccaccaaatctcttccttctgccttttcgtagtcaacccctcttttcaccctcaggctctggcaaccattgatctgttggaactgtattaatctgaccgtttttctccactctgtccattcatgcaacaaccgtttattgataatctatgctgagctccattttaggtgctagggatgaaatggtgaacaagactgacatagaagtttctatctggaaacaagataatgaacagtagtaaatcagtaattccaaattgtggcaaatgctgtgtaaagaacagaaatatttctgtgacaacagatatctgaaggcgaaatctttttttttttttagacggagtctcactctttctcccaggctggagtgcagtggcgcgatctcggctcactgcaagctccgcttcccgggttcacgccattctcctgcctcagcctcccgagtagctgggactacaggcgcccgccactacgcccggctaattttttatatttttagtagagacggggtttcaccgtgttagccaggatggtctccatctcctgacctcatgatccacccgcctcggcctcccaaactgctgggattacaggcgcgagccactgcacccggccgaaatctattttagacactgttaagaaggttactctgagaaggcagcatgtaatctgaggactggaggaggagaagaagccagctgtgtgaggtgtgggtggggacacatggggtaatcattccaggcggagggaacagtatgtacaaaagagagttgggagtctagtgagtgaagggagcaatgccatgaggtgctgtagatagataggcagagcttcactaaggtgtatgtacttcattgcattgcagtgagaagccattgaattaggatggggctctaatggggatggtttgattgatgttttgagctctgtgtagaaaatctgtggtagaccagcaagaatggatacaggggaccagttgatttgcagccaccatccagttgactgttaatggaagattgggcttggcagcagctgtggagatggagaagggatggatttgaaatatattttagaagtataagcaacaggactaagtgtttaattagatatgggtaaggggctggtgaaggaaaagggggaatcagatgtgactctcaagagcttgcttgagcaactgggtgggtgatgctatttactaacatgagtaaaatattgagagagaaacaagtttgtattggaaaatttaaaagctggggctttggacaggctgaaatagagaaacccattagacatccgtttggagatgtgatgcccctagatggggatatgcatgtagaattcagaggagagctcagagctgaggagagagaaatttgtgtcatcatttaacttttaattattcattatatcataaatatacaatttaaatatattattatattttgatatattaacgttaatataaaatctgtattattaacaatttattcactgatatttattgagggcccaccatgagggagacttagtgaggaaatggaggtatgatggtgagtgcaagcctgtatgatctgagacaggctggcagtagtcacacagatatgtgtaaaatttaagggacctcagtaccacaaaggagagggttctatgaaagggcacgagagggagattcgactaaatctgggtggaggtgagggtcaggaaaggcttccctgcgcattaaagaatgaggaagtgggagaggatatcagattaaggaaagaacatggataaaagtcggtgtggtagaagaccagagattttggttctcagatgcactgtgattccaatttagatgtccagaagggcatcccaggaacatctcaagcacttcaggcaattcacattccttcagcaaatatttgttgagcacctggagtgtgcctgagattctttcaggtgttgggaattcagcaatttatgtgcaaaagttctttccctcatgaagcttgtttctttctggtggagctgattcaggaggttcacaaattccagacacatcttcagaaggattgactaagagatgttggcctgcaacagagccatgaggagtgccagcatttagagctctaaaggagcagaagcagcagcaaagaacctagagcaagtggctagtgaaggaaaaagagagaaaaggggtgcgtatagcaaaagctgggggaggtccagatggcaaaggtaatgaatggccagctaggtttagtggtgctgagggatcaggtagaataaaagcagaatagtcgcccctcagctttataacatggcagcattgggaatttttaccaaaccagttttatctgaatagtggaagtagaaaacagattgagttgcttgaaggagtgtctgggaagtgaaaactgacaaagtgagaagatattggcaattgagaagtgaaaaattgctgatgactttagagaagtttgccttcagttcgggacttcattattttcctgcaggaaagagtcttctgttagtggggagattaattaacttatttttgcccaacttgtctatctaaaaggaagaaagtagtaatacattaaaagattgagactgctgaggatgaaatggggtagtatatgcatgcagtggatgctcactaaaaataagagcttgcatttatagtattttaagtttgccagtctcactctacctgacataaattttcagtaattatcttattaaatgccaagtaagattcaaattattattaactgatactcaagggaggaaatagggtaagttaagcaaattgccctaataacgctgctcataagccatggccctcggagaatttgaatccatattttctgtggtttggacatggtttgtttgtccccatcaaatctcatgttgacatttgacggtcagcatggtgatatcggaggtggggcatagtgggagatgtctgggttacagggatggatccctcataaatggcttggtgctgttctcatggcagtgagggcattctcactcttgacactagattggttctcaggggaattgattagttcctgcaagagtgggttgctagaaagccaggacacccctgggtttggtccctctttgcacatgtctgcttcctctttgaccttctcagacatattttaatggaacacaaaagctctgctgaaatccaagcagatgccagtgccatctatcttgtaaagccagcagaactttgaaccaaaataaacctctgttgtttattaactacccagccttagctattcctttatagcaacacaaaatgaagtaagacaacatctgttgacttggttctatgctgtgtttgctccacttggtgttgtaattttattcccctataagaattgtatctgcttaagtggagactgagtattcatctactttgtatccccatacttaccattgcatttagcccagtgcctggcacaaagtttgcagttgtgagtggcactgatatgaaatttctcagcccttggcccagccttcttgggctgctcttgtttttgaagctccagtttatactcaggagaaatgctttggacttcagacctccaaactgattcatgttacacatatcatcagtggagaaagtgggacagagtaaagggtggagatagctcttgaacacgacagtagaaatggtatgatgttagcagaaaattaatatgtgcacatcttgttgtactgagaaatactctaacattataaggaaacaaataaaactgatcattgctaggtgacgtattatatatatagtatataatgtaaaaatacatatatagtgtatgttgtatataatgtaattgaatattatattgtatattatatgcaatgtacatctatatatctatagatatctacccttgtgtatttttttcctacaaaatgaaatactttcaccatcagagagtaccaagtaggaatattcccaggagggtctgagattgggatgcaatctcggaacccattaaagagcctggggacaggtgggctgtaggagtcctgtggagagcttaaaaggtgtctcttacctcttgaaagaaatgactgtgaggggtgaagtaaactgacccggtgtacgtctccctgggatatattacttactaacttttaggtcttacctaggacacgtatataggaaatgttcctgaatcatgcttggctgcattatttccctgtagtggcaaaagtggcctgcagaagctgtgcattctgggtccttgctagaacccagatgaatgttgcttgggaattggagaggaaaaaaggaaacagagcactcccaaattctttcccaaatctcttggatcgaaacatcttaaattgccatttttatatgtccaagatggtcaaatagtaaccatttcacgcagctcaaccaaaaagtatgatccagctactacagagatgtggacattggaaggccttcttgttggtttcaagtttggccaattggtagacatctggggctgtatattaaggcatcttgattttgtgagccagagcaaaggccttcttgttcctgtctctatttgaatagtatctttggtgagagagtgccagcgtcatctatttattatccttcatgctcagtgactatgtgaaaagaaaggaaaagacctttaaagctggggtgattgtctagacagtcctaaaatagctgctccaggtgcaaaggaagccataaaatgcagacaaagcatgagactcctttggcgaaaatacagtgtgtttgaactctcataggctccctgtaaattatgaagtagaaaatgcccaggagactagattccaataattatgatcattagttattttaaattgccaccacttacttcacacagaggcattctctgtgtgctaaattaaatttaaaatattttaaaaataattatttgaataattcagagctgaaatagtccaggttgaactatttagcaggctgaaacacctgtgcaagctttaattcaaaatatacagagaagtgacttcatttttcactccactgtggaggtcttctaatacaaaacaagaccttcagcaggagtccatgccccctggttctgcaccttcttgccttctactttgtcctgtgcctacccactgcactctcaaggtccaccatgacccggccctgctccactccagccgtgtcctctaggggatcgctgccaccttttacctaggcctccccaccatggcctctgccagagccagctccttgtgggcccatgtggaaatgagacctccagatcccatcctgggaaccaccaaagcctttaagagggaaatcaacagcaaaaagatgaatctgggagttggtgcctaccgggacaataagagacccagttagattaccataaaaaatttagacaacagcaaagacttggaaccaacccagatgtccatcaataatagactggataaagaaaatgtggcacatatacaccatgggatactatgcagccataaaaaagggtgagttcatgtcctttgcagggacatggatgaagctggaaaccatcattctcagcaaactatcacaagaacagaaaaccaaacagcgcatgttctcactcataagtgggagtttaacaatgagaacacatggacatagggaggggaatattacacaccggggcctgtcacggggttgggggctaggggagagaaaacattaggagaaatacctaatgtaggtgacgagttgatgggtacagaaaaccactatggcatgtgtatatccatgtaacaaaactgcacattttgcacatgtaccccagaacttaaaatataataaaaaaatttagacaaggaatacctgcccatttggggacaagctgaattttccaaggcatctgcagaaccagccttgggtgagaagagcaaagtgttgaaaagtggccagtctgtcactgtgtggatcatttctggaactggggtttaagggttggagccagttttgtgcaaagatttttaaagtttttgaagacagagatgtctctgtccaaaccaccctggggaaatcacacacctatcttcagggtagctggcatgcaactacaagattatcaattctataaccccaagacttgcagttttgacttcacgggtgctatggaggacatttcaaaaataccagagcaaagtgctcttctcctgcatgcctgggaccctcatgcaaagcagtgaaaggaaataataatagtggcaaagaaaaagaaactgcgttctttgatatggcctaccaaggctttgccagtggtgatggtaacaaggatgcctgggctgtgtgcaacttcattgaacagagcattaatgtttgtctctgtcaatcatgtgccaagaacatgggctttatatggtcagtgtatgagagccttcactgtgatctgcaaagacagtgaatgaaaccaaaagaggggagtcagttgaagatcctgatccatcccatgtattccaacccttctctcagtggggcctgtattgcctctaccattctgaacagcctgggtttgtgaaaataatggttgcaagaagtgaaaatcatggccaactgcattactagcatgcagactcagctgatctccaactgcagtaaggagagttcctcacacatctgacaacacatgactgactaaattggcatgctttgtttcacaaggctaaagcctgaacaggtggagaagctaaccaaggggttttccatctgtatgacaaaggatgactgcatccctgtggcagggatcacctccagcaacacgggtaatcttgcctatgccattcaccaggtcaccaagtaatgtccctggtgtgagggaacaggtacaacttttctgtcttcagctgctgctaccgtgagcttcacatggaggataagggagggtagatggtggtgagtagatctttttttttttttttaaccacagtgcgtaatactgagtgattgaatgcatttctcagaaaagaacatgtagcgacattgggcagaggcatctgtggctggtatctggaactttgtgactctaaaccaaactctcccccatctttttatctccaacttttccgaaagggtttacatgtgtgagaaactcatagcaccaaaaaacttgtcaattatgccactgcaatatttcagaagctttaactgaagcatcttacggtgtcaggggttcttcatgagaaatagcacacattagaggctttgagagaagacctagttctgtcattaacagtcagcctcaagtttgtcctcccatgatggagcaaccttatcaacagaccatatcgcagaagttgtgttttatgaaaaccaatgagtttgctgccactgcagcaaggaaaataaaaggtgctttttcctctcatttaagaaaaagaaaaggctatctcttctcctttttcatgctattcttttccttatgcacaaagatttttaactatcctagattttcatcccattctactgctggattgaccatctaccctgtattagtccattttcgtgctgctaataaaggcatactggagactgggtaatttataaaggaaagaggtttaattgactcatggttcagcatggttggggaggcctcaggaaacttacaatcatggtggaaggggaagtaaacaagtccttcttcacatggcaggagcaagaagacttgctgagcaaaaggggcaaaagccccttataaaaccatcagatctcgtgagaactcactatcacgagaacaacatgagggtaaccatcccattgactcagttacctcccaccgggtccctcccatgacatgtggggattatgggaactataattcaagctgagatttgggtgggaacacagccaaagtatatcaagccccatcctacttggatttatttaagaataaagaacataattttctaatgacgccatagccttactgttctcagtggagaaggtaactgcaatttatctgagcatcttcttcgatgattgtgtaattgtctcctgctggatgttgcctctgcccagttggacatcctcccttcattgaatatggaaagcagattagtggttgctagatttaagaagatgatgagttgagagggaggtgcaaatagctgtaaaggggtagcaagaggaatccttgtggcaatgaaactgttctgtgccctgactattgtggttgtcacacaaagatacatatgtgataaaattgcatataactaaatacacacacatacacacattcacacacaaatgataacatgtaaaacttgtgaattctaaataagatagttgaatcaatgtcagtttcctggctgtgacattatactatagtcatgaaagatgttacaactgggggaagctgggagaagagtataggagatggctctatattatttcttacaaatgaatgtgaatctaaaattatctcaaaataaaaaagtttagtctaaaatgcattcatcaacatgaacttgagtcaaaccatcttggaagagaggcactttgatgtattcacttcacaaagcatagggatgaagatctctggtagtaccagcaagccaaaacacatgactttctgctgtctgtaccctgtggccctgcactgtggataagggaatgtatgtgtcctctagaacatttttgttttgattgctttgtgtttgtttgcatcaagaaaaaagttgcaaattaatgagaatatatgtgtatatctctaagattcatcagcacccaaaataccagagcaagccagacgtcatagggaagccctgagcagaatctacaaaaaaggattgaataatttgattattcagagaaagcatatttctaggggatggatctaagagtagcttgatcatgaaaatggtgggaaaaatatagcggcaagagggtcactaggtggaagtaatatgtctagtttttttgagaaccacacttgagctaaacctttaaaatccaatcaaagaatgaaaatgaatagattagtgtgaggaggtaaacgtatcatttgaaaatagccttggacttgggtactttgctctcattgatttagcaatatgccccattttgttagttgtttatacagagcttcacagttttaaagtaagcatagccagttatgtctatgatttctctgtattcagttatatttgcccaggaaagtctaatcaacaaacagttatcagttatcttacccatgacaacattgtgagatgttgtgagatgccaagaatagaccacaagagcctctttgtgatggtctcagacctccaaaaccaataaagaagaataacacagtaaatcagtaacatatctatagcatttgaattcacatagagaatttgtttagtgggcctgactaaatgccttcactttgcagcttacaggggcttgtgtttattctgcctatcttaagcatggttttactcatttagtgggagcagttggctcatgtcttttacctatttcatttactaactctaagggagtcaagaagaaacttcccctttgcgctctaaagggtcactgaaaatatactggcatgaggcagattgattaacagaagaaaaggcatacacgtttatttaacttgtatacacagaaaccttcggaatgaatacctaacatacaggggaaaatggacagttgtccatttttatgcttaggttcaacaatatgtggacagccatgtagaaatgtgattggacagaaagggtctgatttaaatgctaatggactgagtaggggaaacccagtaaggcctgtccatctagattattcttggcctctctgagaagcatttcttccttcttgatgtgagagaggaccctgtctggaacaggagtcttaggatctacagtcaaaccagttaggtcagatcatttcttcatggccagtttttacgtagaatatttttaggttttatgactgactttcaggaaaaggggttctgatttgtatgatctatcttggggaaaagggattctagtttccatggctatccttagggcaaaatgggactgagaggaggacaggagaaggtcaggagaaacttttgcttctgaagctgctcagcagcagtcttcattttgagatactgttttctgagccccaacaaaattcttctaacatgctgaacatgtgccaggcactattctaacatccatgagaatagagaggaaaggaagagagggatcctgcagctttccagttgggtgctgagatgatgacaccattcactgggtgactccaattgatttgctaaatctattctctgcattttgactctgccaccttcttaccgtgggtctatgagcaagtttctccactgttctattaaatatctgtgaaatgggagcaatggtggtgttgtgatgattagatgagtaaacacatctagagcatagagctctatgcctggcacaaacgaagccctcagttaatatttgcgggatgtgtaaaagattgtgtttatctggttttcaagaccatcctcctcagagacgccaaggagatagttgctatgcttcctggcgttctaagacccacatgcatctcgttaacccttgagaaatctagtgggctctcagaatttttaaaattatatattaataaattataattgtatttatttggtgaaaagtgatgttatgaattttgaatacaatgtggaatgattaaatcgagctgattaacatatacatcccaaatatttaatctttttgtgattagaacatttgaaatttactctctgtaattatgaaatgtatggtactcagttattagctatattcaacatgctgtgcagcagatctcaaaaaaaactcaaatgtcttcctcgtttctgaggctttgcaccctttaaccccattgctgacatcccccagcctcaccagcttggtggaacaccttgagatgtgcttataacagtagctgggatgtagtcagtgctaaaaaattgttagcttttgctgttgtgcatgtagttgttgttgttattgtaaaatggtggctggaatccacttgcgaatatgcagtcatgttacaaatgaggatgtttctgtcaataatggaccacatagacaacagtggtctcataagattataataccatattgttactctacctttctatgtttagatatgtttagatacacaaatactattgtgttacacttacctacagtattcagtatagtaacatgctgtacaggtctgtattacaggagcaataggctgtaccatctagcctaggtgtgtagtaggtttgtgtaagtacatgctatgatgttcacttcgtggtccactaggtcactagtaagcctttctgtacctttttgtatgtaactctttgtatgtctgccacactgtatgataatgcttaggtgtttgtataaatacactctatgatgttcacaatgacagttttctcaggatatatcctcatcattgacacgtgattgtactttaacagagatacaattcttgaacatcttgttagaaggagatgggagaaataacagaaataaaggtagtgtcttgcatttttcaattattaaactaatcaattcattaaaacagctgtcattaattacttaaagtcaggcaggtgagggaaagaatggcttgacgttttctaatttatcactctttcctgttgcccctgactaaacaaactgtggctgctgctacagctaagtatgtcaaactgttgaatacccaagccaggcttttgaaatattgaaaaatgactactcccatgttgatccataaaatctttaccatcttacagagagctgatgaatcatctctctagcaccaggttcacgaacttcccataatgatctcataactctggtgccaacattgcctgggctcggtaaccttcatgaaatttattattaaagtttgaaattcgttcttgtgtaggtgtaatgggattagtcgaattgcaaagatgatagggctgctatttacagaaaaagctcctttctaacacttgccttttctaatgagtcaccataatacctctgtaattattacattgattgtcttttgcagaattagatttttttgtaactctgggagattttgattagaacattcagttattatgtctgaagagtgatctagctacatgagttaatagtctttggattgaatgtgttgaaaattaaattgaaattagaatttttgtacatcaaggcttcaggtgccctttagcaactttgggagacgaagatatctccacactcagaaataggttttactgaaaagtttttggtggtgaaaaaaataaaatacctcaaacaagctgcagaaacaaagattttcccagaaattctcaacaactatgaggatagactagaagttctgcaagggcagacacttgtacatcattaatccttgacagaattggtaggaaacctttggattttagccagtgtggcagagtaccctgagacgtgacagaaaagagtggtggtggtcaggcactgaattcagttaactgttactggtttctaagaactcatcatgcattcacatagaatctttgtcaacttcacaaaaatcctagtagagtgagatttttatccccattttaaaagtgagccatgtaggtaactcgctcccaaattactcaataaatgctgcatctgaattagaatctatcggaggctggctcccccatctggacttcagcatgacttcattaatgttccctaccctctccagccctatgctggtccactagtcactggtgtaccttcctataccataactgtatctcctgtacagaataataatgctcagatgtttggagatgtatgtgcaaagttcagaaatgactttagacaacattttaccttccttcacgatgaaatgagaaaaattaacaccaatctaataccaaaacaaaataatttaccacaaaagtgattatcttgtaatgtgaaggattcaatatgaactatcactgaatatggtttgaaagggttccatattaatgcatgtcagagaagcaggccagatgctgactaaatcagcaatgtctttgttgatgctttttggcctgtaaagtacctgtaaagtacctgtaaagtacctttaaaaccctgtaaagtatcttgtaatggtgtagaataatcaaagacttgggataacttctgtggtcacaaagcctgttgtaaatgaataaccaggacttttgttttgataaatctaatctacattcctctgtagcacacgattatactcaaaagcaggttatgattgcccccaaattcctaggtaccattgtgaagtcaggctcagacctgactttttgatatctttttacctgagcccctacatccctggcaccaatagaggacatggtaatagtcactaaatgaacccataatatctgtgtttaggaggagtgacattttttggcttattgctggtattcaaatgcctctttactcacctatctttgacaacatccctctggattatggtactcacttagtatgcccttcccataggtgttcaacattccaaaattatttgatactttgcaaaacatccagcaacatcaaatattttccaatctttaaagggctgaatttagtttggccttagaacaaaacaatctgattgaagtaatgcatactaaaaagtgaatgacgaatatgttttgttttgtattatttgaaattttagacaaacttttcccttacaagtctttaaaacgaaatgtgtgagcaagattttcttttctttcttagcaggaatgaatgtcagatgtccttttcttacctcaacttctctttactaccccattcagaaacttgacacctttctcctgaagtgttgatgacatgtaatctaaagaatatcttggacatttaggaaaattaaacacataggaaacttttttttccttcctagcatgaagttttctatttttccttcctttgggtgggacaaaacattagtaacttatacagtgctactccctaatgtaaaattataaagtcatttgtatttagggatgtaggggttttttttagatttaatgtgtacttatcatgaaatcagtggatgattgggtcaagtctatgacattatttaactaagcggtctgccatggcattatttaatgaaataatttttaaaaatgcttttattttactgtaagccattgaagaaaaattttactcaaagtttaacaagtgtttagttcatgatgaggcatttgcagctgtaagcaatcatattactgtgccatcatttagttttatggaaaatgaaaacgtttacttaaggctgttaaaagtttgttttttaatagtgcctcctaagcaatacaggctaccacttacttttgacatcgagggaaaaagagttactcagattcattcaagctttagttatattgatttctacgatgggtttttcttagcatgtcaagtgattcctgttttatagtgaaggcattactttgagtcaatatcaaagtacatgatcccctcaaccttcaactgtgtttcctgctttgtgaggtgccaacaatagcaagaagggataatttaaattccgctttccataggaaaaaaaaaaaatcccagctgggcgcgatggctcacgcctgtaatcccagcactttgggaggccaaggcgggtggatcacctgagatcgggagttcaagaccagcctgaccaacatggagaaatcctttttctactaaaactacaaaattagctgggcgtggtggtgcatgcctgtaatcccagctacttgggaggctgaggcaggagaattggttgaacccaggaggcggaggttgcagtgagccgagatcatgccattgcactccagcctgggcaacaaaagcgaaactccatctcaaaaaaaaaaaaaagaaagaaagaaagaaagaaaaagaaaaattcctttggtaaaacattatatactctctaaacagggattctcttcacaccattttgaattgcgtgcttcttgccttgttgcacagattaaactgggaaacaattttatgtgtagcagggtttctaaacctcagctctattgacatttgggggcagatcattcttttttgtgaggggctgtcctgtgcattgcagaatgttgagcaggatgcctgatttctagccgctagatgccagtagcaccttcccctcagttgagacaaccaaaaatgtttccagacatccctaaatgtcttattgggtgtgaagtcatcctcagttgagagctactaatctagcaaattagcatatttctagcaaaatagcataactacttttaaaaataagtttggtctaggatgtttttctctttcaaatgaggtatattttagataattttcacttcaataataaataataattacagaaaccaaaatacaggtttcagatgttatctgtgtaggaatgtgaataacagtgacaacattttctgaaagaaaaatttgtatgtagagactaacaaaggtgttttttctcatttgtgcatttaattatgatacaataatttgattatatttagtggtaaatgaataatcttcattagaaaattatacaaagaaatgaacaattcagaaaaaaataatagctttcatattttgtcctgtattattgaagtaagcatgttgcacccacttgatatgcttattattcttaaaaatttcccacatttcttggtaaatttgagtaattcctgtattgtcagtgaatacattataattttaatagtgattgataagcattttgatctctagatttattatcattaaacaatgcagtcacacactttaaacagaattagtagaaacattttcttatttttcttatttggaacatttatcagactaaagaattttaagtgtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagtcgagattgcgccactgcagtccgcagtccggcctgggcgacagagcaagactccgtctcaaaagaattttaagtgaaaccaaccactactttgtgctgcatatatgagagcacttcaaaaagttcatgggacaaattaaatgaaaagataagaaataataaatagaaactttctcagcatcaagctcaagacacttttttgatcaatgatacccgccattttagtccatctctaaagaactaagggtcctgggaattttaccatgtcattgcaatcttttttattttattaactgaagacaaatgggtgccctttagattttttttttttttaagattagtaagcaaaaagaagtcagaaggagccaaatcaggactggaaggtgagtgcttagtaatttcccatagagactctcacaaaattgcccttgtttgataagaggagtgatccaggagcattgttgtagtcatttttctgctaaagctttggctaactttctcaaaatactctcatagtaaacagatgttaattgagttttggccctctaaaaagtcaacaaacaaaatgccttgagcatcccaaaacgctgttgccatgacctttgctcttgaccagtctgcttttactttgactggaccacttcctcttggtagccactgctttgattgtgctttgtcttcaggatggtactgggaaagccatgttttatttcctgttacaattctttgaagaaatgcttcaggatcttggtcccacttgtgaaaaatttccttcaaaagctctgctcttgtctgcagctgatctaagtgcaatggttttggtaactttagggcgtaaagtttgcttgactttaatttttcagtcagaattgtgtaagctgaaccaattgagatgtctatggtgttggctattgtttctgctgttaatcattggtcctcttcgattagagcatgaacaagatgaatttttttcctcacaaattgatatggatggcctgctgctgtgggcttcatcttcaatatcatcccttcttcttttttctttttttttttttttttttttgaaatgggggttttcactcttgtcaccagactggagggcaatggtgcgatctcggctcactgcaacctctgcctcccgggttcaagcaattctcctgcctcagcctcctgagtagctgggattacagctgcccaccaccaagcccagctaatttttgtatttttagtagagacagggtttcaccatgttggccaggctggcctcaaacttctgacctcaggtgatctgtgcacctcagcatcccaaagtgctgggattacaggcgtgagccaccacactcagccctcatcacttcttaaaatgagtttttcatttgcaaactgttgatatctttgggggactgtcctcataaacttttaataaagcatcagtgatttcaccattcttccacccaatcttcaccataaatttgatgtttgttcttgcttcaattttagcagaattcatgtttccctgacaggggctcttttcaaactgatgtcttatctttcttagtgcctcaaactagatcttgttaaggcaggttataacaagttagtaagaatttattttggtgtaatatacatttgaaatttttgtatagttctttcataatgcatattttctatgaactttttgaagtcccctcatactttctctttgttcattttactagcgtgtttgactaagataagttttaaggacaaaagtatgacttgtatggtttttataattaagtatttctgtaatattccacattattgccagttctgtccagggagaagtttttccagctcattcctgaataattgttacaaaccattcacattcatctaaggtatttctgataactaatatcaaaaccttcagaattcagggtatactatgcttagcaatattacttggagcttctattcaaacagcagaaacagattgttttcctttatccaaaatataatataagttacatcatgtaaagcagtgataacattttgggttaaaccccaaatcacaacttctgggtgagaatccttcaaattttaatataatcagcagaagcattctagtagagtttaaaaatgtttatacctaagaaatagtcactccagatttgtcaatctattgtgcttaaatatgaaaaatgtgtacatacaacacttaggcaaaattcacagaatgagttctgtatgaatataacattgtggacaattttatcctatttaccacatcaattgatcaaataagtttatgtgaatgtatgctatcttggaaggccaaggcaggtggatcacctgaggtcaggagttcaaaaccagcctggccaacatggtgaaaccccgtctctactaaaaatataaaaaattagccaggcatggtggtgcatgcctataatcccagctacttgggaggctgaggcaggagaattgcttgaacctgggaggcagaggttgcagtgagctgaggtcatgccattgcactccagcctggacaacaagagtgaaactctgtctcaaaaaagaaaaatatgctatcagtgtttttcactggggaaattttgtacctccccccaggacacatttgccaatgtctggagacttttgtggtcacatttgggaggggtgatttgctactggccaaggatgctgctaaacatcccacagtttagaggacagcaacacccaccacaaaaacaagtgatctcgcccaaatagcaagaatgccaagattgagaaactctgtactgtagagatgatcaataaaatgttttctttattctccagtgattttcttgagatgttcttcagatttgggacattttgcaaatgttaacttgcatcactgtatctgtgggtatgccaacagtcttactcacatatgtcacgtcacagcagaaagaaaagataatctcttaattgtcattttatcttattttccagagcgccactttaactgcaatttcttcacaaagatttctcaccaggaaactggcagctgtaatatttatgatccgtttcttttttatttttaatttgttttaatttttaatgtttgtgggtacatagtaggtgtatattaatgatgaaagtgcgccattcctgtggcaaatgtttttgaatttttgatgcagacttgttttgaacatctgctttgtgctttatttgtactctttagaatcttttctttttgaataatatgaaaattgctataatggctgtggctaaactatgcatttttggtgtgatggacagttacaacttcttttaacacaggcttatttttaataggataacattgaatttgaaaatgtgtgcgtatatgtgtgtggctgttgaagttctgggagctcagatctgagagccagcaaatttagatgtattattttattcaatcattcattttattgagaagttacttgtgagtagcatttattgcactatttttatattcaaaatattactatttttagaaaaggtacttattttgaaaaatgttcacttttcctgctttttatactaacttttacatcaaaataccactgtgcaactaaatttgtgcccaattgaacaaatttttaaataaattagaactacaggccaaattgttacattagaaaacacttagaaattgttaccatttcttctattttgttgcttccagtaaatttccttcatggcacaatttacaaaaagtaataaatattgaacatgtatttaacattaaaaacaccgcttacatccatatacagttatggctcttaaaatgcagacttttgtattgtagcagtctatgagctgtctcttttgcaaaatatttttctttgtagtaacagctttatttcaatgttggctgactatatcttttattcagggactatttgctgaagtatttgcaactaggggcattttggatgtttaatgggaacaaggagaccttatatataattagaattattccataaggtctgagtgtgtgtatgcatgtgtgtatgcatgtgtgtatatgtaggtgtatgtgtatatatatacacatatatgtgtttgcgtttatatatgtgtgtgtgtgtatattatacacctgtgtgtgtgtgtgtgtgtgtgtgtgtgtgtgtgtgtgtgtgtgtaaagagatattttctttgaattgagcaaaacacacatctcccttttcttcattagggcacaagattttttcctattcctttaactattctgttctgataccataaaagccattcacaataggttgtaggtggctgtaatttataatcatttcagtagtaaaattcatcatccctgggattattccctctcttgtcacacgttaattcctggctccagattgtctttgctgtgacttcatctgtaaagatttgcttcccttttcaatgtccgccttttgctttctggagatataacctttgtttctcaagatctgaatgcatggaatatgaaactttccccaactccaccagcacaagtgacctctttctctcaaccctgcagttgtttatccattaaaattaccaattaaatttccttttatacatgtcttgtctcccactaattggtagccgctgaggtctgagacagcacagcccatattctttaacttgaccctgaggagatgccggtctagcttttatttaggttagggttggcatctgaggaactgtgttcctattgcatgctgcagtcatgagctaacagaacgcttaaatcaaaagctgtcaacctaacatgaagaggcatccacagagctgtctctgagaagctttattctttgactcacatctccaatgtgagtaatgtggttgaaacctagcaaagtcaaaatttacttgaagtgatatggtggatccggtgctgtagatgatgattgtagacctgaaaaaaagaagttacgcgaataacatctgcttttctgtgtgatattttcccccccagctgtttagagaattagaaattgctctgtcaagggtttgtttacaaaagcctggccaatttcaaaatgaagctgcctttgagttgtccctgtttcatctcactgtttggaaaataaatctgaaccattaagatgtaaatacatcaagttagaagccaaaggcagtgaaaaccaagtaaaagcaagaaatgtaccacgatttaagtattctcctgggaggaaaaatatacatggtaataatttttgtatcttataattttattattaaattaaggggagagaaatttgaaatcagcataatatctattttgtgtagtatttaacactgtgatgtatattgacaattgataatgaatcaaaatatgtgcgggtaactgtatgttcattaaattagagtttggtaatgagatagaaagagagaatgagaggggtacaggtgtaagcagcagttctcaaagtgtaatcccggaaccatcagcagctgcatcaccctgaaacattagaaatgcaaattctcaggccctgttgaagacctactgaatcagaaactctggggatggggcccagtaatctgtgttttaacaagccctccagaggattctgatgcatactccagtttaagaagcacttctatgtagatggatggatggttggatggctggcaagatatgtgggtacaatgacacatacatatgtaagtacaagtataggtatgggtataaatacaaatatgaatacaaatacagatataaatacagatattttgagagagagatatatagatagacatagatatagatatagatatagatatagaaatgtggagttaccatcacaggacttttttagaggagcaaattatttccttttacttattatatgattgaataaaagctgttcttttctctaggcaatgggtctatcatttataaactgagaaaatctactggtggtccatttgttgaaccattttccattaggttcacttaaagtgtttgttccatcaagtctgccacctgggtggtttccttcactgcaaaactggtttgctcttccctcccctctgtcttcttggcagctgctgtctgccctggttcttatccattggtagatctgattgctttggggactggatcaacagttgaatcctcacaggattttgaagccaacaatatcctacatattggtccatttttcagaatttcttcatttgtgttttatccttccatttttctttctaagcatatataatttatttagattggtgcagaagtaattgcggttttgccatggaaagtaatggcaaaaaccgtaattacttttgtaccaacctaataatttcagccaactattcatatgcagcactgtttacaatggggatgaataagtaacagctaaatatctgataaaaggggatgttttaaatatagtagattgcaaaataatatgatactttttgagaagaaaatttcaatatgcaaaaaatataggggataatattcattaagacataatcaatgattgttggattatggatgattttaattttactcattttgcttatttttatatttatgattacattagttgtaagctcaaattgctgttataagcaaagataatgcagatttatatgtatatatataaaacagtaaaataaattgattgtattttttatcttcttcctttccccactatgctatgaacttaaagtccagcaattatgccagctgtatctattcatcatttttcacattaaaagcaatattgctggatagtagaattaaatgacaactctgcttttggaaatgacaggaagtctgctgtaaatagataattgatgtagacgttaaagccaaatagaatttccatttatggagaagggaatatttaagggtatgtggctataagaaaatatttccttttgcttttaacacaagatgtaacatgacttgtcatgctcaggatgtgttttgaagtggataatggcactttccctaatatttggaggcaccgggcttgatcctcttttgaaggccttcctttgaagataaacatagacattggttttagcttaattctccatccctaaaattccttcctgctctaaaattctataattccataacaacagtgtataagcaataattatgaaatggaaaaatgagccattctacttgccatccttcatgtaaagctgtactatggaatcctgctctaaggtggggccggtgtcatttctccaagcagtatgatgccctggaagaaagcaatgtacagtggcctgtgattctggaccttggatcactttgatgcccttggcttataataaaagcaaaatccatttaaaccaccttaaataattaggaattttagaggctcatgtcaccaaaatccataagtatgtagggtttcatccagtgacttgacctttttcctgcagtgctcttcattttatgtccctctaagtgtcacctctaggctgatagcaacagaacctgtggcagtttggggataaatatgacgatgtctaagctagtgtttctcaactgtgggtgaccaccccaggagacatctggcaaagtcgggaaacatttttggttgtcacaagtggagaggtgctactggcatcaagtgagtaaaagccagggatgcttctaaacatcttcggtgtgcaggacagccccaccagagagaatgatccaacccaaaatgtcaatagtgctgagtaactctggcatagaagaagaaaggtttcctctgcctataactcacttacattctaggaaacatttccaaaggcttccagccacatttccctcacatgctggtgcctatagtacaaaaggctttaggcctgggttctgagatcaatcgtgggtggggaacagtattaccaagatcagctcactgagccccaaaatgcatgtggcatgtccatgctatacactgtcaaccagaacaataaatacccgtcatataatagtactattttgttattagcaagagaggggaattcaggcatcattactattcagccctaaaaaagaagaaattcctgttatttgcaacaacatggatgaatctggaggacactgtgttcaatgaaataagccaggcacagaaagcaaagacaaatgctgcactttctcacttacatgtggaatctaaaaaagttgaactcatagatgcagagactaaaatggtgctttccagaacctgggggtggggctgagggttggagagatgttggtcaaaggatgcaatattttacttagacaaaaggaataaattcaagagatctattgtacaacatggttactataattaacagcaatgtattttattttgaaaatcactaacagagtagattttaagtattctcaccacaaaaagtgacagctatgtaggtaatgcatatgttaattggcttaatgaagacatttcacaattgtatatgtatgtcaggacatcatcttgtacacaataaatatgtacaatttttatttgttaattttttaaaaatcctgtgaactgctaaagaataaacatactctccaaacctttctgtgggatttggggaagtgtttcttcacctgtatttttttctgggttatctgcattaatatctttctagaaaaggatatgactggaagtggcttattgacaatctggattttcccaagagaaattaccttcaaccaggagagatgactactttaaagaagggctttgcagaacctatgtctttactgagtcattcagcaatccaagtgagagatgatgatagcttggaccaagatggaaccattgaaattatgagaagaggtcagattctgacatattttgaaggtacagccaacaagatttactgacagattgactatggattgtgaaatggacccattggtgatagagagtggaagttttggcctgatctactggaaaaattgagttgctattgacttagatggggaacactatagagaagaatattgagaagaagttgaagaactcagggaattcaagaaaaaaatgtcctagttggagatataaactaggtaactatcagtgcatagatgtcatttaaagatacaaggttggttaaaatcaccaaagaggaattgcagatgaaaaataaaggagattcaagaacagagccatggtgaattccaacattatgttacattcagagaggtgatagacactcaaaagagtgtggcatccacaaagcttattctcacatttgttaattgacgtcaaaaacatggctggttgttttgtttttgtttttaacttaagctctttcaaattctggaatttgggtatctttccctaaaagagaaaaaacagccttcgtcttttgagcaagccaggaagcctcttcctgccgtcaattattaattttcttaacatccacttatcatctaaaacaggggttcccgacccccgggccgcagaccagtaccagtccatggcctattaagaatgggactgcacagcaggagtgagcattactgcctgtgctccgccgcccgtcagatcagtggtggcattcattagagtctcataagagcgctaactctattgtgaactgcgcaggtgagggatcttggttgcaagctccttatgagaatctaactaatgcctgattatctgaagtggaacagtttcatgctgaaaccatccccgccgcactgtctgtggaaaagttgtcttccacaaaaccggtccctggtgccaaaaatggctggggtcagctagtctaaaacatagcgaagctatgggctaaggaacttaccttgcttttgtttttccatctgggcaaatggttcatcctgcccctccagggtgagaaatgcctgtccctttctctcaatctgtatatgcaggctaacaaaagatatttttcagagatgatttatttcaccagaacgattattgataatttgcatttatggacacttggtgatcttatcaatatttttatgttttctcttttttagcttttaagttcaagggtacatgtgcaggtttgttacatggataaacttgtatcatggggttttgttgtacagattatttcctcacccgggtattaatcctagtacccattagttatttttcctgttcctctccctcctcccaccctctaccttctgagaggtccccagtgtgtgttgttcccctccatgtgtccatgtgttctcatcatttagctcccacttataagtgagaacatgcagtatttagttttctgttcctgtgttagtttgctaaggatatataccatggaatagcatgcagccataaaaaagaatgagatcatatcttttgcagggacatggatggaggtggaggccattatccttagcaaaatgttttccctttttgtgggacattatcttgaatttctcagaaatcaaccacaaatttaaagagtgaacactggatatctattgcaaatttttctaaaataacatacataaatctagctatgagaaaaacagctttcaatttttattttgcataagagtttcttggaaagtttcttaaaatgcagattccttgacatcagaagttctgttatgatcaatttgggactggactccagctggtccatttcatccatcccacaccattatctgattacagggcagaggatccacaagctgttcaggagctcatataaatttctgcaagctgaaaaggaaattattgactcccaaagtaatgatgtaaatactcacctatatatctaaaaacatagcaagtgccaatttcattgtcaactagtatttttaacaatctcatcacatgtaaaaacaattcgtaatgtacattttgttctcttaacaagtattcctgaacacgcacaataattacttaaaaaatcacagccaaacgagaatccgatgaattacttattgccaaatcatgtcaaaatcaaaattgtaaaaattcttgataatacaaggagatgaacctcaaaagtaagtgcttaaaatagctcagagctcctggaactcacttttaacaaaaagtaaccccaggtgattctgtatttgatcttttgcccacacttggagaatctaaggtctgtgtggggatgcttcatatcatcaaagcgtacttgtcttccttcaatcatttatcaaaattcttagcacctaaacctagcatcttagcatgatgctagattataaaaatacagtgataaacaatctttctaattgtgaagcctccagcccagtaagagagacagccaatagacaaatgcacaaacaagtaaaatcaattataggttgagataagtgctaagaagaaaatcaacagtgtgttgagatcaagaagccaggaaacattaatatcagattggggaagtcaaggaaggctttttgagcagatgatatttaagcagagaccagaaaaaggaggagccagccctgtgactgacgccttaggaaagcagttcaagcaaaggaaacagcatagacagaaacccctaatcaggacccagcttgccttgtccatgagtgtttgaagaacaggaggaaagagaggaggcatgaaaggtgaggctaaggaagttggtccagaccctttgacataggcaagttctatgtggatggattttattctaagtgcaatggaagcccgttgatgatctttgcttgcttgtttgttgttatttttttaaggttggatatggtgtggtactttgtgtagcagttgaacacataactcgagccagactgcccaggcaggaattctggctttgcctcttataggcagagtaaagttgagcatgttctaacctctcttcactcacttcctcattgtaaaatggaagtaataacagtacctacctcttaaggttgtttagcagatttaataaatatgtgatatgctctatgtatgtctcaaaatgaagaattgtctttaagaagattactgttatttcccccatgaacaaattgagtaaggacaagagcagatggctaggttgtctggaaggctgctaaatttgtttgggagaaatgtgatgggggctggaattggagtgatgaaagtaaagatggagaggaggggtcagattcctgatttattttggatgcagagttgacagaagttggtaatagattaaaagtagaacatgcagtgaagaggagaataaagaaaatgacttagttcctggctcaactaactgggtggataaaaataatcattatttaataataataataatcatcatcatcatccacaacaacactgattaagcgagtgctgcataccaggcaggcattgtgataaatgctttgtaaacacctctaaagatgtgggaggctaggataccaaaacatttgccagaagagaaagtcaagagttcattagtggataagggaagtttgagatgaccctgagacaccaggtagaagggtcaagaaggcagctggatagtcagctccataaacacaaagatgattggtttggagatagtatttgagagtcctgaactttgcaatgggatttaccaccatgtttttttgtataatggcttgggctgttacgataatatttttgtcttttttggtctaattctttttagttcaagacctgctttgtaaaaaccttagtgtcaatcaaattttcagtcagttctccatagtgtaaaataaagtattgcattaacatttctgactctgaaacaactctactgaactaaactacttaatctgaagtttgtgttgtgtgtgtctgaaacatttcctcatcaaaattcaaagaaactttagttcaagttatggcctgaaatcaacagaattatattaattcatatggatatagaaaatcatttatttacagtatttaaattgacatttaaacagtttttccaatcccacacagttagtggcataaggtcttgagaaagcatgaaacattttttttttatcagcctcatatttcgttgagcttgccaaacacagttcattttccatagaaatttgcaaacctgagtagtggccaaattttcagagtcgctgaatgtaagccaatgaataaaattgttaaaccctttgatttccccccacttttttcccttaaaaagtaacatagcgtgtgcctgagttttattttttgacatctattacccacaacactcgagtgtgtttcagaatcagcctgtatggacatttcagtacaaaatgaacacagccggcgctttggggaacgttcatttgcagctttgttatccttagacaggaagccttctcctccacactttgatcgacatttttcagaaggcaatggcatcaacctttaaaaatggatactttcaagggtttaaaggttgagatttttaagacaaacccagaataggcaaaagttacatattggccaaaaatgtgactccagaaaccatgtgttgtagctaactggggccactagcaaatctttcttttgagacttctgtcctgttagcagaatgcactgatcgaactaaaccttgagcatgacacaggatagaactagttattgttaagaaaataatgttcaagggcattggtccattgtacccaggaatagtttggaaagatgaaggatatggaaacaaacaagcaaaaaaagaagaattaaaattaataattaaaatgtcagtaactgtaatgtatttctcttagtggatgataaaattacataagaatgtcgaccttttctttaacccaatgaccatagtggcagtctcttcattggactgcttccttcattggcatcgccttctaatttcatttttacttatgatagtgaaaatgcacaatggcccctggaggcaataccctaatttttttgtttaagtgctcaaaaaagtatatcctttccctgcgaaaaaggcagagggtcacaattaattactgaatttcagctatgaaaaacccactgaactgtgagagtccattgtgcttaagttgcatttaatctctttggagatgccaactacctgatatacaagagcaactgtaagttccaaaaaaactctcacagataggaaccatagacatggagagaagggagccactactcagaaatgaaggagttggggaggagtggggctgaaccatgaagccagaacagaatttttgtcagtggcctagaagcaaagctgagaagaagggtctgaatgtgctggggaccagtggttgtagctccacactgagatggaagcctcctctcactgtagcttctgccaaaacacataggtaaatttgcaggagtaatggtgacctcggaagagcctggtgtaattggggaatgattgttgcaagggaataagagccagtatttcatttggtcttttgtgtctggcatttttcactcagtataatgtccccagggttcatccatgttgtagtatttatcagtacttcatccctttttgtggctgaataatattctattgtagggatatgacacattttgtttattccttcatctgttgatggattatttgggttgttttgactgtttgactattaagaataatgctgttaggaacattcatatgcaagtttttgtgcagacttacatgtttttcatgtccatatttcttgggtatatacctaaaagttgaattgctgagtataatggcaaatgtatgtttaacatttggagacacattctcaccagcactatgtaagggttccacatccttaccaacagtttttttttttttttaaagctatcctagtgggcgtgatgtgataattttttttttttttttttttgagatagagtctcactctgtcacttaggttggaatgcagtggcacaatcacagttcacttcagcctcgacctccctgggctcaggtgatcctcccacttcagcctcccaagtagctggaactatgggcacgcaccaccacaccaggctgttttttattttattttaatttttgtacagacgaggttttgccatgttgctcaggttgatctcgaactcctgagctcaagtgatccgcccaccttggcctctcaaaatgctgggattaccggcatgagcctcactgtgattttgatttgcatttccctgatggctaatgatatcaagcatcttttcatatgcttatcagccatttgtatatcttcttcagagaaatatttattcagattttttttcttatttttcaattaggttgtctttttattattgaattgtaagagttcttcagattctggatacaaatctctcatcagatatgtgagtgagcatttttttcaaatgattttttccctccagcaatcatactgcatttctaccatctactgtaaactgccatatgtctacctcatttatctcaactttttaactttttaacttttacacttttcttcctagtgggtgcttgggggctttcagccttctgtgcctggggaggactttcagaactaagagctccccagggtgtctgactcagaggatcacagtgacccaaggctctctccctccgagatcctctagttgtgcattccagacagggagactgcctggccggctcctctagcactttgagcagtgtccctccctgcctcctgtctccttctctgttcccacactgcacaggggctctgcgtggggagtatgggggctcgctactgcctggagctgctgctattgctgaggtgtaagaaccctggagaggtaagaagatacggtgtgtgtatttcaggctctgtgtttcgtgcctactgctagaagcaaggtaggacccaagccaggaagacgtgaaagattccatggggtaataatcccagagcagcatctggaaaaggtgaacataagtaggaaagaaggagggaagtaatagcgttggagggatttgctcaatgtgtcctggcgcttgagtctcttttaacatcaaagctcaggtggttcaaatgacagtcacactgcctctgcctgttgctttaagagtaaattcagagtcttcaaaccaggcttattggaatattacataccattgccaagacgtgtatatttttattgaaagttcagagcaaatcatagtaaggacccaccatttcttctgcaccattccttttggctattttctcagtatttgaaaatcaatggaatttgactttaacatgcacattggcttataatgttactgttgcatgggtcttaatgttactgttccagtccagtgtttttgtgctagaggtaaggaaactgaagttcagagtgaatcaggcattgccaggatcaccagactaatccaggatgagccaaaacatcattgctatggagtgtctctttgggtctcaatcattgggtactatataatgactgacgactggggacaagggcataggttgcccttttccttagtatgatgaaggatcaagattctataacatcgataactgattagggtactaatgtggaaccacaaaatgtggttcagctctgtcctgtggccactccatgcagcaaagacagatggctggttcagaaaactttggttttgttgtttgcatacaataaaggtagcatctggtgcaaattttattttttttaatgattccagggttttttctttaatgatttcatagaaagaaccttaaaactcatcttttcagaatattaatttagattgttaccgaagtgttcacagagcctaattaaatacttgctggtttcatatagctacaagtaaaagctgctttgaatccttcctaaacttatattggtttatttggtgaattgtgtgttaacaccaagaaagtgaaatcattggcttttctacagattggtgatctattaccttaaacaatatgatcaggccacatcaattcatttgcaaatttcttcctctctctatcatgtgcacatgccaccataggtataaagtaattaaaatatatacgaattatttagtttgttaaaagccaagttgcttttgaagaaaatttgctgctcttagattatgattatttacagtttgttaagtgatttcattttgtaggcatagactttttattgtgattctgattatttacagtaatagcaactatcaaatcaactaatgtggtggtgattgcagatttttggatatctattactgtttatcgggaacattttttcactaccagaacggggaaaaaaaagccacaaaagcagtaaatcccattgctttccaagtgtcattgtaaatcctgctgataagaactgcacattttagcaatgtttaataagtactttaaaaattgagaattgtctcaaaagaaacagattttgaagttcctctgttgtacctacttccagattaagaaaaatcatttgtggaaaacaagttgatcccaagttcctaatcacagggagaagatgggattttgtaaacctgcagagcctgaatttgttattgcatgcagctgtgcaaatttgcaaacatttccttccctagtcaggaccctatggaaggagccagtttggactgctgccttgatagctaacatttgtagaggctgcagtgcaggaagctattggggtacctgaactttgtcatctattttaatctgggcattagatgccaggtagagagagtatgcaagccaattagttctgcttcaatgtcatggtagggatatatcagtagccttattattcttgtcattctcggtgaatttcagaatgctgcttgaaatgggctttctgtatgcgttgagtgtgtgttcagtgggctgtctgggaaggaagatagcggagggccaaggcctgggtctcctaaaacacatgattatttcattgaactaatcagtgagagaaagacagggccttgtggtttctacgagcactggacttgcgtttctttgttttccatccatcctttggaaccagagaaggcatgaggaccatccatgagcaggttcacactcaaagctggttgcccttaccctggttgccatggcaatgttgtcctagcgtaggggatacttgcctatgtttgtagctgtctcctccccatctttggcagtttagcacaagaggcaactccctcatgcaactacagagcatttaatgagttagggattcttcattttgagttacagttagctctctagtatatttttgggaggacaaatgggcaggaaaaattaagtcacaggagacaagcttcatgactctaatggagttgaatttacatttgccattaaaaatagctatagattgtttaattagaatcctagaggcggatgacgaattagtttatctttcaaatggtactcataaaaaatggggcagtgtgtgtgtgttttaaaagagcctaacttcttgttaaaatttaaagttcaaaccctcatttgtaaattggtgatagagacaattctataacgttgtgagaattaaatgagctaatacatgtcatgtgcttagaatagtgcctgaaatataataagcccagtaaatgttcagtgttattattatcattacttttatatgacagcatcctgggtgtttaatgctaatgatggctcattgagcagatattaagcatactgaccagtttccaggtatttttccaaatctgcctcaaggagcttgacagctaagggggagacaaaagtagaaagaagcagttgtttgaaatagaggcatggtcaacatatcctgggaaacctctgagcctgtgcactccagccctgtggactagcgagagaggtttctagaagaggtgacattgaggtgttggtcattgatggctgctcccagatgtgtggatatgggggcaaggagacaggggaacctcacttccaggagtgccagccaacgtagagcagtgagagaagatttctagaagaggtggcattgaggtgagggtcactgatggctgctcccggatgtttgggatacagcagcaaggaggcagggagatcctcacttcagaagtgccttgagttggttatttggacagatagggtgttcgatggcctgggtctgtcagatattctcagctgcccaaggtcagtgcttaatcatcttctctccttacaatacactgctttatattctccatggctgtaggggttttattctgtaacaattttgtaacaaaaacttcttaatcaaaagaatcattcttttggagagtggtggttctgaaaatcatgagaattaaggcatcttaaattactgcccactttatggacagaaccactcatttctcattattctgccagatccaagcaaatctcagaacagaacttatcccagactaattgaataaccttgaattcagtagttacactcatggctaaatttattattttctcctctttatcactcgggtagacacaatcactttcagaggttcttcagtctgatttacaattagctccttagcacatctttggaaggtcaaacaagcaggaacaattaactcacaggagacaagcttcttgtaacctcccaagaaacaaatactcacttctaagtaagttctgaagaagcaaataactattctaacttctgtcggacggtttttaaaaattttgttttaatttactttttttattttatagatttagagggtggacatgctttcttacatggatatattgtgtagtggtgaaatctgggcttttaacaggatagttttgatttagagacattagctgacttaatcacgggacagcactttctttattttgcaaattctccttaacacccctaccactccccaagctgttttgatttgtttagatccctgttgtgactccagacattgccaaaggtcccctaggagacacaactgtacctgcttaagaaccactcatctagaggaaaacggtttggtaaaggccgggtgcagtggctcgcgcctgtgatcccagcactttgggtggctgaggcaggcagatcaggaggtcaggagattgagcaatcctggccaacatggtaaaaccctgtctctactaaaatacaaaaaaaattagccaggcatggtggtgcctggctgtagtcccagctactcaggaggctgaggcaggggaatcgcttgaatttgggaggtggtgattgcagtgaaccgagattgagccactgcactccagcctggcgacagagcgagactccatctcaaaaaaaaaaaaaaaaaaaaaaaaaaaagtaaaagaaagaaaaatgaaatccttataatgtggaattagctgaattgtgccaatgccagagtgacaagggaagggtctgagttgggagtcactgtacacaaaggctcagccctagaaagaaggtaaaaggaagacatgcagagagaggtggtctcaagttctagcctccacttagtggagcgcccccatgacacttgcctggtgttgctctcctgttaccctcagagtggtgaattgaggatgaaggcttgtcttggaggcagcaaagaacagtgtctggggatatcaggtaggagaaggcaaagatcatttagggtcacaatcagtaagggaggtgttcaggtggctacactgtcagagtgatgcactgataaatgacagacatgggccgggcatggtggctcacacctgtaatcctagcactttgggaggctgaggtgggcagatcacttgaggtcaggagttcaagaccagcctggccaacatggtgaaaccccgtttctactaaaaatacaaaaattagctgggtgtggtggctcactcttgtaatcccctctacttgggaggctgaggctggaggatcacttgaacccaggaggcggaagttgcagtgagccaagatcatgccactgcactccagcctgggtgacagagcaagactctgtctcaaaaaaaaaaagacaaacgtgatgtacttcagtgcctgtggcatcaaaaacttccatgtcatatcctaattttgtatcactcctgcttccaactgggtagtgttctctttgggagtctacagaggcaggacaaagctctctttctgattacaagaactgtagctaacatttattgagcttggggctcattaacatgaaaagactcagagcagagcatgatattagtacattttatagacgagtgtactgagccatagagaggccaaaaaaattgtccaagtttccacagcagataggcaatggtcatgattgtgaatcaaacggtttggttatggaggctgcaccccctaccatcacactggaaagccggctttgtgcttctgtggacacttaactgacacccccagagcctgcacattccatggccaaatatgaagcatggaaaattatttggagaggcaaacaaaatttggctgtttggaggaattgagattttaatatcgttcatttttaaaattaatagtaaagtgaattctgggtcctgtggtgttttttgttgaccataggacaatgatatttgcaaatgggctttattaatttagattttgtgatagaggattcaagtgtgatttattgaggtaaatgtttcgaacccaaatgaccactcctttcttctctcttcaaatcctcaccactcccagcccaatcttattcctcaataattatttatcgtctggaagagtcaggtgtttcaaatgaggccagcatggacttttcccaacagggaggtattttttaatatctaaatgtcggcctatggcccttgctgttaaggctccagatcaaataggggcaaaaggaattgaaagccaaatcacaaaaataagtaaaaactccaactaacaagaatttcacaacagacataagctgatgactattttattaaagcaatgtggagtactactaaatgctactatgttctggaaatgtaggaaattggttgaagtcgtttttctcttgttagtctcatgttaagctgttcatactaggatctcttgggttattttttcccaattaatacagttgtctactaatttattttctttttaaaagtcttggccttaaactcagtcttggtattttcagctattgtttactaccaaaggaaaaacttcggatttagagaaaagtctgtatttttattttgtgtggagttgagaaaggggatggtaaacttgacattgcttggaaatgaaatgcacagcttgatctttttttcttgatatgatttttgtattggaagaactgtagtatgtcttggtggtgataatgaataccataaccacataatcattctctaaatgattgtaatggaaagaagttttatttaaaatttcaagttactcaaatggcacatgtctccacatgtgtctttttactacaggtaaacccagaaagcatgcgtggttatgggtgtgtgagtgtgtgtaacgtgaatgtgtgcctccctctatgttatgttgcactattagtttgaaccacaaaatagaaaagaatgtaaatatcttctgaactctggatttatctgttctaaatgaaagctagaggggaaaccattttagtatgtaaagtttggcctgaggaagagaatggcacttctacagttcttagaaaattctcatagaggatcaggattactggcatgcttggggaacaacttgctgtgggtagctgagattttcagtttcaaccagcaaatctgttttgtttcatcttttgtttaaaatatttgaattaataagaattatttttcaacttcaagaagtagtacatagagcaatgctgtctgataaaactgaatggtgatggaaatattctgtatctgtgttgtccagaatggtagccactagccccatgtggctatttagcgcttaaaatgtgtctactatgacggaggaattgaattttaagttttatttaattttaatttatttacatttaaatagccacataggacaggactaccatatttgacagtgcaagtattagagtataattaccagttaatgtatgtctctggtttgaaacattcctctgtattatcacactacgtatctgaattttgatttggaaaccgtggctgaatgctgggattgattccagctctgccaacaggaaaggagtggtgaggaaagctgttggacagctagccaaggatatttgccatatttgccagagtgttttgactgtacttctgtcatagtattaataccatttggcctttttaattgttatttgtgggcttattttacccctttggtagattctagattccttaaggatggggccttgctcttttcaccagcacatggaatagtgccttgccctagagtgtgcttaataaatattgactcaattgattagaattggtccatgccaattgattaaaagcttttctacctttaaaaaattgaatctaaattctttaaaatcaagttatttgtttgaatattgacaccctcccaataaagttatgtttattcattccagaaaatgattaaggggccttaatcataaaggtactggaataaagttaccatgggtttgtgtaatataaaccctgcaaagactgtttacaattctgtgtgggtgtaggaagaaaaaaggattcaaatataaatatgagtgagaaagaaaacttgttttgagtccattttatgcatttgttaacattttgaagactatacagtacaatttatcttaaagttatgaggtgaaagaaatgacttgtgtttaaaatcactgcaattctctatttgaagctccattgataacattttttgaggaaaacaaattacttgaataactttaaattcagtacattattatgcatatcacataatttcatttaaaaatcttttttccatagaatgagatcaaaagaccagattttgattgccagtgtggtgtgaagtgtaaagccagtgttccatgtcctattttgtttcataatataaacattcttcaaaagtttatctttcttaatgtaaagaatttttcatataaacttcccttcatttggttcaggttttagttattgtacatattcataaattttcattttatcaactgttttaactgatgtataaactttgttttttaaaaaagatttgagacagtataatttaaattttctctaaaaagaaatatattccttatttgcttgccaaatggtgaatttgtatgactaaatgagcagttcctacctgattcaagaatactcattcataatatatcatctcaaatgataggaaaatttaagtttcattcaacacaaagacatgaatgatttttaatgcattttattgtctgctaatggtacttttttagttacagaatttgctaagtaaagtgattataagcaaaaatcattgtgttcttgtgtcactcctgaaagcatctgaagtattcattcccctctcatcttctgatcttttaatcctgaaaaaaattgcaaaagaacagttaaaataatttacaaatgttcctagtgagtaccatttacaataacatgtctggcttcagttttgtcaaaacaatgtacaaccatttaagttgaactctataatttctgaagtttctttgttatttcgttgtcattagatattaggtgtccatgaggactgcttccaccttcaggacacttaaagcctattattttataataaaataacaattgctacctttttggggggtacgtcttgcatgtcaggctccaagcttatcacgctattttgttttccataaaacaactctaagaaactatcaatgtttatactcaaattttacacaaaaagaaactgagttttaaagagttcaaactatctgcccaaagtcacctttccataaatagctttgtcaagatgtgagcacattataaagttcatggtattaattattcataaagaagtaaatgcattttctatgtacagagagaacatgtgccttggactagaatagccaatgataggcaccgattacttgggattcaatcaattttcaaaaaattctgccccatattttccgtaaacatgctcacaattatgaagccatttatgacatatattatgatttttttaaattcagaaactatggtatttataattggacagagacttgaaaataatctgatttcgtcattttcccccatttaaaagaaaataaaacaccgatacatttgaagtaacttttacaatactgcctcgtctttgagggcaaagccagaattggaacctttgtgtcctggcttcttatcctggtcatttccacctcacttctctcttcttctcagtagcaaatcatcaataacatgtataaattggaattacagttggatacatatacatgataggatcacataatctcgtatacatagaagtaagactttatggatgtagattaagtttgttttgttgactattcccattcatttgtaagagctacctgtaatggaagatttagtgctaaattgcagtaacttcttgctaaaagcttaatcatctatagaaccccagtacagaaaaggaatctaacagtatgtttagtttagccgcctccaagttagattgaaaactactggaaatggggaatcttcctgtaggtttttgaagagatttcccgtctaccttttgtagcctgttcagatatttgcactctcaaaattatccgctccctcttgtcttaagccttcagtgcaactctagcctattcttgctagtcaaacctttgaaatataaggagaactgatattcccttatactgttgcccttaaaattcatggggtttagtaatatatatttctattaatgggttttggtaatacatattctggtagaaattcagtaatagtaaaattgaaacctaccataaaaactgtggtcttaattaccaagccatttagaggaatttgtctttaacataaaggtatagcatattgcttggactaatagaatcatagacctgtaactactacaactctagatccttggttgtcggagaccttagaactctggggcctattttgctgcaccattttcacaggatttgcattgtagtggcttcaaaatatactcaccacttcctcccgcttggtcttgtctgttgatggccaagcttccagagtcagatcaggaagcatgggaggcaggggctgcatggggaacatcggaggcagaggtggctgtggcggcaggggctgcatggggtgcacaggtggctggggctgcatgggctggtgaggctgtggctgaacaggctggggctggtagggctgctgggcgggcggagggaggtttggctggtggtgttggattggagtcatggagtgttggccaggaacgggcatcattggttgctgggggatcacgggctgctgagctggcaccactgggatgtggtgatgaggctgcagggtgtgagtcggggggtgctgttgggacagcacggggatgatttggtggtgcagccatccacccatgggctcgtaaccataggaagggtactggtgagaaacagagaggcaggtttaccattggctcaggtgactccaaccagagaagcagcagtgttttctttgccattatggctataggaatattttattcatttttcctttgcaaaaatttgtaactgtgtacacagatatgattttttacaaactaaatttcccattaatgtctgcatgtggagtagacatgatatttcacttaatatgggaattttaatgcatgcctaatattttcagggaataaggaacaaaatgtctacataccggtggccttatgctctggtaccacttcaaaggggtaagcaccttaagagaaaaagatattagaacccatttgatttaatttactttcatccaatatagaaactcactgatgcagtaggaaatatagactcactaatgcagtcctgtcaacattgatagcctgagaatgtgagttctacaaaagaaagaagaaggtaaaaatttgttgggtgcttcctgtgtgacaggcactgtgtttacatccatcacacacattcttcatcttttcttatatgctaggaggcaagtattattactctcactttttagataaggttatggggagttaaagagattcattaacttgactgaggttacacagggagtaaatctgtttaattccatagttccttcttttcattgtaagagcaaaacaaacacaaaattatgacataataatatgacatgatgttaatttcatttttttctttgatgtcacaatgggaaaaagagaggtgcaaacactgtccctcatcctagaaacacagattgactgatcagatgtgtcaatcttttcggttcaacagaaaatcttgcctcaaaatcttactaacatttgtcttcagcttttataagtaaataaactcatagattgttacctgaacctgtgagagaagtaagaatcttattcctttctgaacagtatatatacttggttagccttaggtttgaggattcttcatatagtaatacggcatttaatcgatacaaaaaataatcagtaaccttgctcatattatacttgacaaagcacttttcatattcattaactatattactctccaaacaatattttgaaatatggttattataattatttcctttctccagatgaggaaaccagggttccagaaagaggaaatgatttgcccaaaatcacaaagttagtaagaggttgaggagaacctcaaacccgacgtccaaaactcatgcattccgctgttctgcggagtctctcctataccacttagtcactaatatttcagcagaggcaagcaagagacacacatagagtgtgactatcttagaatcaggagttttttgagctggaaagagttttaaataacatcttacctaatccttacattttactagctgggttagaaccaagctggtcagagtttactttttgccctatcatggagcctccctgagtagtggttcatgatgggtaagcttacggccatatttaggaggacagactgagtcagagtggccaggcgggaggctgctgggacgacacaggcttgaggccaaccatcagagcttaaactgggaagctggtggtaggaactgtaaaatcaggaccacttgagaaacatctgggataaagaatcaacacactattctttacagagcccagggcattgttaacgcaaacaatggtcaaaattagtaaagagaaaaattacctcatagctgaagttgatataaccagggtgcccaggatgaggtggtagcttttacagggaggaggggaggagaatagaaagagagaggaagggagagagtgaaggaagagaagagagaggaagagattaagtcagtatgcaattgttcacattaaaggagactgaagctactttaaaaaaatctatatagtgcagaatatacttgaggtctgtttttagtttgaacaaatgtgctgtatagaagaggagaccttttattttaaagaggttcagaacagctaaatgactgttcctggggttatagccttatggctggagacctggaagcagaaaccagcacacatttattctccagtgatctttggacagcatcccacccccacgcccagtgttttcaatgaatcctaccctatcctgcccaacagtttacttgctgataaaactcaccccataatggggagagaagtgtgtttctctttcacaataaagaaatatcaacaaggagagaattgtctcacgaatgttcccttgtagatcaggaggtggtcaagtacttttaagtatcaaagggatttctcataattgacatgcaaagtaaacaacacttccatacaacaaaagaagccacaaaagaaaccacaaggtgggaattattgatgaatgccagaacaagatgggtggagcaaagtggaaacattataaatcccatggaaaatgaaagagttgatttatgacgtttaggccgatctttttttattattctgccaacggttttatggcagaaaaattttcaagttaaaaataaaaggccacctgaatgatgatctgaatcaggactgtctgtcctctcaaaagtggggcccaagtgtctggtgcctgtattgtggaactctggttgtgcctggggtccagggaggagagacggtcatgcagaaaatctccctcagacattggcctcatttaggattggctctattatattctttaaaaatgctcacatttcatgggaaggtttattctctctcatctggatgtgaatggttttagtcaggtcctataccctcttgaacaataccatcttagagagtgggaaaagggctgaatttgtaaggcagggacccctgaggaaactaggaatcgctgcaatgcaggatttcaggaagtcagagcacagaatcttggttttgtgggtgagagaggaagagaggaggcaagggtgcaagcttgctggcttctggttgtatcaactgctctttattccaccaaaaagcagatgcagcctgcttggcatgcatgtgatctaagttctctgcccttatgcacctgtgtccagacagagtgggtctaatgtcctgatctttaatacatttgaatataaaatatatcactatgtattgggtgtaggcaggatcccgggcaaccacaaaaaagtcacgtactcatcagatgtacccaaaggggtggggcctctgagaacaggaatgtggctcaaaaagtggattcctaacacaaaaatcttaccccctgaggggtaagagcagcaatatgtggagggcaggaagagatttggaatcttgagaggaattgggttttagacaaaactggcatctctgtaatatttgtccaaagctggttaagcactttctctggagacctttcaagggtcccttccaaaagcttcctccatctagagatgggtggtgatatttacaagctaacagttccaacagaatctcctggggtgcttataaaaatgcagagtcctgggccccgccccagctgtaccaaatcagaatttttggtagcggcatttgagaatatacctttttaaaacaagctcctgaagtgtttcttcaacccagagacatatgaagacatctgatctcatactgttttaaaccctaatttcaccaactatgagcagatttttatgtccaagtttgtgaaattggacactgacttatgcaaggggtgttttactcacaggcatggcaaaagctgctcccaggaggcaggcaaataaaatccaggtccccatttcttgatggttctgaaatgtaagtcaacatccacttttcttatctcttctgaaacatggatgtaatgaatgctccataaaacacacataatctacattagtctattgctagtaagaaggatggagccattgtttgtgaatttacttcagtcatatgtgatttccagctctcagcctatttcattgtttctggagtcacagtagtgataaagatgcatttaatttaggttgagggctaaacaagttacagggacatgaatgatctatcttcatatgactttgcatgccattttcctatgcctatacagcccttagtcatagaagctaaattgtatttataattaatgattaaaggaataaagttggctctaaaggttgggaagatcatcaaagtgcacagtattttataattttagaacaaggaggcacagaaatgtctcgtgcacagtctacctggacattgctactgttaaaaacaaggactaatcatttgagaaaatatattaatttgccaagatagattttagttccagaaattcctatctacagaacttcaggcaagaccctccagtaacatctctgagctccagattgtggagcaaaagatgtggctgaaccaacaggagaggatggtacgaattttatgtgattcttcaatgaattttgaatactttctccctaagaggtttcattttctttcaatggaatcttcattttgtttgatgttgcactgtaattattctataaataagacccttgggacattaagcaaaacaggtcctcctaaaatgtgcacattgatttgtggcacaaattactgggaaaactgtcagaagaaagaccttaaattttgtataagaagtgaatattacatgtgataatgctgtctatgaaaagtacactaaagttttctaactcctaaatttgttttttgtttgtttgtttgtttgggttaatgagaaaaaacacttcatggatggttctattttatgtaattaaataaaaagcttttcaaagtagtagatcacagcctgtgaatgtattatttttactttaatcgataattaattaaaataaatattttactgtgaaatgtggccaagaaagacctttggaattagacaagcactttgttgcattataaagttaaaaatcatttcagtaatcagagtctaatttaattatgggccaactaaaaagtaactattgatggcatatagtattagaaatgtagaatacatttatatcttttaaaagaaatgcagagaaagaaataagcacaataaaaaggatatcaaattataaataaaatccacatacctttgaatgtattcagtgcaagtttctgtttgaaactcagggatgcttgatcctttagatttcttccaactataagctcaatttatatcattcatggcatctgtaacaaccaatccagtttctaaaggaaaaatgtgttgagtataactaaaaatccctgtatcatgattttttagaagctatgatcagacataaggctgtatgttgtgattagtgcatatggaatctttcattatgggcaataataggtttaacaggcaaagagtttcatcacgctattttgaagtcagcaaattagttgactgtacatgttgatatattcagatttatttttaaaaagcttctctgccatcgccttttcctcagttctagcaaacaacgttgttctttacaaaaatcaaggtaggtggttgagattctctagtgtaatctggatatcctccaggatttttccagccctttcagatcaggagaaattgattcaaattcccatttgggtaaaaccccaaagctctctctagtttctctctgaggaattataattttgggatcaccactgctctattatctgcttccattgaaggtattttttctctgttccccttggctactcctttatcacccctctggtgtccaccaaaacaggggacaaagccccttctcggccccatgctgaaacccatctaccgtaaaaacaatcaggaacttaaggttcttgcagtagcaaagcttttactgatgatctatactacaaggcaaggagtgcacaccagacagcacattttaaagtaaattttgttttttacaagcaaactcatgtcacaggggatgttgtcctttgcctcccatctcacagagcagcttggcctctcagtatggcggcccttctttgcccatatccttctggcccaatcccactttctcatacaggcaaacccaaattcctctctatttttcagagtctcttaactgtctggctagctactttgtttccatgttctcagcagcctcccctttccctaagcaatgaccaaagctattcactttctaaaagaacctctgatcatctacctattaaattcatgtgtgttttacccctctaccttggtataacacatgggctttttctttcattctggaatttgattagattgatctaattgagcaaagttgtaattagtggcaggagctaactgacgagtcgtccatcaatattagatcaataaaggagatactgaatatctacccagatacagttgatgttatacttggatctctttgaatacacaagtaatacttataaagtttgtatatatacatatgtttatacgtatatatacaaattacttagcctgtctgagcctcaatttcctgatatgtagaatggaaataataacagaacctagctcagggaattcatgtgaaaagtagatgagtgacatctctggggaaatggaagtctatttattactctccccaaccctgtcagctggcatacagtaaatgtttaaagaatgctaataaacaagattccaagatgatctttggggataaatcagtagggatgaatattgcaaagaaaggtaagaccttccaatcagggagagagagattgcaaagaaggaagtagaagattataacaggtaaaatgtatgcatgaaaagaaacatagaatatgattctaaaagccaaatgtccccaggatttggctttatttatgaatatatttattggtgaattttatagcagagacaagaaggattccctttgaaggaagttggaaaatggaccttaggaggattggcaggggtgtacagcaaggtggtaagggagaggaaggaaaatgtggatcacattttattcactttcaatctttttcccccattttatataattacatatattggagtgtctgaaaggattcaggatattttttttttctacaaagttgtgggtaatctctactaatgaagtcaatgatgaattactagtagccttgtagttttagaaagattgatcttatactttttctcaccttctaagaatgagaggatgatatatttggccataatgatcaacaggatgctgccttaatgtggcattaattcctctggaccactggatagtgagttaccgctaattcaccatggacagttgaacaagctttgatggccgattccatagaaataattgattttcccctactgcatatcctgaatcataggacattaaaatatggatctctgtttgaaatctcttccactaatttaggccccacttacacagcttaaaaattggtaaatgttttgaggaaaatgaaatttcaattgaaatatttttcctataagcaattattttatttatgaataaattgactgcataaaatagttcttttgctcatttttttgtagtaggtattctttttcttgacttgcagcccagtacgttttgctgttctcacaatgcttatgttagcaacttccccacttctaatttgctgcttctaatttacagtatgctagaaaatcatatgcccaagcttgttaaaagtatgcgtgaactgaaagtaaaggaacactctaagtggggctggcctgggagggcctcgcctgtgagaaaagcaaatgaatttcggttttgtgacacttatttttgactgctgggagggtgtttggtttgttttggggttcctctccactggcttactgcctgggtttcaacagcactcggggtatgagggtggcctttggataagtcaggtattatgagtttgcaaagcctttcctatcatctgtaagagttcaactcttgagccttcttttaaagcatccccagggttatccaatattctggaataatttcaacagtgagtcttcttaagtagctggagccaaagctggcttttaaatattttctctgtagatgtttacttacaagaaaacatcattctctaggatagcttttttttttttttttttgctggggtagagttggagttgtatgatcttcagatcttaggcacaaaaccaccgatgaattccgatacacatcgtaactttgaccccaccgcaacccttagaaatcaggtattgtgtcttatactttcttgggagctccttggtacctagaaaaagctcttatacaaagtaggtgctagataaatgtgttgatgaattaatgaaaatgtagaaaagttttccatgacattgtaaacatagaaaatgtggattctgaaagaaatcctacagtgatttagatggaccttttcaatagctaagatggataattcagcattgctctcaactgctcctgtggacttctgtgcaaatgacctctgataagtatctgaaaagggagatgctgtaaaagcgctagaatctattatcctaacagtctcattacatttggctctgacctcttagttcaaattataatatactccaaacaaatacactatgatagataattttttgttgttgtttttgagacagagtctcgctctgtcgcccaggctggagtgaagtggtacagtctcggctcgctgcaatctctgcctcccgggtttaagtgactctcctgcctcagcctcccaagtagctgggattacaggcacatgccaccatgcccagcttatttttatatttttagtagagacggggtttcaccatgttgtccaggatggtctccatctcctgacctcatgatctgcctgcctcggcctcccaaagtgctgggattacaggcatgagccactgcgcctggcctatgaagtaacatttaaaacaaaatgtctaccaatagcggggctggttcaaatcgattatggcacaaatagcattcaagatgaggatgtcactctgcgtttgtcaacataaaaagatgttggtgatacattgttaagtggaaaaatagattttttaaagtccccttctctaatttttttctccctccctccctgctctcccttctctccatttggggagatattcgccaaaacacagtagttatctagggactccttgaaaatctctgggtagccgaggtttaaatttatttcttttaaataatctgtgaatgcaacaaatgcaggggaaatacgagaagtttggagtatgatatttctcactcatgttcagcaagagagatgagtaagtgatagtgctacttgcataggccctgggtatatccaatgttcattcttagggggaaaaaaggttcaacataaaatccaagacaaaaaaaaacacacgattttttaaagtgagagagcccttttaaatcatgagtaggaaatattttaataatataaacattcacagcaagagttcatacagcttgtaatttgaaaagtccgtaggcatttgctaaatatcaggtggaacaattttcaacaagggaaattatatgcagttgaagagtgtgttgtttggattataattaactggtaactgtcaggagtgaaaatggtacatctgtgttaaaagaggtaggacagtaatgtaaaaacaagcatttttattcctgtttattgggtaaaatataccaaagtaagttcaactttcctgctgaggttcagtggagacatacatagattagtagttttttaaaatattgttcagccataaaatggaatgaagcactgatccatacagcaacatggatgaaccttgaaaacattacattcagtgaaggaagccagtcataaaataccatatactgtatgactgtataggaaatgccaagaataggcaaaatccatagaaacagaaagtagattcatggttgccaggggttgagggaagggggaaatggggagttactgctaatgagccccaggtttctttttgtgatgatagaaatgttctggagttagacagtggtgatggttgcacaatcttgtgaatatactaaaagccactcaattgtacactttaaagtggtgaatcttatggtatgtgaattatatcttaatttttaaaaggacacatattatatatggtatgatatcggccctcaaaaaatgtacagcctttatacattatgtaaaatatagattaaaaggctaaacacggtgtaatggtacagaacaatagtgtaagtgttgccccacgatgataaagttgatgatgacgactatgatgaagatgaaactaacctttattgccagccatggttctaagcatttaacatgtttaaatgtttattggtcacctcccgcatgccgggtatattctgggtttatgttttacatcagtgattaaaacacacaaagactcctactcacagtctcacagaaagcaactatgaacaatggatataataaataaggacagcagaagagaaagcctatggaaaaggaaaaagtagagcagctaagaaggattagacgtgctgagttgcacgtttcaatagggtggtcagttttaaacaatttcttgaagaaggtgaggtgttcgcctgagcatctctgggatcagcacaaaggcaccagcatggaagtggcccagtgtgttagctagctggcaggaacccagcactgctggtgtggtgcaaggtggagggcataagaggagctgaaggccaaaaggtgacatcttctcatgcttccatgatcttagcaattaaatgtagaattccttgcctaaaataattctattgttcattgtgtgccaggggcttcaggctttggagatgtgaaggatttggatagacatagaggctatttcctcacagggctgagtcattggaagaaagagaaacgggaatgggcagagcatgcttggtgtgcagaaaaagaccagctaggcagcagcagaggttttaggtagaaaaagggcaatggcagatgggctgttgggaacagagagaccctgaatgttggacagggaaatccacttgtgtcccctctgcagtggcaaagcactgagcatttgtatccactgtccttgcttgctagggtttctacaagaaagttcgtctggaagctcagacttgtgtcaagaatgagaaggtagaaacacaaagcaatcagatgacttggctgtcttcacatcacattgagagtcagagcagacgcaagacccctgggctctggccctggctcagacactcttcacccacttgctcacagatgaatgaggcataccttggggccccagatcaaatgataacattataagaacaactggaaatagataagtctttaaaaatacagaacataatgtttttcctgtgaaatatagggttgcattcaaaaactgttaccagagaatattctccagagaaacctacagctattcaaaactgctctacaatataagctcttgtttagtaagaaataaaagctatttaatgaaaggtctataaaaacggatttaataacttaatacataattatatgctataaagttcatgtgttgaaagggtacacttgagtgggttttagtatatttttaatgtatttacaaagtttgccaccatcaccatagtctagttctagaacattttcatcacctgaaaagaaatcccatacccagtaacagtgaattcccattctcctccccttagcacaagacaactaccaatctatttcctgtgtctatggatttgcttatttggtacatttcatagaaatagagtcatacaacatatggttggaaaatgtgtctctgagaacctctacaaaaaggtttgtcggtgttagcactcttggcatttggggccagataattatttgctgagggatgtttagcagcatccctggcctctaccttctaggtgttagcagcaacaaccctcgctcttaagttgtgactaaccaaaagtgtctccggacatcgcatatgtttgatgggggagtgagggggcaaattcgcccctagttgaaacccacagatttacagttacctaagaactgagctgggtgtaggggtgtataaagtgaggtgggtgcctggacccagggtgctgttgtggaaagacaactatttcagggtctgtgaaggtccaaagtttgtaccccaagttccaaaactctgtgattcattttagcaaataggaaagagatgactaggggcaagaggcacaactgttatttagatgaagttattgttcaaacaatagctggtggggaaaaacactcattttttcggtcactaaaaaagatagagggtgatgggtgcaccaaaatctcacaaatcaccactaaagaacttattcatgtaaccaaatatcacctgttccccaaaaacctatggaaataaaaagacattttaaaagatagaaattgttattttaaaataaaattcaatagtatatgccagtggtctttaccttccttataaaggactggaatcatggtgtcaataattcaaaaagtgtctaaatttggatttgggctgttttatgttacaacagtaagaattaatggttctcaaagagccttacttaagtcagctttaacattactctgcagactataaacaccccttgagcagcaaaaggaagcatgaaatttgatttataccgtagctaacgaaaacaagtgggcaatcacaatttgatcataccctactaatctaatttagtctcaggaatggactaaaaagaggaagcttgtggactttagaaatatgtacatttcagaaaatataagtgtgacctcttttcttttcagaattgtgtaagtgaaggaagctgtcatcctccctggtaaatccatttgtaaataaacgggctaaagaaatcatgactgtggtcctttctagttcttaggatctgtcctgctcagagtgggaatcacaaagtgattgaggtaataactggtatctttgttgttctcagtttaaaggaagtgttctctcaaactgccttagactgcgcagccttgaccctctaggacttgatgccctgtgtatggcattgttatcagatgcaagttagtaaacccagattgtgtttacaagtaggttgtcattatacagtggcttctctgtaagtacaaaatgtatatttcctttttatttatcatggactatagcaattacagaatgtagctcttgtttttatcagggatattactgaggcccttaaactcaagctgacttacatttattttaaaatacatgttccaaagatgtttttaaaattttaaatatgcatatttttaagattttcccctttaacctgttctcccatcctgacatttaggatggggaatagacagaacatctgagggagtttgggtctcacagatcggctgtaaaattgagtaagagcaaaatgtttggaaaaaaaaaaaaaaaacaatctgtgtggttgttcatctggaaagatctgttccccactcagtagcttacagaaggctcaacatgatatggatcagctcgaattcattatctgaccaaacagcaactcaggaatcttatgtcctgtccaaggtgtgctgtgggactcaataatctctttccagatctattatatctacataaaaatatgcatgagaatcagataaactagtgggcctcaaccaggaatgattgtgcccttcagggtacattttataatatttggaagcatttttggttgtcacaattggaggatacggatgttcctggcatctagtgggtagaggccagagatgctgttaaatattctacaatgcacaggaaagccccccaaataaagaattatccaaccccaaatgtcagtagcattgaagttgggaaatcttgttcaaggaaattcccagtgcctcaggttgtcttatgagatgtggagcatgtcaatatccacagttgccagttgtgccatatggaatgctgcaaggagaaaatatagatacacatgaaaatgtgtttttgggatttggggaaatacatctatggatttgatactttggtgttccaaagatgtggctatttttgcccacaagtgttgcccaaaaccctggggctatgtggtgcctttttcacagagcaagtacataaagtacagactgttaaacagatcactcacctgctataaaatgtcagttaataatgaggtcctatcatggatattagttgaatgataagtgccacttctttcctcttacatgtttattagtgtcatctaaagcaatggctctcaaaatgtggtggctggaccagcagcattggtatcacctgggaacttgttagaaatgcacattgtcagccccctcccacacctactgaatctgaaacttttggggtagggcccagcaatctgtgttattttaacaagcttccccatgattctgatgaactttaatgcttaaatcggagaactgttggggaccaccagcacctgggagcttgctagaaatcacatgactaggccaggaccttgttgaaaggcagattctcatttagtaggcctgagaaagggatcaagatttgggactacagatatgatagcttgggtaaaaactacaaaatttctcctttttgagccttctatttccctcttcaaaaattgggaagacattgtattggttccctgttgctgctataataaataatcacaaacttagtcgcttaaaacaacacaaatttattatcttacacttccagaggtcagaagtctgaaatgggtctcactgggctaaaatcatggtacctggtgactgtaggggagaatcatttttcttgacttttccattttctagaggctgcccacattccttggctcatgtttccttcctccatcttcaaagccagaaatggcctggtgagtctttctcatatcacatcactctgacactgacccttctgcctccctgttccacatttaagttgctcctgtgatgatattagtcccatatacataattcaggacaatctccttattttaacagcatatgattagcaacattaatcccatctgcaactttaactcctctttgccaggtagcataacatattcacatattcttgagatttggatgtggacatattttggggggcattattctgcttcctacacaaataattttacctttattctccagcaaaatttgtgtcatagagaaaaatcttggaaggaatccagtcaggaccaatctcctaccaattcagaaatcttcctgcaaaatcctccaaacttggccatgtgatactagcttctcagctagactgtaagctgtatcctacagaagaccctatcttatagttattctccatctcctcagtgcctagaagagaatttagctcataatagatacttagaaaacattctttgattggtacactgctttcaggcacatagagcacgatatgactatatagactgtggaatcttgactttgtgaaactgagggattgatgctgaatctctgtcaagccttattaccctcctgtgtaaaatggggataatattacattctgtataggattgttgttggaatcaaatgaaatgttgtaaatagagcacatggagatatagatataatttacatgaaacgtctgaaaccataacatggtagaatactaccttgtgataatttgctaacaaaactgcacaagataaggacaggtggtattgagtctctttacataatgcttactgaagtgtcgcctctggcttcatttataacatcaatttagaagcagtgtttctcaacatagactatatttttgaaccattcgtgtagcttttaaataatatttttgcctgggttccattctacctagtttctgatttacttggtctaagcattggctccaactcttgctatgtttttgaatcccctggggaagcttttataaatatcgatggccaggtgccacctccagaaattctgtttcgatcaaatataatgtgtagccatggttgagatccattgaacacaacttattctaccttataaattgttacatctgccagacctttactgtatatgagaagttgtagttttatcaactttgcctgaatcagtggatgtttttctaatttccattcaatgtcattggtggaattaagaacactcaacataatgacatttgcaattataaaggtggtatcacatccccagagttttagcaggatggcagaaccacagtgagcactcagaaaacgtttgctaatgatgggccaaaaaaaagtgtcttttatggtctcttgatttattcaggaatattgcattgcagttgagtctctcacagagtccacttgaggctgctaacatgttgatttaatgaatgggtgcatttcatgaaccacccatccgagtgaattactttgggtgtagctgttttgatttttccttcctctgagtatatggttttgttaatttaaacaaattcagttgttttaccattttgtagacacattctttgtgtggccaagaatcttgtttgtggtggccacaccacaactggatttgaatgtagagcaacccagcaaagaagtgctaatttgaagcaattgttaacattgccagcaacaaaccaaagtgacctccatcaatgggttcagttagcaaccctgaaggcaagacactctgtttattccattatcgtttccttcatctatcagaaaccctaatcttcatggatgatgaaataataacaatctcaaacttaagatatattttgttcatcttaattttctaaatgtccttttttcccctcagtacaaacataatacatgtaaataaattccaacactataaaaattcattaggcagtgtcaaagtcccacaaatcccatcctccagtgatggccactaataaccatttgagaatatataaccccagatctccctgttaaattataataaacatttatgtccataacttgtgttctgcaacttctttgtttaactttacatatagtggatatctttccaaatttattcagagagaactactccactttttttcatgactgcccagaattccactgaatagataccccgtagtttagttagccagttgctcactgatggacacttaggttttttatgtttctttaaacatatatgcatataactaatatataataaaattaattatatataagtattaatatatatattttggtagattataatacacatgtagagaagtgcacataagtttacaacttaatgaatttctgcaaagtgaacacacctgtgccagatggagaaccatccctgaccagcacctcacagggatcccttggactcccttccagtcacttctccccaaaggtaacccctattctgtatttttgtagcatatattggttttatctggttttatagattacattactggtatcctacagcatgttattttttatgtcagacttctttcgctcaacgtgatgtctctgggattcatctgtattgttgtaggtggttggagtttgttttttcattcccattactgcatagttttccattatgtgatataccacaatttattcagtctactttcacgaacatttggataatttacagttcggggctgttttgaataatgctgctatgaacattctagcacacatattttggtgaacatatgctcacatttccgttgtttttattggtgactgggtttttttgctatcagatattgtactgaagtgaatgtctttgcaaatgtatcttgcacattttgcaagtattgctataaagtagatattagaattgctgggtcaaatggtattcacagaactgctccgaaaaaaattttgattttttttttttttttttttgagacaaggtcttgctctgtcgcccaggctggagtgcagtggtacaatcatgtcttgactgcagcctcgaaatcctggactcaagcagtcctcccatctcagcctcccaaagtgctgggattccagatgtgagccaccatgcctggcctaaatattttgacttttaagctaggtctggacctcaagtaacctattgtggatacacccctttgctattaccattatctgtgacacagacgctgctattgtgtcttcctgactacaaggcaagactaacaaaaaccagaatcttctggctcttttcagtcacgctctagtgagctagtgcctctttcatgtatccactgagggacaaaaagataaaatgacctagtgtcccaggatgccagcttaaacttttgagtacattgatgctatgataatatacaccaaatggactctgtggctctaagtaccatccactccagattgagataacctcctttcccaagtagagaaagaagattctaacctggaggtgagagccatttgcatgtcttaccaaaaaatgtcccattcagaatgagctgacattgggagacattaggttagagcagtgtttcccaaccttggaactgttgacatttagggtgggatcattctttgctgtgggggccgttctgtgcactgtaggatgttgagaagcatccctggactccacccatcacaactggcactttcctcctcagttgtgacaaccaaaaatgtctccaggcaatggcaaatgtcccttgaggggcagaatcaccccagtagaggactactaagctagtgcttatagaagaccccagctctaaatcagattatgttcagattctggctcagccactttttatgtgacctaggacaaagtacctaagttctctgcctcatttggctcatctgttaaatatagatattaatagtaatatttacctcaattggttgttgttgagattaaatgagattattaatgtgatgcacttggcatagtctttggcaaaaaaataagtgtcgaaagttgttaggtttattagtcataatctttattattattaaaaaaaaatggaggggtggaagaaggggtcccattgtgtatcctggaaaaaggatgaggataatgcatatctgaaaaaacatcaaaggacaaggggctcataactcttggaacacaggcaatgggaaatggaaatgtggagaaaacattaagtgctatgatggaagacaatggcatttggttgtctctctctgttccttctcaagttaacatttggaaactagaatttgtggaaaatagactttggcagcagaattaggcatttttaggaacaggataaatcactgtggggaaatattttattgtattactcttgttaatatgaagttattaaactttcaatagtgtgttgaatgcttttatcttaaataataaaatatattcagtgctaaagcagctgtattgtttttgatattattaagtagaaaaatttatctgttaggagctttgttgggttgattttcacctgataccctcttctcccaccaaagatctaactttcataaattctggcaatagaaaaacaagtcatcatgttaagctaggtctgaaccttaagaaacacactgtggctgcatccctttgttattgccattatctgtgatgcagatacagcaagacagagtggcatcctggacgggactccagatggagagtatgagtccagggttatgtctttgtgttgccaagctgcaccttggcttgtcacttcttcccattgtgcctcaggttctgagcagatggaattagtttagcatgtcccaactatattctggggaattcgagtgatatggagagatggtctgaaaattaaaaaaaaataaaaaatagaaggaggtgagattatagcaagtgtatttaggaggtactccgagttatgatttcccctctgcaggacttctctattattcttattgtttattgtgactacttaagttgaagctaccatgcacaactttttcaaatatatttgattatggaacagcttggaaaatcctgcattaaataatgtatgtgtcccttgcaggcataaaaatattctgatttcttttgaattaatctgtcatcatggctgtgacaaattaccataaatttagtgccatgaaacaatacacatttattatcttaaagtgctgtaggttagaaatctgacacaggttgcactggacaaaaatcaaggtgttgacagagctgcatttcttctggaggctctaaaaccacccacactccttagctcatggcccccttcctccagcttcaaggccagcaatattacatctcttagatcattattctatagtcacatcttcctcaaactctgaattctgctgaaaggggttgtcctattttaagggcctgtgtggttacgttgggcccacctggataatctagacttctgtccccctctcaaggttattaacttaatcatatgggcaaagtcccttttgccatgtaaggtaacacattcccaggttccagaaatcagggtgtggaaaccttaggggtgagagatattattctgcactacctatcctagtggcttcttccatttctcaaccctggagggtgtggggtcgtgttctgtagagccaggaagaagttcagcatttgttcatctgcttttgaccctagcaactcatgaaatgtgcaatgactatcttgtaaggggtattaaattcttctggcttttcctcacccagtaagcaataaaatcaaagaggacaagagtaattaaagcaagcctattgatctattttgtgtagcattctttttagcttctcttctgatataggcaagaatatctccctgaaaggaactaaactctgaactgtactttaacaagtaaaattgccatgctggatatcaacaattagtctttagagttaaaatataaacataaatgattaaattagttaatctactctttgtggtatagccattacagggctaatttttttttaaaaaaaaaaagaatactagaaacctctaaatttttcaagacactcatattcatcagactgtaaaaagcaaaagaaactgaaggattgtgttccttatcacagcttggaaaaagctctgatggctgatctatatgaagtggaaacattgcatgagttttcttgtaattgttgatatctcatgtgaatggaatgaggcggaaaacaagttttgcactaaaataagtgtttgaatcttgctatttggagtcatgttgtctacgttttttttttttgtttttggctacatagttaccatatgatccagcaattccacttctagttatatacccaaaatcattgaaaacctacgttcacacaaagtgtgtatgaatattcacagcagctttattcataccagtcaaaatgtggaaagaacccaaatgcccatcaactgaagaatggacaagcaaaatttagtatatctatacagtgaatattatcctgccataagaatgaatgaagtaatgacacatgctacaacgtggatgaactccaaaaacatgctaagtgaaagaaaccagacacaaaaagcccacatattatatgattctacttttatattaaatgtcaaaaacatgcaaaaccatagagacagaaagtagattagtggttcccaggggctggggtgagaggggaatggggagtgactgggtatgggctttccttttggtgtgatgaaaatgttttggaatcagtgatgatggttgtacactatctatgagtatactaaaaagaaacacagaactatacactttaaagtggtaacttttatggcatatgatttttatgtccaagctcttctattattttactataatttatttttgaaaatgtaaatttcaatatgcttcattgctcagagaaagcatgattttctatacatcagagcaaaagtatttacacaggtctgtgaaatactgtgtaatttatcattttaaaagtcgtatattgaggagaaaacatttttgaaaaataaatctgaaaagtggcagctagaaaatcagatgtgaaccagtaagtgcagatggcttgttttcacgtcatacctgcatttggtgtcatacttcatgttggtttctcccttttcaattttcccttttacatgtttgtctcttaatactaaaagtcaggaagcaagattttcttttttttgcatttttactggaagtgattttagctactttaaaataaatgtcctaaatataaatattccctgctggtcttgtttccatgctaatagacagaaatgattttctgtatagacagaattgctactctccttcaaattttctttcaaccagcaaatatacaaaagcacaaaatgttagtgctgtttctattcttccagaacctacagtctagccagggagaaaaggcacaaatatagataatcaaatagctttccaatgtttaaataagagtcaagaaaatagctgagatggggcagggtcggggggagatgagtgtgatggttacataggagggacgtatcggtgacgttagagttttctggaaaaatagctgacatttaaacattcccacccctcctctttcctccctcaatgagacatcacaagtgattgtctagacatctcaagtgtctaggtcatttggaaccttgaaagaagcagattcgccttctttaacaaacataaggtgaatttcctttggtcatgttttggtgttccttataggtccatagtaaacttgtttgtgttttagatggtatgattttcttgttaatgtgatgattcatttgtaatgtccctgtagggggacgacagggcttctcagaggaggtgatgctcagtaagcattacagggtgagtaggaaggcatggggaagccatttgggctgagagcacccctcaccctaaccatgaagtcctctgggctcttccatgtggctgaaattaagggatgtgaagtaagtgaggcttggtgaagcccaagagctaagcagtggccagatcttgagcgatcttgtgttttcacctcagagttgagaacttcatctggaaagctaggagcctcaatgatggctttcaaaagggaagggacaagatgagttttgctttgtagggagagacagcctacaagagtgtggaagtgctggtggacattcccagagaggaagtgttaaaggaaaggacagtttttaatgaggtgggatccacagaaactggtgactttctgagtgtgagtaggagagacataggaagcaatgttaaaaatgattttgcttcagttttcctgggtcactgcagggaacccatactgatgtatttgaaccacagaatcattgcccctaattttattgtgtgtattttcaaataattggtttacttaaagcaagatgcatttgcatacgtaccctttacccactgtgtattatcacatacctattataaatatttgtctatataagatagaaatatgtcacatatataattcatcatataataaatatataatagtcaagagatacatatagatacacatagatgtagagatagttaaatctatttaatatggagacaaatctataatgtttgtagtttttaattacaagtttctcaggccggccatagtggatttgataggcatcactctagtatgaatgtcttttctttcgagaatacttggaagaaatgctgattcctaataagtagctcataccaaatactaaagtccatgctactgatttcactttttctccctgagctttttctcattatgtgcgtaaaagaaaattagacattgagtgatctctgtggacccatctgctcatacatacagagatgtcacaaacatagttttaaaaacatgtggttcctggacacaggaaggggagcaacacacactgggtcctgtccggtggtggggttgggggagggagagcatcaggataaatagctaatacatgctgggcttaatacctaggtgatgggttgataggtacagcaaaccaccatgtcacatgtttacctatgtaacaaacctgcacatcctgcacatgtaccctggaacttaaaattaattaaaaaaagaaacagaaaaaaaatgtggttcctttgctgtttgaaatagtgaaatgctccaccatgaaatgtgaacattgtcatcccctatgtcatatatctggtgatttcttttcagtgggtccagatctggggtcggcaaactttttctgtaaagaatcagatagaaaacattttaggtgttgcggatcatactgtctgtgttgcaactactcaactttgctgttgtatcggaaaagcagccacagacaataggtaaatgagtgggtgtggttgttttccaataaaatttgattacaaaaataggccttaggctgtcctttgctgaccctgctttaagtcaacagttgccacctcaaggtcaaggcatgcctcagtcaatgtgttagaagtaatttattacctataataattaagttacaaactttagaatatttgtaagaaaactaaatgagagagaattagagatgagcctagaaccacctcatacagttattttgatgaattttcttgagtaggagagcaaggtgcagaaaagtagcataggatagtggttaagaccacaaactcaggactaaggtccctgagtttgaatttcagccatgccacttgcaatatgtgtcctgggacaagttacttgactgccctgtgctttgatttcttcatctataaaatgggcatattaataaacctcacattttaagattgtttaatgattaaaaccatgagtacaccataagggactggaataataatgggtacacactatatgtacaagagatgatagtcattccccacatatctaaatcttttggatttagatccaggacatagctctcagcttattttatctgtgctgtgagtcactgatgaataatccttactgtgcaccactaattagtagttgtggtgactacaaatttttatgttgctaatgggttgtaattttgtagtttctgaggttaaaaaaaaaatctacccatagatggatacttaacaagaaagaagcagcaaaactctgtgtagaaaatgtgaacgtgcacaaatcagtaatgcccatgagtgaaaatgacatgggaacatgttgttagggtacaacagttaaaattaccaaaaggtcaacaaagcgattatgtacttgaacattggacatcatgttctttatgttcatatcactgaattctggaattctgagtctactggttttttttttttacaaatgaaataaaatgtagctatgtttacagcatacccttccttgtccatcctattaatattaactggtggcatggaagtcaagaaaaatgactcattaaaataaaaatttttaataatttttaaaaatcagattaccatataattgatttttttgtaactgttttcaaaatggtcttcatattgccacgttaatttatcaaatacttggaacatgcttttagggatttcatgactttctccttcaaaagttggccccgctatttgctttatttaccaaaaaaaaagggtgaggtttggggaggggtgtagggaaaaagcaatcaaaacctgggtctatcagcgcatgtgacacgttcatttatcataagtgttacatgcatagctctctcctccctacaggactattttatctccactttacagagcaggtaattgaggcttaaaagcgttggatactcacatggctagttatatgctgaacttgaattcaaacacaggcagccagaaggagagtcctccctgtaaccactgtgctataacactgcatcccatttgaatgaaacagtggcaaaatgaacagataagatgaaagctgcttaactgtgctactgttcaaaatattccccatcacatctatggcagagctcatggaaagtgacatctggatcaagcctgtgcacgtgaaaaacaattttaaattatggatgtatgtgcttggagacttaatctcttaattggtagcattgttaagttttctttctgctgtcaatggaagagaaaggaaaaaaagaatctgagctttgagatgagggcacgttatgctctcggtgtgggagaaatctggcagaatcagtcaatgaaggaatatatggagagtgcagtcatcacatgagtatgtggaagggtgcaagaaatgaggagtggaggcaggagggagggaagcaaaggtacatgacaaattcttagtggaatttggagaaaagttatggatcctggaaaaagttcaaggaatttgtcttccctgatagtttcattaagctctggccattacaatggttctcaacctggactgcaccttagaattttggggaaagctttataaatatatcattgtctgagccccaaccccagacagtctaattgacttggtctatacctgtgctgtccaatacagtagccactatccacctgtggtaatttaaatttgaatcaattaacattaaatacaattaccaattcaatattcagtttctctggccatatctcaagtgctcattagccacgggtggctagtagccaccttagcaattagtactgttaacaaaaatgtccattgttatagaaaagtctattggaccatgctgttcttggggagagggacatggtcataaaaatttttgaaaactacagcaagtaattataatgtgcaatgaacttagagaactgttggtccttggagaatacatttgttctaaaatgtatcaccacttgtatctgaggtcattttgctttggaagatgattctgaaaatatcattaatgctagactttttctgcagcctagaaatgtagccgcatatatttttatttaaagcagcttgcttgctcatttactctacaagatttagatgagttaactaccagactgcaactaaaaatgaataacttgcttttccccacttagaatgaagtggtacaacaattcatgtagattttgaattacttattaaaagagtttaataggataaattatcttacagtaaaaccgagaggctcattgtccacagctcacattttaggcaacagattagaagcaacgtctatatatttgatgatatccaaaattaatttattaacttaatatgtttatgaagtcgcatgtaattttgaggaaattgttttcctttctcattagagaagaaccccactgagaagagacttttgcaaagtgccaaagtgcaattgatgaaacacaatgtcaccaaatatagcattgaaatgagaaagtggaaaggaattcactttggcattttttattttgcctagtttgtttggcctaagagttttcaagctcctaaatacgatattcttctatccttaaggcttgttttatatcctgctgatttgtaaatatctgacttgggattgggttcttcagtttgaggtgacagtacttcagcatccctgtatcttttaggtaatcttgctctgaaatccattccatgtttaatgagcagtgaatatacccataacagaataaatgacctgccctacaaagagttcacatgacatcttacctagaatgagtgccctcttatctgagtttccttcttatttcaagaaacctgaagcatccaaccttataactcagcgttcctcactacatgagtagaaggagcagctacaaaataagtaccattctctgcagtgtggtagaaccagcgatatacagatttctccataagaatcaagataaaatgcttttctctaggtcaaccctcctgggcacctaaaatgagatgcaaatttcacactctgtactcaaaggtatttctccagctataatcttgggcttaattttctggggatccatatttattggaaaaagagagggactctcataaagaaagaattcctagagtcagcttgttttattgctgcctagactcgcttcttatcagttcattccacaggtagagcctccgtttaccggttacattgtagactcagtttgcttcctctctttatccccttcctatcagttctgcaccactcggcctcattcatctttcctaaaacatctctttcatggtgttacacccctacctaaaactgagagtggctagttctacttgtaaaggatctggcatccaggaggttttctaacatggctgttccttttttctttaaatgaaatacctgtccctctccttattcctggaggtcattgccccatctattggctttcttttctctgtttcatcctggtgccctgcctctgtttctgcatatttctgtgtctcaattccacagggctttgagccctgagctgtcatctatgtatttaccaaaattctcccagttgcagagaggccttccagtctctgttggatgctctgtgtcatacttactttgtttataggtcttccaaggaagtgaataaagaaaaggttgctggcatgctgtgatattgcctaggggttaaaattattgcatttgaaaacagactgcctgggtttgagtgccaactctttacttgccagttgtgtgacttctggcaagctctttacgctttacgctctctttgtttcaactttcttatctgcaaaatagagataattctagtgcctgcctcctagaggatagcgtattcatggagacaataagtactcagtaaattttagttgttctttattgtggttttgactgtttcagattcatggtcttaaatagctttccagttactagatttgctttgatggtagagtttagatctgaaggatccaaaacattctctccgtgcaaataggtcacagtagcatcagaaggacgctagcaattagaccaaggtcagggtgctaggaatggggaaaggacggacagctacagttaaggaagcaaatggcagcaatgagagaatatacattggcttatcacctagcccctggaagttctgagcaatacaaagatagagtctgatggttaaactgatggtaccacattttcactgagcactgtaaggcagcagatgaactaaaatgtctctcacaatttgcatttttatatatagtcttaaaaaatattaagaccttacatgcgaactctatgctacactcaaaaaaggttaccaggaccaatggaaggtttatcagtaatgaatataatctaaatgaaatttcactgtgccattttatgagtcagtcatgattttgaaagataaaagcattacctatttctaaccattggctatatattattcaaaatctgaaggatgtcattagaaatatatttgtcttcttttatattaaagactttctacatgctcagcaaaacaatatataaagagcaatttttactttaccatccagttgatcaactactctgtttccaagtgagaatgtaggaagggacgaaatgagtcatgatgtcgttcagtggggagaagtataggaggagtttcaagcgcaagggctccagatcaggctgcttagatttattatctgtgttcatatgggaagttcaggaaagtgaggtcagctgctatatcagatacatccccaaatttcacaacataagtctatttgtcattcatactgttagattggccacaattggtgggacagctgtgctccaagcaatgattctgaacctgggctgcttcttcctttcattcagctggaggtagggtgggctggatttaggttgagacattggggcaactaaacctttcacgctggctatattgcctctccacgtggtctcttcaacatagtggctacacctatgtcatgggggctcaagggtcctatgaatgcaaaagcagaagtttccatgccttcttatgtctcaggtccagaatgggcttggcatccccttctgccacattcagttggttaaagtaactcatagagccaggcgggcttgaagggcaggggactacactaggcaaagaacactgaaaaatgtggtccactcctgggactaccacacatggctatgcaggttgcctggatgctgtctccaggtttttatggactggggctagaaatgaagcttgtcacttcctctgacattccattagctagactccagtcatatgaccactattaactgcaagagaggctgggaaatgtagactagctgaatgcccacgaaaaaggggctacgggcttcatgagcagtcagtgttttcctcactgtgcgccatccatttctgtgcctccatcacttcctctataaaatgaaattgttggaggcagtgaatacatggcacacatgaagtgcttagcacctaatacatgctcagtaaacttctactgttatcattcactattatgtagtggctatttgattttattccatctaagtaaaagcacaccgcactggataccaggctaaggaatttggactttgtcctggagctaaggaggagacatcaaagggttttaggcaaaagagtactgtaatcagaaatgtattcactcaaaaagtttgacagtgattctatgatatttttgccttaaatgtgcaaaatatcaccagtgatataaacagaaataatccagaataagagccaagaagaaggtggaatgaatgcttaatggcatagattcttaggctataaattgtttcttggtatgcttagatatggagggttaaatgggaaaaaaatgaccattgtgctctcagcactttttgtgattagcgaaactcttccacagatggaaccttttagttgcttcctgatatttatttccaaggctctttcagtgactctttggtctcttattggttttacttaaagagttgttatttaaatcttaaaaaggattccttatctttatgttttgtttttctggtttgaatgcattttccaaagaataccaaatatacacaccttctccattatttctgcacttcctcttaaggcctgccttgcttccactcttaaaacagactaggaatttcacaagatgttgtctctcgggattatttgagattattcacttagtcaccttcttacgaaacatttattgacctgacagtgtatgtctccatcaaataattgatttaacagaccactctagtgttaggtaaacattcttatttcatcactgtctcttccttattagatacttataacatggctcctactagtactgactctgaactgtggttttgtcttccagttaatttgtaagctcatagtggttgggatgacagccgcattacttatgagctgtgaatctttgagcaagtcacttaactcctctgcgcttctgtttcctcatctgtaatatgaggataataatgtaacctactgctaagaattattttgatggttagataagtcagtgcccataaaatgcctaaaacaatgcctgacacttagtaagtgctcagtcagaactacatgttgctgtcatctatttataaactaaaggatcatttgcctaataataaaaaatgaattacatatttatcaatttcatgtgaaataatatattaagatattagatatattgatattaagatattagatatctttaaatgaggatgtaacttccattgatgagtatccagtatgagccatgttgactgtctactggaataatgcgtattttcaacatcagtttttaggatagtggtggtggaggtatgtgcagtaacaggtagattttactctgaatctctgtttaagtttaatcattctagtaaagaaaaccacctggaatattttactgctttaaaattccttccttagcagcagcagcagcagaggctatgtgtggcttacatgattagtttcacagaatcctagtaaaagcataccgagtccttaattttgaatcagtaagatcttccatgaaatcatttcccggtttgtaaattataatcacagtgattcttttgttggaattcacttgagacccatgagagaactataacttcctattgactgggaaacaaagatgtcttttcgagttgtatttggttcagtgccatgtggaatgcatggagatcaaggtaattcgcgattggaattaatcttcccttttctctctgctcttcatggatgccacccccaacccccaccccaacctgaaccctcttagatatggccatgtgggtatattcactctgacctccacaccctctgttcaggaaatgaacaacttctcaaggactgctgtcccacaaagaggataaaatacagagcatgtgttatgcttcagtgtgaaagagaatgaaaacttttgctttttagtgtgtgtggctagtgttagaaaaatggagtcagtagttttaaaatataatttaagaactgagaatttgtcctaaacaaagaaggcatcctatgtgctttatcttgctctcaggggtttcaccagtggcttccaacattctttggttgattcctaataaggacagtttgcacagttacaatccaattaccgtttgtagatccctgtggaaaagaggattttttttagaggaatccttttctaactcgagtatatttcttcaaaatactctcattctttttgtcccttccctcccctctttcctcctccccaactctctctctctctcaccctctctctctctctctctctctcacacacacacacacacacacacacacacacacacacacaggcacacacgcatacaaacacacgcactcactcatttgtgcacttactcagggacacagcctgcctctgttctgaaaggacaggaacttctcaatgatccgatgaaaagattgcatatttttggtcccaagattcacagtagcggaggtctctggcaacaaaaggtatcgtgggagtcacagctatgccagctgggccatttctcagacattcaatatgatctgccatttcaggatgcattttttaccaaaaaaataatttttttaaaacagactcaacttcctactgcaagcttagttcagttagattagagaggacagcaaagacgcggctgattataatttatgggtaagcaatataaatatctatacttacactactttttcagaaaataattgtgataaagttttgtgattctttcacatccatcttgtgatttaggaagaaaactggaatgatcagtgtctgagatgtgtgacagctaaaaactgtctgtgtcaatatggatttatgagaaccttatttttagattaatgatgtggcagcttgaaatgagcaaactcaagcaggaaaggattgtgtcatgattaacagaacagcataattgagctaatttctgtaaaagattcgggcacaggctgttttgaagtctgaaagggtaaagtggtttatctttccctcttaacttcttgaatatgggtgcaacattttagttgctgtggctgtgataaatatgggtttaggggaacagtttggatattaaataaggctaataatacatcggatgtgcttgtgctgtcttttacaaaagaggaaactttaagcctctgaatttttaaacactgtctggctttcattattataagggtatgtctcataatgaaagggcttggtggtggaaagaggggaacatgaccctgatgtcccagatcccattatgccactgcagctgctttgctcatttgtaaagttagaggtttggattggtttatcatgaaatgttatgaaatacatatagtggttatgagtctaaattctagaacctaaagcctggcttcaaatcctaactctgccacttaattggtgtgtgctcttggcaagttacttaagttctgtgcctcagtttcttcatctgaaatatgggaataatgatggtaacatagtccttaggttgttgtaagaattaaatgagataatataaataaaaggcttagaacagtaactagcagagagcggaccatctataaatgtgagcagtatcttcaaggtctaatctatctccggaggtcgttctaatttcagtgaactaaatttaattagagaaagacaagtagaaccatcagctgctggccctgtcattaagaaatttctaattcatgccagtgtttccagtttttgcaaccctgagatttgtgcaggccatcttaccttcttcctcccatccaagactcgagagaagcttagaactgagaattaaattgatggccattagaaaagtccacaattcaactgggactacacagaaatgaaattgaccttttgctctgacgtttttgcccttgaggacttccagtatgtcccctctatgctaaccactggaaaggttctttccactggaaacaagatgtaagtgacatttgattttttagatggtgttagcccagccctgggtttgacaatgttcatttctacttctttagtttatcggtaacccaggtgaacaggccatttgcagataaccacttctatttcatgctagcatttgcatattttctaatatgctaaattatgttgtttgatttttttttttacaggctctctgggatgtttctcagagacaaaatcttaggagaggaggaaaatggtgatggcaaaaggcagatcctaatcatagatgtgtctttacttttagtccagtccaggggtcagcaaactttttccataaagggccagatggttacctttacggaagggcagcttcatggactgtgcagtctctgttgcaacaactcaactctgcaattgtggcctgtaggctgccacagaaaataacaatgaatgagtgtggctgtggttttcataaatcaataaaacttgatttatgaaaacaatcagtaggcagtacttggctccccggctagtcagcttgtatcagcaaaatccctgtcatcatccccatttcatagatgaggaaaatggggcatggggaatgtaagtagcttgctaaaaagccacatggctggctagtaagtggcaaaactgggactcaaactcaggcagcccagcttgccaccccttgcttttagccaccaggctatgctatacctatgtcaaccagtctctgcctgggctgctgggctcccaaaacctgcctggctcattccctcacctccttaagggttggtgcaaaaatcatgttctctgtaaggctgtcctggtagctcatgcagcactcctattcccctcaccctgtgctacctccttctctatctcttatcaccttgtaaaacttgctgtgtaattcagcacacatttcttaagagtttttggtgtctctaatacttccaagttaagatgctgtgttaggtccttcttgtatcaccataaaaatacctgagactgcgtaatttataaagaaaggaaaagaggtttaattggttcacagttctgcaggctatacaggaagcatggtggtgtcatctgctcagcttctagtaatgcccttgggtaacttgtactcaggatggaaggcaacagggaaccagcctgtcacatggtaagagcagaagcaagagagagagggaagaagtgccatgcccttttaaaaaaccatatctcacatgaactcagagcaagaattcactattgcaaggacagcaccaagatattcatgagggatccaccctcatgacacaaacacctcccaccaggccccacctccaacattagtgattgtatttcaacatgagatttggaggggacaaacatccaaaccacatcagatggtgatgcaaatttagagtggtgatgattaatattaattataacttaaatttccatttattcaggtcttgtgggagcttataagccttccacaagaaattcatttgtattgtctgatattatccctacaaactgagagttaagtcttgttcttttctccatcttaataatgagaaaaccgatgatcagagattttctgaatcttaccaaagaactgccatctatctgaatccaagtcttcaccaccatgccagtgagactcaacttttattatgcaaaaagtaagactcatctggggatgctgctttataatggaggtgcttgggacctattccctgtgactctaattctctaaatctaccttagagccaaaggaacctacgtgtttaacaatgatcattctgcccacgtgattccgatgccttgggtccacaaaccacattttgaacagccctgcctcaccccttgtttggccctggggagtttacagttggatgagattaaagagatgctgcagttagagactagccccaaggatgtaataaaacaatgtggtgtagaacaaaaccaaaattatttcaatcaattttatttcatgggaaaatcaagtctgtaaaggtgcaacttagctcaaaagaatgactttctgaataaagcatagatattagattgtttgggttttagtttgtcttttgcttctttttttctaaacatagagacatatacttctggtgggaaggaaatctctttagttaacacttttggtgagttgttctccagttaatcaagactctattgttttcaaactttttttggtttgcttcttttaattaggtttgtagtgtttgtacttattaatactagcttaaaataagccctatgattctgtttatgtgtataatacgtagaaaaatacatgtaaaatacacatagtaatgcatgatatataaacgaatatatagtacatatttttatgataaacaaaatatataaataattgttaatatttccagcaccatcattttaaggagattatatgtaatctgggcttaacagcagacttatttatgctaaaccaaggtttctcaacttctgcactgtagacaagttgatccagatagttgttgattttgggcagtagtcctgtgcattataaggtgcttagcagcatccctagcctctatcttctagctgccagtatcaaacgctgccccagttataacaaccaaaaatgtcttcagacattgctaaatgctcactgggggcaacattaccccaccaaggaccattatcctatatcattttatcatattgctgccctttattaatgctgtcacatagtaccctagaatagaaagatgtttttacaactgccaaggtctttagtctatccagagacattggatgaatttcaatttcatctacatttataaaatctaaacaaatttgaaatcatccattttcaatccttaaaaaaattccatgatgatcactcaaaagactagattcagaaagccttcaaatgagtcattcatttataagataaacagtcaccaaagaaaaatgctggtctggaccatgcatgtgagccttgagaaaccaccagaaacatattctagactgtgctggtaggctttggtgcccttcctgggtgcttgtttatcactttatggtccatgccatgagagtcaaagggagactatgacctttgtgttcatgtcttactgctcctatgaagtctgatgggtgggtataggtatcacggattaactcttccccgcgtcacctattatcacatttattttctcccctcatgtactggcatgggtttttcttggcttatcaacaggctatttcaaaagactgtctcttaatggtttattcgaatccagaatacagtttcccacatatatacaacattgtatgggttggttaggtttccaatttatttaactcatgatggggctggttcattagtccctagattgacaaatatttattcagtggctgttaagtgccaggtactgccttagataccgagaacatcaaaatgaataagccagacaagggtcttgccctcctgaatctagctgttgtatatggctgataatgcaaggccctaggactgggttgctggaatatggctgtagatgctacacaaatatgtgtagggcactacatgaccctaatctccatatcaggggttggcaaacaacagccagtgggccaaaagcagcctgatgcccgtttttgtatgacttgcaagctaagaattatgtttacatttctaaatagttgaaaaaaatttgaaggaaggatattttgtacacataaaattatatgagccttgacttttcatgtcatagataaaatttttggaatatttgtttatgtagggtctatggctgtttttgccctacaatggcaaaagttgagtaactgtggcagagaccataagacccacagagcgtaaagtatttactatatgtaattttctataattctattttatgggaaaagtgatttcagaattccagtcttgggacctctccagcacaaatcattggtgatggtacctgtagtatgaagcagcaccttagcatcaggtagcagggagataagaatctgatggaaggtcaaaacctacttttttaagtgtctgcgagcatgcccttcaccccaccaacttccttttctaatgctcccccttactcttgaattcatttcctattgctgccataacaaattatcacaaacttacaacacaaacttacataagtctcatgtgggcctcactgggctaaaatcaaaggccatgttccttctggaggctccaggagagaatccttggcttttcctgcactagaagctgtgtgcatttcttgtcttgtggctcctttttccatctgtaaagctagcagccaagctctttcaaatctttctctctcccacctctgcttccattatcacatttttgtctcgcttctgcctctacctctctccttgtgatgacattgcactcgcctggataattcagaataatctccccatctcaataatctgaaattaatagcatctgcaaagtcccttttaccatgtaaaataacatactcacaggttcctgggattcgggtatggacatctttaggggagacattattctaccaaccacaccttccacctgattacgccttactgtacttctctctacctccacagaacaaaatgtgggcagaggggcaactcacaagcttgcaacaaccagccagaatattgtagtggctaagagtggcttctgagagtgtcaggttcaagttaatttttttgttgagtgaaaaaataaggattatgtcatcacttcatttgtttaataaaagaaagcagggtcatgcttactctcagtttcagaaagtaacgtccttactattatgactgtcatagaaatagctttctttcccttggtagatttgtatctttctttgacaatggaggacttcttggattttctagacttactacatagcacttattatagcctaactgaacaatgtggatgcacactcaaactagaatctattcaagccttgagctcagtggttctcaaccctggctgcatgggagaatcattagggaacttcaggaaaaaaaatggacaaagaaaatgtggtacatatacacaatggagtattattcagccataaaaaagaatgagatcctgtcatttgcaacaacatggatgaaactggagattgtcatgctaagtgaagtaagccaggcacagaaagacaaacatcgcatgttcttacctatttgtgggttctaaaaatcaaagcaattgaactcatggatagagagtagaaggacggttaccacaggcttggaagggcagtgtgggggatcaggggaggtggggatagttaatggctacaaaaaataattagaattaatgaataagacctaccatttgatagcacaacagggtgactatagtcaacaataacttaactgtacatttttaaaataacttaaagagtggaattggatggtttgtaattcaaaggataaatgcttgaggggacagataccccattctccatgatgattattatgcattgcctgcctgtatcaaaacatctcatgtaccccataaatatataaacctactatgaacccacagaaatttaaaaagtaaaaataaggaaacaaaaaatacagatattgtcttggtcactgggtctgccataacaaaataacctcagatctctcttttggttaacaattccaaatataacaaagaagtttaaaaatccaagaagttaagaaccgtgggctgcaatatataatggactaaagtaaacttgaagcatcgcactttactttttattatgctaactgtagtcatttgtaaacagtttgaaaaaacatatattatttgattgtgttggaactgttttaattgagagtacaaaatcaaagctcaagaaaaatataaattggccaggttctgttttgccagacttagtaatgttttaattctgttttttcaaaagaaaataccattttcaccatgtccaaaactgggtgatcttccttctccccctgcaaacataattccctctgccattccccatcttggtgattagtgttactgtctgcccagttgctgaagctagaaactcaagagtcatcctagattaccccttctcttcccctcactgcatccagtttattctctagcatctatgtggttctaagtttctcccgtgtctgttcaaattggaatcagcatcccacttagcacggagtcttttctcatctccacatctttgacttgctctcccctttaattccttaggaaacttgtttccagtcatcttccctatatttcaaatctgctcatgttcctctctagctcaaagttcctgaatgactagccatcgtctatggaggaaaatctaatctggtttgcattgccaacagagacagccctacagaatctggccctgacttctgcttggcttcacctcttgcccttttcctccttccagccttgtaattccctgaacaagcctgttttctcaaactcatttgcctttgcacctgctgctaaagttgcattgctactgggcgaaccctgccccctcttactcaactttcaagcctccattgaaacactaccttctctataaagctttccttgatcctccagatagataacaaagccttgtctcctaggcattcattgcatttagtacttacttctagtaccacaatctctgtgttttatggattgtttgtgttcttcctacctgaaggttaactctgaggacgaggactgtgttgtcatcttaatagtcccaagcctaccacagagcttagcatctcatctgtgcttattaaatattgtttgaattaattaaccaggaggacttagtaaataagaacaaaatgtcccttctaggaattactttatttcagtcataagctatagttcacaggttgggaaactctagcccgccagccaaaaccagcctgctgtttttgtaaataaagttttattggcatatggccacactcgctgatttataaattatctgtggctgctttcatcccaccaagccagagttgagtagttgtaacagagatcacatggctcacaaagcctgatatattttctatgtggtctttacagaaaaagattgtcaaacccctactacagataattaagcccattggaggtcacatctttgattgcttttaaagaataggtatgtaattctgttttgacacttcaaataacagtcagctcccgtaggtacctaagcttgatatctaaaatttataaactcatctggggactttctatctgggagaaaataataataaaaaaaattccccaatagtgttccttgtagttctctaagcttagagggtgtgagtgaggggtacacccaaggcctgagtccccaaccataatgtctatatgtcctattttttcttagtctggttataccaaaaacataaaagaaagaaaaaattcaaaatacactggccccagaagaattttcttctgttcactgaatgtgactgcagcctcctcactttgactagatttgctcactcactcctctccccacatcccctcctgcatcaccctccctgagctcctcctgggttcctgctagtcttcatcattatccactggatataattcatacatgtcaaggcaaagaaactaaaagccataacttctttaacacttgctcaaattttgccttctcagtgaggtctttcctggctgctgtctctaaaactgcaaattcctttcttctacttccccttctttgcctttttctccttcctagcagttatcattatttcacacaccattccttttacttaccccgttcattttctgcccctaccagagtataatatattcatgtattaaatgagtgaatgaaatcccagataaagagggaaaatatcaaagaattaacatcatgccattcacttttggaatgaatacactagacaggaatttgtcaccagtgtgaaacaaagtgctatggcactttgttgctgggaccagtctttctgtctcccttctttaaggtgagtgacttcttttttatgtttttaagacagagttttgctcttgttgcccaggctggaatgcagtggtgtgatcttggctcactgcaacctccccctcccaggttcaagcgattctcctgcctcggcctcccaagtagctgggactacaggcatgcgccaccatgcctggctaattttgtatttttagtagagacgggcttttgccatgttggccaggctggtcttgaactcctgacctcaggtgatccacccacctcagcctcccaaagtgctgggattacaggtgtgagccaccacgtccaggcgagtgacttctttaagatggtgaagtcttatgggattctgttaagtgttccatttattgcaatgagtccctgcgtgggccagtacctctccttccctgatagaacttttctttcttgatcattgagcaacagtagctgcctcctcaaatctgttgcagcatgcctgatacatgagattcacaagaagtctttagtaaggagacactgggtttcagaggattgtaaagtactttttctttggacgtcactttcttactgtctgcattgagggtggagccatttaccctcagtggcctgcaagggtgtgcatgtgtacacatgagtacacttttaggattgtggaaatctttgctttgactctttgatgtggagtattttagcatcaaatgtctctataaatactgaacatcttcctgttgatcataactctaagcttattgtgttcacaataactcatgagagtgctacaaatagaacctcagtggttacaatattagcatagagtttaaagccctacattcttagcttgagtccttattccaaatcttataagttttatgatttggggagaattacttaacctcctcaagactcagtttcatcatctatattatattggtatatgttactatactattcatataatatgtcataagtataaactttactattataatatattctcatatattatactagattatattattaaattttacatgagataggtaaaaaatgttaaccacttcataaggttgttggagggattaactaaaaagcccttgactatggttaacagtaatatatgatctcaaatagctagaaggaggatattgaatgttagcaaccaaagaaataataagtgtttgagattagttactaattattagaaatatatatctaataaccatatgtatagaaatatcaccatgtgccccatgaatatgtacgatttttatttgccaattttaaaaaatgcccttggtgcagccgctggcacatggtaggctctccatacacactcatccccctatatctgatgtgtgtgatggcaattagcagcagcacagtgtttcacaaaagttagaagttcccatgtgttcccataaaaaggaggaagtaggaccctcacagtatctttctacatagtttcctcaggcctatatgcataatgagataagatcatgtgacccagcagatacttgagattttgacatttgcaactaactgagaaaatccacagtgaactaaaagaggatttgactttgggaattgagacccaattttggaacacaaaggtggtttgcttgactttattactaagagaggatgagatttgtgagaggtaagtgaactctgtaactcttgattttttttttttttttttttttggcctacagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaaggtaaggcctcttctgcctttctgccggggaacactgcaagtcaaatattggctctgccaaagccgtgagctgtgaactcttctcacacctaatattcacacaggaaggaaactacagcttcttggttgttggctggcattagtgtccatttgaaggacatgttcaagagggacaatttgcatgtcaggtaatacatttatttaaagggaaggtcaacttggagcattacaaaggaaagctgtgtgtatatcaacagtctatatggattctgaacaaccaattaaaaataattttcaggaaggtcatcttaaagggtcagaagaaaagctgtgtctatctcagtttggtttcaaaataacccatttgaaaagaatgccttaacactctgttaaacttgtcgtttgaccctatgccaactcagaatcagggattttaccgaacctaactcctttttagccagtttttcagctggtgtgttgtatgttgcactggagccagtgcacacctgattggctgatgtttgttttttaaacagatcctgattccagtaaagatgagacacatgtacttgaattccttgaatccataaaactttgtctctgtatgtttactgttgtctataaaggcactttttttttttttttgagatggagtctcgctctgttgccaggctggagtgcagtggcacaacctcagctcactgcaacctccacctcctgggttcaagtgattctcctacctcagcctcccaagtagctgggattataggtgcacaccaccacgcccagctaatttttgtgtttatagtagagacaaggtttcaccatgttggccaggatagcctcaatcccttgaccttgtgatctgcctgcctcagcctcccaaagtgctgtgctgggattacaggcgtgagccactgcacctggcctataaaggcactttttaatttgtattagtatgtagcagacagctactttgaggcagaatgaaaaactatgatgttatacacataaagtaaatctgccatgaaaagcaacattgggcagggtgcctgaaacttaaaggaaagcagaagagggataggaagcttctagaaactagaacatttccacggaggattttggtatctgcaaaacttctcttctactttgttttcttttggaggaggtcgaggggatgcttcatgaatatttattcataaatagttcatatatatatacacaacatatgtgcatatatatgtatacacatatacacacaaataggtggttctcaagcagggttgattttgctccccatgccctggggacatctggcaatgtctggatatacttttggtttttgcagcttaggggatggatgctcctagcatctagtgggtaaaggctgaggatgctgaccaacaccctataataaataggacagccccctgcaacaaaaattatcaggccccatgtgctgaagttgacctaccttgctgtacacacatacattcacattctgtcacccacagtgccagtggtgcagttctcttggctcagctgtggctaacagaaagaatgctggcttggaggtctaaagactaggacttgtgaactcatcctgtcactcctcacacctgtgagcttgggcgacttgcctctgcggtaggaggctcagttctttgaccagaaagagtagcacaaaaacactgaccagagtttttctttggatagtgagtcttagggccacgttttttcttgaagcagaacctgagactccattggaggttatgacagagttcagaagagagagatagacaaggccaatgggctgacaagacatgcatatttcactggcatatgccttgcacctttggctttcttgtcacggtttgttcactaccacaaccacagcatgttgtttccaagaggaaatccccaccctgttttattttttcatgctaatctcacacatagagaccctcagctcaaataagaagaaaatcacttaggcaattgtgaaaaatgaatactagtgactgtcaggccgtgtcgctcttatccttgagaaacgccctcctgccttacctggtattggtttggttgtagggtggagatgaggcctgttctccctccaacataactcacaaagtggcccatgtggggcccgggccaagagttttgtctccctttaataagcacagacattcttttcattcctaaggaaaaaaaaatggcaatattgttagcaaacttaatttgtagtgaagagaatgatgactttgaaaagtttttgaaacttggtttgaatgcacatcagataagatatcagggaacagatactctctgtggctttgtttttaaatccagttgatttttttctttgttcctgcttgttaaagagtccactaaacaaataacctttaccaaaaacaattttataaaacttgtctactagaggctctgtctccattaattatttctgaggctgtgtggttatccgcacatccagagaaagatttgtgctatcgaaatgtttgaagatattcccaggccacagcagttattttcatattttctgtcaaaataggaactaatgatttacaaataattttctcatttatagaggagagagggaattgtgtggctggtgaaagaaacaggcatcgcatgagggtttctgaagctactgaattgggcatatgaatatagacatcaaatatttactgagatccttggaatgtgtggctggtggcaagctctatgacagtagctttggtctaaatgtggccacttgatccccatgcaaaccttcaaatggaggttctcaacagggtcagattcactgtgtgaataattttcacaggaaaataaatactgtagccaggacctaaagcctaaagaaatgatgccaaacctaataggatataatgaaaatcatgatacaatgaaaatggacacatagtcaagctcacatttctgttctctgtcacattaggatgatcatagggatttatttgtggttatctatttgtagaaccctctcctgtgagtctggtgcttccagggttcaaatgaatgctattataacatgatcatcagctgccagaatttaccatagagaggaaagaattgaggatgggggagttgggaaattactgggtgatttcctagagtagaccacaagggtgggatccagagcacaagtggagggtttgaccttcttttacactataatgatagatgggcattagttatatggacactgatgcaagtgagttagaagatggtgggagggcacgtgggattttactccagattgcgtctcagcgtccaacaaaataggaagcaatttaatccactaggcgtgaggatggcgaagaggtcctggaggtttgaggaaagaggagaggagtggaagagagggcagctaacgggccagcaatgtcacaggattgcaggacaggccaaaaggtccgtttgaggttagtagctgggaattttaaatgaaaaataaacatcctggtatctaaacactgttaagctaaatacaccatatcggacttttaattccccagccttagttaatccaaatatcctcttttgagttaggacttttctagttcaattcaatgaaggtgaagagggacatggcagttgagaatatatctgtagtaggcaaaataatggacccccaatgatggccacatccacatccctggaacttgtgaatataatacctcacaggccaaaaggaactttgcaaacgtgatgagttaaggtccttgagatagggagattatcctggattgtctaggtgggctcaaactaatcacatgggtactttaaagtgcagaaattctcccagctgtaatcagggagatatgtgactatggaagcatggtcagagagatgcaatgttgccggcttcaaagatggagaaaggggccatgagccaaggaatgcagatggcctctacaagctagaaaagtcaaagggacaaattcttcccaaggggcctccagaaaggaacaaagctctgctgacacctcaattttagcccagcgagacccatttcagatttctggcctccagaactgtaagatgataaatttgagttgtttaagacactaagtctcttgtcattagttatagcagcactaggaagctaatacagtatccaaaggaatgattctaatcccacaacacagagtctcaactggataagaaaggaaattaggaagtaattcaataatataaagctgtaaattttgtcattaattatctataagctgaatgtgattccaaaataaagtaccaacagaatttttctttttgatgattttactaaattaatctaaacatcatctgggaaaataattaagtgaaggtagtcaggggaaatctgataaagagataaaatggagattaaccctgtccatttattaaaatgtgtcacaaaactgaagaattaaaaatgaaccaaaatacatatgaaaatttattacgtgataaatacggtatttttgtaaagggaaaaagatgggttattattgtatttgagataatgagacaatcatcattaagaaaataataaattgatatggaagaaagatttaaagattaaaaaatgaaactataaatgatgcaccagcagaaaacataggtagatatatatttttttacactagggaaggcctacccagaaaacataaacaaagagaggaacaagtttcactacattttaaaaaaatagaattatctctgacagataagcaaataactaaactttatagcacatttgacaaactaaaggctaacttctctattgcataaaactttattacaaattaatataaaaagaaaatctaaaatatagacaaattacaggtggctcacagaaaaatacaagtggtataaatagatttgaaaagatgctctccctcacattcattaaagaaatgcaacctaaacaccaaggagattttttttttctctcagagtggcatggctccaaaagttggatgatacacttcgtggggaaacaaacactctcatacactgttggtagaggtgtaaattgttgcaacagggtgcaaggcaatttggcaacatttgtctaaattgtatttatttatttattatttccatggttttttaggaacaggtggtatttggttacacgaataagttctttagtggtgatctgtgagattttggtgcagccatcacccaagcagtatacactgaacacaattcatagttttttatccctcacccctttcccaccctttctccctgagtccctgaagtctattgtgtcattcttatgcctttgcatcctcatagcttagctcccacctattagtgagaacatacaatgtctagttttccattcctgagttacttcacttagaataatagtctccaatcccatccaggtcgctgttaatgccattaattcattccttcttatggctgagtagtattccatcatacttatatatataccacagtttctttatccactcattgagtgatgggcatttgggttggttccacatttttgcagttgcgaattgtgtggctgtaaacatgtgtgtgcaagtatcttttctgtataatgacttcttttcctctgagtaaatgcccagtagcgagattactgggtcaaatggaagttctacttttagttctttaaggactctccaccctgttttctatagcagctgtactagtttacattcccaccagcagtgtagaagtgttccctgttcaccgcatccacaccaacatctattattttttgattttttgattatggccattcttgcaggagtaaggtggtatcacattgtgattttgatttgcatttccctgatcattagtgatgttgagcattttttatatgtttgttgtccatttgtatatctgcttttgagaattttctattcgtgtccttagcccactttttgatgggattgtttgtttttttcttgctaatgtgtttgagtttgttgtagattctgtatattcgtactttgtcaattgtatagattgtgaagattttgtcccactctgtgggttgtctgtttattctgctgacttttccttttggtgtgcaaaagctctttggtttaattaagtcccagctatttatctttctttttattgcatttgcttttgggttcttgcatttttctaaattttaaatggcccaaccattctacttctaagactgtatctcacagatacatacttgtatttgttggggtaggctaaccactcagtgccttaacaccactacaaaagtatatttcttactgaagcactatctaatgcaggttggcaatggggtgagaagggcaaactctcttccaggccgttattcagggacccaggcttcttgcatcttgtggctcctccctcctgtatatccatttagcctggagatgtacacactgaataactaataagataaaatagctgatgagcttaatttgttaccccttctaaacttaacatggttcaaaaagagacttttgaaaatgcttttgagaatctggagacatttttagtggttgaaatcaggaaccaatcattttccctgtgagcccaaaattactccatggaggcaagcatggactatctgattattcaaatggctactcttggcataggctcttggatcagactatctagtttgtaaatggccaactcttagtcacagaaccaggaaacaaatgtaaaaaatagtcaagaaattaagcaaaacctaatggtctacacaaacttttcacttatttaaaacacatccaaagagcactttttgtatatcaagtagtatgttaggtccaattaatattattttggtaacattttaatacaaatggtcaaaatcaggggttagcaactgaaccatggccaaaccaagcttaccatctgtctttgtaaataaagtcttactgaaacacagccatgctcattcatttacaattcgtctatgcctgttttcactcaatgtcagagttgagtagttgtgacattgtctcagaagtttactatctggccctttacaggaaaaatttgctgatgcctgatctaaggtaaaatgaaagaaaataacttattcctgccacaatcactatagcacgttagtgtaggcattatggcttaaccttattatattgtaaaccaatatttacagttgaatggttctataagacagaaatgcatatttgtgttttctttagagctgttttcttcttgtatcagttcatttctgatatcacaattgagaaaggctttgtttatgcattttgaaaacagtatcatggaatgaggaatagctgatggtttaagaaaatatggagaagagtctcataaaagagtaccccaatgcctcaaaattgctcaattatatggcttccttataaaatgatccctcgccattatcccttaggcaatgtcaaatccaagtacacaactcaatgaaataaggaaaattacattcttgctaggccaacactgcagctgtcttcagtttgtgatttaaatgttgatttagaaaataaaagtaacctggtaggcaaggaaattgagattgggtgtttatataacaacccttgacagaaaaatttaactgtcctatttctgttattctttctggcaatgcccagttgaagaggtgatgtgctagaactgtctgccaaagccttttgtgtaagtaaaaataaggttgaaacctggtgcagaatccacaaaatccactgtaggtagaaatgccaatgggaagcaaacaccaccaaatagggatgatcacggaataatgagaccactgtgcccagaggccctcaacaaaggtctctattctgtgaactgtggagctgattgtaccttctgtgtgtccacaatcaccttttctgtgatcttcacacaaaggatggtgacttcccatggagtagggctacgtcttattggtctttgatctggaacatcatctgtactgcctaatacacaagtggccctcagcaaatctttgagatgtgaatggatgcgtgcaggcatattatttaataataagcttttaaattaagctctttctctcactcttccccatatctctaaagagcatcgatcacctttctcccactgtccccagtgtctccagtaatgattttaaaacaacctcaacacttccttactccttcacttcatgctcagtttccagctttcattgatggtctcatagggttgatgtgagatttaaatgaaataataaccataatgagcttaaatcacttcctgacatcttatatactctccataaaacttatccatcaccatcatcatcatcatcattgtcatttttgccatcaccatatcactttgtcctgtatctcccctcaaccctatgtcactgcatcattatgcttgattttaattatagtcatagaacccctacctactttcctcaattcagggcttctcctctattctatctaccacacgtaaaatcaccagagtgaaacttcaaccacagtggctactcctttgttggaaaaacaaaaagcaaacaaaaatcccaaggctccctattgtctactgatcttactatcaaagccattttatatgagatactatctatttcatataaaagaagaaatccatttagtttgcagcctgttctcagaatgcaccacagacttttatttgtttacttgtcttagaacagcaggttgcagattttttgtccacaacctatctgcagtgagaagtacattttacatctcagcccaggaaatgcatgaagccaaacagcttatctttatcagagatacatttggatattctttataatattctctcctatcctcttctatctgattctctttcattttcaaaatatgttttcatgatccactgaattttcttgatttattaataggttataaaccactattcaataacacagtcttggaaggtatatggaatagagaacagggaatcacaaaggaagcaacaaaaatatcagtatggaaaaattagttgatctttgctgtggctctcagggccttgataaggtggacgggaacttctttttccatagggccatggtgatgaacctaaggctagagccatacctgagtatcttatgccttctctctctagagccaaactgagggagtgacacccagagggcttcctacaaggcctcacagctctttcctcataataccaagggttatgcaacctgaaggagatacatatgtggggctttaaggtctagctgcgatagaggattcaacactatgtcaaaaggagttcctatcatcgagtagttcctagtcaatagacagagaaaacacagatgcatcaattatattaaaagatagagcagtggagatgatctgtccaagttgactttggtgaccctttagatagaagctgcctcatccacccactctggtaaaagccaagaatgacaaagacattatcctgcaggttattttgtaattttcttcttggatgctcttcctagcaccccagggtttttaccatgtaaagttctcaagtgtctgctgccactatatgatgctatgttggtgccaagcaggtgtgggattctttaagccatgtgctttgtaccatggtattcacaaattacttcctttatgttctcagacaatatcgttttctatccaaggtcttgtctcaactggtcatatttatacatattcgtatgtcttgttggagcagcaaccactattgcacaagactttggcatcttgaccaaaacttctgtcactgcagtttctgaaatattctggcacctttcaaagatttcaagactgcactatattctcttttgggatcatagcccaaaataaacttgataattatgaagaatatcccatccttcaaacatgaacattttgccttttttcttggtttccccatgggcaaaataaaagcaaatacgtatacgttgaaatttaatgctgagtgtattttttaaccaatcagcctttttaggtcatttggaatcaagccctcaagattacttaaaaattcaactagtgggtgttactagagctttacatatggaaagctctggaagagtagtttaacaggttttcacttaagatagatgtgggcaaactaagctcatgggccatagccagtccattgcctgtttttatatttttattaaaacccagccatgtccatttctttctgtattgcctgtgactgctttagtgctacagtggcagagttgagtagttttgacagagaccttatggcccacaagatcaaaagtatttattctctggatctttacagaaaaaaagcttgccaacccctaatttgaaattaatattatagtaattcattgttattttttatgcagttgttcaactatactattcctgttcatttcaatttcttcattattttaatttcatgatgtagtaattgtgtgctttttaaggatcagacctttgttattcttagatgttttagtgcttatattacagtcatgcattgcttaatgacagattcatactgagaaatgcatcattagatgattttgacagtgtgcaaaacttaatagagtatacttacacaaacctagatggcatagcctactacacacctaggcgatatggtagagcctactgctcctaggctataaacctatacagcatgttcctgtactgaacactgtaggtaattggaatgcaatggtaggtatctatgtatctaaacatagaaaaggcatagtagaaatattgcataaaagataaaaaatagtatagctgtatgaagcacctccattataatcttttcagaccactgtcttatatatggcctgttgaccaaagcattgttatgtggcacatgactgcatatgtgaccaaatattttttcaaggtgagatgagttcctttggtggcattaagcaaaaaataaaagtcaatatttttatgactggtttaaacaactgatgccaccatgcagtctatagacacatgagttatgcattaaatgggtaactttaataagtcaatcttcattacaagttattactttcactattactatcttgtttgatgactgagaagttagcaatattcccttctcatgtcctagaattgcaacacctgccagtgcccaaatcaatactgggaagtagaaataaatcactgggattggcttgaactaagggttcatttcccgagtttggggtgataactcatcccaggatgagttgcatggaggatgagcaactgacaaaatggagcaaggaagaattgcagtgagtaggtggaggggagcaggatagagatggatttagattaaaaactactggtatacggaagaacattgtcatcttctgccattgcagacaagtgatagagaggaaaccattcttattttatttgctttagcgtctagcacagtgccttatacatacctacagcacaataaatatttgaaaaattaaatgagatacattaaaaattcaatcatagcacatttatgtatatagtgtttccatagcatatggaattgttttgaatggctcaaaggataatcaaaaacatggaatggataagaaaaggataggtagtataatagtttcatttaattgcatcatcttttcaggtactgaatcagagagagctgttttcatgggagcaactggcaggaaattctaggcatttccaagactttaacaagtaatgataagactcccaaaatttgggttttaattttcttgagttaaccacctagaatatttattagggaaaaatgatttttgtatttttgttctcctgcctacttcctttcatttacactccaggaatgaaatgtagcttaaaaaaatgacttggcaaaagccattttccctgccccgatatttggaaactcctgtctctacaaatacagtgcctacctagactaaactaaaagtattgtcctccatttaaggactgttcaatgaaagatacaaattcaggagcctggaaggacatactagctcctagatcatgaaaagtcagcagcagagctgcccctttgagacatgtgctgaaagctttgaaaaaaaaatcttctttaaaaaaaatcatataacttgactgtggaaaaatgaaagcaagtaaaagatccttctagggcataatttgatcattagcagttcttacagcaagcagtgattacaaagaacacctagttaaggaaaaaccatagttgagcctttaaagctatggcatctaaaccatgagatcagcttccctacctcatgttttgacggaacaaggagacgtgttcaacaaatcaaatatcttaatgatttttctgtaatagaaaaccacttgctttgaggttcgaggatccagaagttttttttctcctcttgaagatgatatagaaaaattttagaactaatcaccctgccagaataatttacacaaaacagaataggtttcttcttagtgtttaactgaaggcatggtgacctccaagagtcgactttctctacagcagtgagagactcacagaatgttcttattttctgaccacacctttgataatttcaccaccacttcaacatgtaaactgtggggattagtacatttcacaagtactttggggagcctcagccctaaggagaggcatcgctattgcttaagaataccataaaacattttcttctccagggaaacatagacactttggaaagagattttggaaatcctagcccacaaagtgctagcaggaaaaagaaagtgtttaattcactgggacttataccaacaaaagtgaaccaatcaccctgttcctatctgcctttgtctatttcaattaaagttagtggaagaactgttaagtataagttaataagcaaaaactttgataacatgagtttggttaaataaccaacaatctagggtatgaaagatttcttgaagatgacacacgcgcacacacacacacacacacacacacacacacacacacacacacgtatccagcattgcctgaatgatgggaccagtttgggcttgaatacgttttccattattttccatatagattgttttcttccacaattattattttcccctctcttgaaccctggttcccacttaagaaactagcaatccactcctgaatttgcaattttctcatctttttcaccaatagaatgcttagttggtaaagggttggattataaggaatcaaacattaaaagggatagggtaatcagaaaggaaggatgtcctaaactaagctggtggaaacccccaccaaaattcaaagaccccagagagggataacttcatcccttaaggttgaactcaaacattagcctttgcaagcagaactggaagcagtcttctctcttttgtcctggcacctagtaaatgtcttctcctcactgaagcatttcttcatattgcttttttttttttttttgtcgcccaggctggagtgcagtgacactactctgtcgctccggctggagtgcagtgacacgatcatagctcactgcagcctcaacctcccaaggctcaggcgatccccctgcctcagccccccaccccaccccaccccacccagtagctgggactacaggcacgtgccaccatgcccagctaatttttgtatttttagtacagacaggatttcagcacgttgcccaggatggtctcaaacttcttagctcaagggatccacctgcctcggtgtcccaaagtgctgggattacagatacgagccaccatgcccggcctcattttgctttaattaggtttccacatgtctatctctagcactgaattttgaatttttcaaaggcagagatagcattcattcatctgggttcatagcacctagctcagaatctcacctattgatcaatcaaagggtggatgggtggatggatagatcagtgtatggaagatgacatttaaacagataactattatattgtaaataatattcccaagccaagaatagtcatcatgttctatggtacaacatccctgggcagagaatacttgcttaagaatagggaagagatccctgttttggctcccttcctaaatctctgggattcatcccaggttaactcttaaaccagagcattgcattggtcccactgttttccctttcctggtcccactggtttcgctttcctagattactattcctcttttctatcagagctgctatccattccatttcttgggatagactttgaatatgaagcaggcaactcaaagtagaaggagcaattttgaattcattccactcggggtggcaatggcagtaagtggatcctttgtccagcctgacttgtcctcaggtaacacctgttttcctatgtaaacttactgggccaatttaacttatgttgctgggattaatcattagaaagcaccaaacatggagtacaggcacaatgaatggctcccaagtgccaggggtcattaataatattgttacttctttaacaaacctcctgttccaaactggaaataaaatatctggttcagtctttctcttgccttattttttgggaggtctgtggcttgaaagccacaaagaaaagccctcaaagtgagaaataatgagatgaaataatgaattttagttttaataaaggacaaaatatggtattactaaacctttttacaggatatccacagatcatataactcaattcacatttatatgtacatatatatgtaaagagatgttatattttattttaaaaacaatattttggtttacagaataggcattggagcttaaaaatagatttctgtactaatcaaataatcggtgttcatgaatgcaaatgaaaaatactgtctggataacttaagcagaaaaaggatttagagaacctaagatttagaatcttacaacaacctaataagccacctatgaaaaaatcaccagccccataaaaacaaatctggtccatcttgttagctgtccactccctttccagcaaacaggctccaccagaatggcaaacataatagatgtttcatgtcagcttaggcacatgttttctttcagatcaaggagatgcaaataggagattatttcactagtttcagcctggcttgtgagtcacctcccttcttgtcactaaactgagctttcagttctgtggagcacttcagtgagcaatacaggcctccattttctcacatgcttgataagtgagtttccaacctttgcttgaatacatctggtgcctgggagaaaggacttatttttttttaattttggaataattttagaattacagagagttatgaagatagtatagagttcccttatgccccttacccagtttgccctgttaacataataacataacctcaatgctattatggtaacattaataccataaatgtattaccttggtacatttatcacagctaagaaaccaacattggtgcattgctatcaacaaaactatagacttcactcagatttcaccagtttccacactaatgttatttgtctcttccagaatcctattcaggataccacattgcatttaactgggcatcttttcttatctttttatttttatttttcaaataacaaacatttatcttgtaaaacagcttctgtgaatagcttagcttgggtgttctggttcaggggctcctgtgaagttgcagccaagcaaagatggggctgcagtcatcttagggcttgattggggctggaggagcagttcccaggctcactagtatagctttcagctggagacttaccccttagctttttgcatagggctgctcctgacctggtttctcacaaagtggaggggtgcaagacagaatacaaccaaatggaagccacaatgaatgatgctttgttttgaggcagctcattccactggttccatttgctggctagactgtcttcctatgatatcttcctgaattttcattctggcccatggagggctggccagtaagtctcttcatccaccatgtttagtcctctaaataaaaggaaagaaccacaatgtctcctgagtcttctctaaatgctaaacatccattcatacaactgttgactatcagagggtgttccatacctgatcctgccccacccaaggagaaaaaaacagttcatataaagaaatacaaggctatttcctcaagaaacttggcttattcccccatctgtagtcctagaaatttggtagaaagataattatatgcagactcccatttcttcgtaaattaaagaaaattgctattgtgtcccaaagtcagtgtgatacataaaggcttcataatttgtaaacacttttacattgttctgtttaaaacagaaactgagataaagtataacttgagcattgtgacaagtgggaaaatgtgaatgttttgttcacatttacatgatttgggttcatagctgctctctaagttgagttatacatagaccagtggttctcaactggagtaagtttagtccctggaggacatttggtgatgtccagagacatcgtgtgtggtcacaacagtggtggggtgctctggcatctagtagataaaggccagggaatgctgctaaacatcctacgaagcacaggactattctccactgaaaagttatctggccccaaatatcgctagtgcctaggctgagaaatcctggcacagattatatgcagtttctaaagggccacttccctactctgccacccaagtgtatctttttaaatcattttcccctcactttttcattgagctctcctcattgcctatgaatttcattggtttgctttctccgagagtcaattttattggtccaaatacatagtaaggcagctgtggctaatgaaacaggagatggtgccaaaaagcattccttcagtcttttctcagcaggatttttttcaaagctttgaataagctaggaccttccttttaggctagggtaggttcacaaactctgaggcataccaggtaatgtaagtgggtacagtggcccagggttgggtgcctatgctgccttggggcacatgtgaggaatgtgggacccagtgttgccagctcttccactttcctcaagaggctggaactctagatatgtatgtgaactttccaagattttgcattaggacttaactttttataaaactttgtgtgggctaaaaaccacctgaatagtaggggactggatatggccattttgcacccatgaggctggaaatttgcctgtgtgtgtagcagcaccagaggaggtctttgtccccagcagacatttagattcttttccaccctcatgtcatatttcagtgcaggtgatttcctttcctttccagtaatgtaatctttattgagctctgcaagtgaagaaatttaaaagggcttaaacattgatgccatatcccacattcaggtgcacctgtgaattgaggctgtttacactcattccccatgattgcctggatgagaaatgagccttagcgcttcttgcccatcatccagacttctgggagggcagagtctaaatgcattgcacaaatggatgtccgctgttttacaaacacctcctggataggagagccctgaaccatctctcatgttgcaaaggcaaagtgaccttaaagaaggacttccagcttctcctcataggcatctgggttctgctcttagccacacctctcaagacagaactgcgcttattggaaagaacttgaatttggcattgaatgtcagccctgccacctaccagttctgtgattttgagagaatttgcgttaattctctgattttcagttctctcaattgtaaaatgaataaatcaaaatgctatcccaatggatcgtgtgttgacacgtattaggtatatgatataaatatttcatatcattaaaaaaaagtacttcttccagtgccagtgcatatttagagcttggaaattgttagtttttcattcccctccctctctaactctatgttaccttgggcatgccagttcatgtatctggctcttactgtcacatccctgaaataggcaccacatttcctccactacagcgtaaggtagaggttagagcatgatatggtttggctgtgtccttacccaaatctcatcttgaattgtagttatgggaatataatacccatgtgtggtgggagggacccagtgggaggtaattgaatcatggggactgttacccccatgctgttctcgtaatagtgagttcgcacacgagctgatggttttataaggggcatcccccacttcgctctgcaattctccttgctgctgccatgtgaagaatgacatgtttgcttccccttccacaatgattgtaagtttcctgaggcctccccagccctgcgaaactgagtcaattaaacctctttcatttataaattacccagtctcagttatgtccttatagcagggtgagaatgcactaatacaataaattgataccagtagagttgggtgctgctataaggatacccgaaaatgcggaagcaactttggaactgagtaataggcaaaggttggagccatttggagggctcagaagaagacaggaaaatctgggaaagtttggaacttcctagagacagagggctcagaaactttgaaacttagaaagtttgaaagtttgaaacttcctagagacttgttgaatggctttgaccaaaatgctgataatgatatggacagtgaagttaggctgaggtggtcttagatggagatgaggaatttgttgggaactgaaataaagttgactcttgctgtgctttagcaaacagactggtagcattttgcccctgccctagagatctgtgggactttgaacttgagaaagatgatttagggtatctggtggaagaaacttctaagcagcaaaaccttcaagaggaagcaaagcataagagtttcgaaaatttgcagcctgatgatgcaatagaaaagaaaaacccattttctggggagaaattcaagctggctgcagaaatttgcataagtaacaaggagccaaatgctaaccaccaagacaatggggaaaatgtctccagggcatgtcagagacctgcacggcagcccctcccatcacaggcccaaaggcctaggagggaaaaatggtttcctgggcctggcccagggccccccggctctatgcagccttaggacatggtgccctgagttccagctgcttcagctccagctgtggctacaaggggccaaggtatagctcaggctgttgcttggtgcaagccccaagccttggcagcttacatgtggtgttggtcccgtgggtacacagaagtcaagaattgcagtttgggaacctccacctagattttagagaatgtatggaaacacctggatgtccaggcagaagtctgctgcaggggcatagccctcatggaaacctctgctagggcagtgtggaagggaaatgtggggttgaagtccccacagagagtccccactggggcactgtctagaggagctgtgagaagagggccacagtcctccagaccccagatgtcatctatatagcaggaatcatacaggctgcagcctcttcagattggcttctttcacttagcaatatgtatttcaagttcctcttgatcattttgtggcttgctagatcatttcttataatttctgaatagtattccattgtatgaatgtaccataatttatttatgcactcacccattgaaggatatattagttgcttccaaatttttgcaatgatagataaagctggttaaacactggcatacaagtttttgtgtggacgtaagttttcagttcatttgggtagttaccaaggagtgcaactgttagattgtatggctcagctatgtttagttttgtaagactatgcttagtttttgcaacatttggcaaccctattctcaatgagttgcacctcttttgaagaggtaaagaacaagcatatacttcaatgagaaaagccataaaggacatctgaaagtcatgttcattcattcatacattcattcattcacttgatatttgagcacagtcatgtgctagaccctggaaatacaaacaaacattggcaatggaaaaaatgcatgctgtaaaacaaagcaaagcagcataacaagggcagtaggaaaggctccaaatatgcaagtgacagaacaaagatggagaaattttccctgcagcagtttcaagagaggctcagagaggtatgaactagtgaagtaacacattttttacccttctcctacactgggtctgaggacacagctatcgtgaaacaggtgaccccacgcaggatcctacagaaaaacaactaaatcacgtttgtgaaactcagaactacaagctcttcctcatgatttggacaatagatgctttcaaagagtggttatttttcctatattttccttcccttctcttaatggagaattccttcttccaccctgaaaaggaaatacgaccatcagtttcccaaataaaaagagggaaatacatatgtgtataaacggtggtgaccacctagtagaattttaagcctttgtttaaggatattttccccctaaggactgcaatttcctaagttgagtcaacattcagaacttcagttaccattgtcctatgtgagatttgtgtgtcttgtatccaatgtactagttaggtatttctttataggctttttaagatttacaggtgtacctgatcaaaaatagctggaaagatctgagatggtttttactggataatttattccatgtgtacccaacagccaagcacttggcaaatgaccaaaaaatatgattttaaaagccagaatagctcatgcaagaaataagtagctgagagataaagaaaaaatggcaacgttatgctttaatggcaatgtaaactatctagaagggacatttatcagttcaacaagaattaattttcttcactctcaactcctatgaacaagccttctccttctaaaaggtaggaatgtctgccccagtaattaattgtttatgggtaactagtacatcacgaaaatctctataagacatctttctctggcacatattttatctttatactagatggaagataacaaccaagtgagctgtttgttgaatagggcacacttcaaagccaggtatggatatctgatttaatgcgcattagcaggacatcagtgcaattgttgtgtgagtactgaggcaagtaggcaaatggcggggtgaacttcactccttaaaatagtgagctaaacagacgtgaactacctaagttgtttgaatttgttccacatgctcttttaaaatgatataagacaaaagagatttaactggttaattagtgaaaatctagtaacaaaaaatgtctggttaattcatggaaaatgggaactttgaataaatttcaagataacgtttgaattaggccaataaagttaattcttgtgtttgcataaacacaaagattggagaattgctgtgtattcaccatttactctttcaaatgaccattactttatttagtacgtgtgtattgtgcacctcctgtatggctgggaacataccagtttccaaaaataaaattaggactatgataaagtttttacactctagggtaacagttcagtaaataacagccacaatacagggtttgagaggtacagaaccactaaaagagaggaaagggggcacaattttgtttgagaactaacagggtccagaaaaggtgaagaactaggtggtctttgacacaagtcttaaaagagtaagtaggcacttgccacacatagaggaaagaaagtgtagcagacaaatagaccagtcatgattattaactatcaactagttcatcttttttattttttatttttttgttcctttttgagatggagtctccctctgtcgcccaggctggagtgcagtggcatgatcttggctcactgtaacctctacctcctgggttcaagcgattctcctgcctcagcctccctgagtcactgggactacaggcacacgccaccaagcccagctaattttttttttttgtgtgtatttttagtagagatgaggtttcaccatgttggccaggctggtctcgaactcttggcctcaggtgatctgccggcctcagcctcccaaagtgctgggattacaggtgtaagccaccacacccggcctgtctttaccatttacttgcttttcattcctggacaacactgatctcagggaggtagtgagtagaacggtggttaccagagggtggaaacagtagcagggttgacggggataaagaaatgctggacaatggatacaaacatacagttagagagaagaaataagttctagggttcaatagcacactcgaataactgtagttatcatgtatttcaaaatacctagaagacatttgcgatgttctcaacacaaaaaattgataaaagtttgaggtgatgaatatcccaactactctgatttgatctttacatattcatgaatcaaaatatcacatttactccatacatatttacaactattatatatcaataaaaatcatgaagatattggtaactaatagctaacatttattcaacatgtaccatatgtctaaccttctcaccatcattgtttcctgtgacacagtaaccctctgacacagataccatcatcactgttttacaaataaataagaaaaattatttcaatgtgctttgggtgagcagcactgagagagccctgattcacctggataagaatgcaatgtgcggcctggctcaatttgacatctcagagcttttgtactctgagtgcaataaatcaggtgtatgcacagaaatcagggcagacttaagctcctcctaaggagtgagtcaagtattttgtgatttgactggatcaccttaatttagatatcttcacaaagatataagcctaggactccaagatgaaattttaacatcagggaaatgagatggtcctttccctctgctatcaggagaaaccctctccaagaggcagggaggcaaaagactgtttctcttcagtttcagttgctgaaataaaggacttgccactggtctgtgggcaaaatttcttgggcactgtctttgcatatgacctctgaattttgttcagtacatcactgctctaaggatatatttagtgcttttactttgcattttaacattcagctgctgagtgagacaatattaggagacatgatgctcttgatatcagccattcttcaaagcgggtgtttattatggaataaaagaaaatacgtgcttcagtctagaatttaaaagcactaactgcaatttttcaagcatatgtatgtaaattaaagttacctgtcttaccattttcttgagaaaagtgtatctttacgtttgttttagtgcgacttgtttctgatatcctaacctaaaatttcatggtcacaaatatataaattaaacgttatcttaatgaaaaaataaaacaggggctatagcacaagagatgtgaggaaaatagtcacacacacacaaaaagtaaccaagagtgaaccctgaagtaatctatggacttggggtgataatgatgtgtcaatgtaatttcatggagtgcaacaaaggcaccactctggtggggtacatggatagtggggaatgctatggtggcagaacagggggtaaatgagaaatctctagaccttcagatcaatttgttgtgaactaaaaacaattctaaaaaacaaagtcatatatatgtgtgtgtgtgtgcatatattcacatatacgtatatgcatatatatatgcatattatctatatacatacatgtatatgcatatatacatacacacacacacatatatacgtatatacacacatttatacacacacacacacacacacacacacacactcctaataacttttaaggtcaaaaactttcttcccttcagaatatctgccagagtgacttcaagtacacagttactcatttgaggtactaaggggtgacataaatatcaacttttggccgggcgcggtggctcatgcctgtaatcccagcactttgggacgccaaggcaggcagatcacgaggtcaagagattgagaccatcctggccaacatgctgaaaccccgtctctactaaaaatacaaaaattagctgggtgtggtggcgtgtgcctgtagtcccagctactcgggaggctgagggaggagaatcgcttgaactcgggagacagaggttgcagtgagccaagatcatgccactgcactccagcctggtgacagagtgagaaagactccttctcaaaaagaataaaaataaaaataaatcaactgttccatcactaaataccttgtggtgtctttctcatccttccactgtagaatagtcagatagcccagtatgtataatagaactctcacatggacctctgcagtgcttattttgcctctgtaactactgaaagagatctcaaataaggatcttcttagaaacttgaagtagtacttagacttacacatcaacacatgctttgggtaaaaggaaaatcctttatgaaaatgcaagctttaagaattaaatgctccccataaggattcacttattcctgtataagtgactgtaggcagaaaaacagaatctgaatgaactttttttttctttaacttggaaaaccttgaaaagataagagtggtatataggggccaattaaaatgaaaagaacaagggaaaatgagagtaagtctctcctctcctcccaatgagggtattgtgttctgaacaattcatgaatggaatttcagaaactcagcaaaagaatacatttaactgacttattccaaatatattctgaatttcatatttactaaagtgtttccaaatgaacattttgtatgttatgtgcaaaaactgcacattaaaaaggaaaggtaagagagttcatcatacaagattttagatgcatgcatacttaaactaacttccacatactccacaaatactaaacttaaaaaacaaagcaccctacataatttaccttgccatagatgtgaagtaattgttaagcatacataaatgttaataaaatactttgaatcaatgctgaggggtggtatcattgaatggtggaccaaaacaaactaaatggcattttgatgtctttggaaatgacatacccacaagccaatggctcagcactgacatttatatatcctgctcagttgtctcaatcatttatagtagtttaatttttttcaagaacacagatgttaaggtaagtttaataattttgaaaggccatagagtatatctattttttgaagtcatactttcattggaattgtctctttaacctaatgaataaatacaaagaatgcacagataaaataagttttgtcttcttttattagagaaaaatgtactgttccatgcctgtgctttctacagttttggaacggatacagatccacagaggccaaacctaaaactaaattatctttaatgttaaaatttaactgaccatgtatataactgtgcaattgctgctttctcacagaactgtctagggttcattcaacagatcacagtaacgaggtctggcatttaacaaacaaactaatgatagaggagatacactaatttatacgagaattaactaaatactgtcatgtggtttagtgtagctcaagttatgcttgtatcatataacataggttcaagttttttcatcagccatcagaataacagtggttaaagagacatctgaataagtgccaactcttactgcagttgtctcaaaaaaagaaatttaagtaattgcaatatacatttctacaaataaaatattccagtgcttacatcaatcctgagtttttaagattaaatatgcagtacttatggtctccgacacaattttattttggaacacggtgatgtattttttaagttgactttcttcaccactttcttcaccaaaaagagggctttcattatactcttccaagtcctcaatactctaaaacaaaaagtctagttcactgacaaaccatcactttacatctcaggttttaaacagggtaaattagatgtcaaaggaaacagcttttaatattcaaaggatgctggttatttatttcaaatttaaaaactgtaatcaatacatggagctccaaatacttaaattttttaattccagatttcagtgaaatattattatagcaggtccaacagtcatgtagtttgcttgaataaaatggcttgatgaacatgttacagacaagatggaccaaagacagaaaaagactgtcagtcttatatcatggaataccatattttttcaccaggtagtgaccatttgttatcactaatagtccacataacgtggttttcattgaagggataaaatggtctgtgatatgacctaatcaagttggggaaaacataactacgtatgaaacatatactagtccctcaacaaatagttcagcagttcatagtccctaaaatgttgtatgttaatactgaggaagacgtaaaaaatgagtacacaatctcttccgtattcctgtgacatgagcaaatgcacgaataaaaaaaaaagtaatacaaaacttgtgttactgctatggaagagcaactcactcggacatgtagccaaaaatggagactgatgtcgacttagttggcacaagatttcaatcagtcaaaaaaaaaaaaagaaaaaagaaaaagaaagattttaaaagcatttggagggaagggcatgagcaaagcatgggagtaacggtgagttccttcagggaaggctgtcaatctggagagttgggaggaaagacagagggtggcaaaacaagcctaagagggggtcatgtaaaggggagagtctctgaatatctaagaactgagacatgggcaccactgacaggctgggaagagggaagggctaggaagcattttagaaaggggagagtgttaggaagatagtattgcccatcagtgaaggatggctcagaagagaagagataactcagaaaagagcttaataatacaagcaaggaagaatgaggtcttgaactagggcagcctcagtagggatttaaagaaagaaattaaaggaccattacagcggtaaacgtgcctcgcaataactgcatgggaaggataatggactcagaggagtccaagatgataccaaagtttctaccctaaggggtaacatgtagcattaacattgacaggataacttttctagtttaatgttcataccaattaataaatagtttctgaggaacattatagcaacatgttctcttctcgtgacttctatgtaaataactgtttgtgtacagatcatccttaagttgcttgaaaattttattttcaaacgcttttcctagtttatttaacacatctcagttagtgtagaggagtgacatatgagcatgtcttttcacaaggttattaaaaagaatacctcccaaaagaaaattacattgtttcctaaataatatacatctacatgaagaagaggtcattgtccaataacgattagctaatatgctatatgacagcagataattcacaattcacaaagtgttaataatctgctggctttcacattctgttatacatctgaaccatctcttatgattacaaattttcatgtaaaaccattactagtcactaatagttttgaaagggaatatgccataaaacactcctacattccagcaggaaataaaagagatactcagtagtcaacacttgcctacttcctatttaactaaaactgtttaaacaagacaagtaaaaaagacatccagtaaggatttatggacttcctgcattccactaaagatctgtcgctgatctcctaaaaactgaatatgaaatcttcattaatgtattcataaagtatcaattttatacacaagatttatatttccaggtaaaatttccaatttaccttttcctgttttaaataactcccacaaaactattcatgaatcctaaaaatacacttaccaattatgttaaatctggaacaatacaaagtgaaaatggtaagtaatttataatgtataaccaaaaggtctgtccacttggaaccaacccaaatgtccaccaatgatagactggattaagaaaatgtggcatatatacaccatggaataccatgcagccaaaaaaaaggatgagttcatgtcctttgtagggacatggatgaagctggaaaccatcattctcagcaaactatcgcaaggacgaaaaccaaacaccgcatgttctcactcataggtgggaattgaacaatgagatcacatggacacaggaaggggaacatcacactctggggactgttgtggggtcgggggagggatagcattgggagatatacctaatgtaaatgacgagttaacgggtgcagcacactaacatggcacatgtatacaatgtaacaaacctgcactttgtgcatatataccctagaacttaaaggataattaaaaaaaaaaagaaactctcggggccaactgaattttataaaaatgaatttgttgtttggtgaaaaaagtaaaaactataaatcctagaagtcagttaaaggatacctgtaaagctctgtggaacaaatattaataaagtcaaactgatcaaaaaaaaaggtctttccatacattcagaaacaagcagactgtcttctatttttgttcatgagttgtattttataagaacgtattgtgttaccaaatagaacagacctttgtgaattgctcatgtggcggctcaatctctttcagttcctttcccatcttgttgccgtctcttttgttgctcttgaaatattctctagaagcacaaaactaaaaagtgattaaaatcggataaattttaatacttacaaaacataattctgcattagctttaaatggatactctttaaatcaatacttctgaacactattagacaacatttatgaccaattttaaacagttgtgttcaccactcatatgctaaaacaacataatctttctcatcagtcatggagtaaagaatattctttcttatatatattcaacatgtatgtcctaattcttggtttcaaatgaagagtatttgatgacccttcctacaatttgttgaccacagatagttaatttctaatacagatctttcttacctaagaaacattcttttttactaagattttaaacacttggtcatttcagtatgcacatagatgaaccttccaacaatgattgcctttctgcaccttgacctaatctccaacaacagtgttctcctctcctctatgtggcactcactcacacagtcatcccctagattttgtcattcccaatggctgcaacatctcccgtaataataataatagcaatgatagcaacgataaagagcaaccatgggtgagatcgcatcctgaaaattttaaataaacccattacataagaaccctttaatccttcaaacaactctgaggtaggtactcttaccatgtctcctttcatagataaggcaactgaggcacagagataaataatttgcccatatttccaagctagcaatggtcaaactggagttggatcccaagcaatgtggctgcagagtcccagcccctgaccactccactcagctatttctccatcttcccaacatacacagccactacctccctgtcactgtaggtcactcacttcagtactacagctcaggaatctgtagggacccaacacccaatggatggagcacttttcactgcccaatgcccacccccatgtgctccggtaactcagtcccagctgaaattccacagccagtcatcataaccgccccccctccaccaacatatatgccctgcccaactctccctctatcaatgtgctcagctacaccccaacccaggaaattccaaccctaaagttactcttgcacaaatatgccatctgggctgactttaacttcttaatccctatgacactgacctcagttggacccctaatgctgcatggcaattatattcccctagtccatgagtccactaatgggccccgctctctgggttcatgctctcttccttctttgctggatttctgcatgaaccattactacctgagacattgatacaataggttaattgtaaagctaagcctgataccaacaattagttcttctccttcttctctcttcttcatctttctgctcacctgtgatgtattcttcaagggtattcggctccttcttctttcttcttcatctttctgctcacctgtgatgtattcttcaagggcattcagctccttcttctttcttcttcatctttctgctcacctgtgattcaaggacagtcagcaacttcagagaacgtccataactacatttctgcctgtaacacataataagtaacacggtcatatgtcatagagagatgaaaaattaatcctattcaaaccaaaactgacttcacataatttatactataaagtagcaagggagtaatggcagctgaaatcttctttttgggaaaaggtgaaatgagttactgtcattctgaaaggatcccttcctaactgactactagagcagctatcttacattctttatgtgctgaaaacaaaggagagtttactgcactataaatttcccagaaacaataattttctctaacagcagtttacttttcatttcctcaaactaaataacatgtgggttctcataagtaggttcaagaatatcatagccattcatcccgtaagatttcccaaaagaaatacttcacttaactctctctccactttggtacaacaatgattttctaaaaggaatagtgaaaacaatttaactaaaatagataacctatttacgacataaggttgtccctttctacataacttaatattgttaaggatctacagactaaacgttgaagacatttatcttatatgcagctgccatatttctagaaatggataaaaattaattttacaggaagactatttttatctggaaggcaaaaagaggtcatcttcattggctttctagataatatacctcaattctgttaaacttaggttataaaacaaagaaacttacctgcttaaggaacaatcaagtaaacatattgttcactacagacaccaatatgtacaagatagtttttgaaattatttgcaccaatgaatacaaagaaatgatagaaatatccttattcaaaaaagccaacaatcatgcatttttagttgtattgttctcaaaatacgtttaattttgttgtttgtttcgttgcaagcttttgcaacgctttcaatcctttttctctttgcagcaagaccctttttaatgtcagctagacagtaaatgaaaatgcattaaaaattaatgttgaaaagtagtttatttgcagatattgaaatcaatatgggacatgatggttcagcaatatcagaaggatatttaaaatgcaaaatggaaagatcgtttcaaaaaagtaagatttaatccttttctgtaaaacctttcaggtattaataatagttttccaattccaattggtataacagcaaatcacttaattgacagatgatgaaaaaaagcaaataattaaaatagtttctattttttaaatgtgcagaaagggtaacaaacacagactttaatttctacatcataaaatgtccaacagttcaaacgacatgtttccatgaaatactgtcacaactcattaagtaaagcacataaaagtaagaccatcaaaagggtagacataacataatacacaataaagtatttttaagcaatctagtgattgatgctattaactgtattttaataaaagaagcaatgtccatgggtataaaaatttaggtttaagtagataaagaaatacacttaaaaacacgtttgaaatattttctgggagctttttatatgacatttttatccacaatgctgtttctgaaaactgtattactgcaaggaatgctttcctaaacatagtttcacatcagagatccaccatcaattgctaagaatagttttctgcagtcataaaagatctgcaccataatacaaatattttttacatacagtatccatctatagtggtcgatgtattaggcagctcacaaaaccagcactttgtcaccaccaagcagagcaaagctttccaaatatactgcttatatgaattattgctatagaagaactgaaaactaaagtaagctttttaaaaataagagtgttgtctccatcgtctctacagaaattttctcaaacttttttgaataaatggtcctataacagtcagtacaactaatatttcacatggcaatataaagtttatgagtttttggatccaattaattacatgtttctcactgggtagaaaagttgtctttacttttctactacacagtttattactggaataataatagaaaataatcattttagagaattcaattttttctcatactttaaagaaaacaaaatcagaaagctgtgacaatagaatagctaaattaggaacatgaaaaactcatattaaaaattctgagtacatatggacaggaagaggggaacaacagacaactgggcctacttaagggtggagggtaggaggggagggtgaggatcgaaaaccacccatcaggtactatgctataacctaggtaacaaaatacaaaataacaaaataacaaaagtatctgtataccaaaccactgtgacacgcaatttatctatataacaaacctgcacatgtaaccccaaacctaaaataaaagctaaaaaaactgatatgtgacttaatgtgtgtacactaaaaggaacgaatagagctgtttctcctccagtgtcctctaatatcccccaaacattaaatttccacgtgtatgaaagaaaagccatccctctcacttgcccattattagaagcattctcacattccacatcaacaataaaaaaggaagtaatacagatttatcaaacagactatgttaaatgctatatatgagaagaaggcatttaagacagtcttgtccactaattcgtacagcctattgtaacagttgtatgattgaaaacaattttcataaactacaaatagctcctaaaacatacctgcaatatcttctagcttctggatatcaaccctgtaaaaaaaaagttacatcagggaaatttatagcactaaatgcacacaggagaaagcaggaaagatctaaaatcaataccctaacctcacaattaaaagaactgcagaaccaaaggcaaacaaatgcaaaaactagcagaagacaagaaataactaagatcagagcagaactgaaggagaaggagacatgaaaaactcttcaaaaagcaatgaatccaggagttggttttttgaaaagattaacaaaatatatatttaggatagttagctcttcttgttgaattgatccctttaccattatgtaatgtccttctttgtctcttttgatctttgttggtttaaagtctgttttatcagagactaggattgcaacacctgcctttttttgttttccattggcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgcttgttagtcgatgcagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttggctgtaaagtattttatttctccttcacttatgaagcttagtttggctggatatgcaattctgggttgaaaattcttttctttaagaatgttgaatattggcccccactctcttctggcttgtagggtttctgccgagagatccgctgttagtctgatgggcttccctttgagggtaacccgacctttctttctggctgcctttaacattttttccttcatttcaactttggtgaatctgacaattatgtgtcttggagttgctcttctcgaggagtatctttgtggtgtaaaacagcatggtactggtaccaaaacagagatatagaccaatggaacagaacagagccctcagaaataaggccgcatatctacaactatctgatctttgacaaacctgagaaaaacaagcaatggggaaaggcttccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcagtaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccggaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaagtaccatttgacccagccatcccattactgggtatatacccaaaggactataaatcatgctgttataaagacacatgcacacgtatgtttattgtggcattattcacaatagcaaagacttggaaccaacccaaatgtccaacaatgatagactggattaagaaaatgtggtacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggaggggggagggatagcaatgggagatatacctaatgctagacgacgagttagtgggtgcagcgcaccagcatggcacatgtatacatatgtaactaacctgcacaatgtgcacatgtaccctaaaacttaaagtataataaaaaaaaaaacaaaatagactgctagccagactattaaacaagaaaagagacaagaatcaaatagacacaataaaaaatgatcaaggggatatcactactgatgccacagaaatacaaactgctatcagagaatactataaacacctccacacaaataaattagaaaatctagaagaaatggataaattcctggacacatacaccctcccaagactaaactaggaagaagtctaatccctgaatagaccaataacaagttctgaatttgaggcagtaattaatagcctaccaaccaaaaaaatcccaggatcaggcggattcacatctgaattctaccagaggtacaaagaggagctggtaccattccttctgaaactattccgaacaacagaaaaaaagagactcctccctaactcattttatgagtacagcatcatcctgataccaaaacctggcagagacacaagaaaaaaagaaaatttcaggccaatatccctgattaacattaatgtgaaggaaataagagaggacacaaatggaaaaacattccatgctcatggttacgaagaatcaatattgtgaaaatggccatactgcccaaagtaatttacagattcaatgctatccccatcaagctaccattgactttcttcacggaattagaaaaaactactttgaatttcatatggaaccataaaagagcctgtatagccaagataatcctaagcaaaaagaaaaaagctggaggcatcacgctacctgacttcaaactatattacaaggctacagtaaccaaaacagcatggtactagtaccaaaacagatatatagaccaatagaacagaacagaggcctcagaacaatgccacacatgtacaaccatctgatctttgacaaacctgataaaaacaagcaacggggaaaagattccccatttaataaatggtgttggggaaactggctagccatatgcagaaaactgaaactggatgccttccttacaccttgtacaaaaattaactcaagatgacctaaagacttaaacgtaagacctaaaaccttaaaaaccctagaagaaaacctaggcaataccattcaggacataggcatgggcaaagacttcatgactaaaacaccaaaagcaatggcaacaaaagccataattgaccactgggatctaattaaactaaagagcttctgcacagcaaaataaactatcatcagagtgaacaggtaacctacagaatgggagaaaatttttgcaatctatccatctaacaaaaggctaatatccagaatctacaaggaactgaaacaaatttacatgaaaaatgacaaccccatcaaaaagtgagtgaaggttatgaacagacacttctgaaaagaagaaatttatgcagccaacaaacatatgaaaaaaagcttgtcattgctggtcattagagaaatgcaaatcaaaaccacaatgagataccatttcatgccagttagaatactgatcattaaaaagtcaggaaacaacagatgctggagaggatgtggagaaataggaatgcttttacactgttggtggaagtgtaaattagttcaaccattgtggaagacagtgtggtgattcctcaaggatccagaatcagaataccgtttgacccagcaatcccattactggatatatacccaaaggattataaatcattttactataaagacacatgcacacatatgtttattgcagcactattcacaatagcaaagacttgcaaccaacccaaatgcccatcaatgatagactggataaagaaaatgtggcatatatacatcatggaatactatgcagccattaaaaaggttgagttcatgtcctttgcagggacatggatgaagctggaaaccatcattctcagcaaactaacacaggaagagaaaaccaaacactgcatgttctcactcataagtgggagttgaacaacgagagcacatggacacagggaggggaacataacacactggggcctgtcgggggtggagggctaggggagggatagcattaggagaaatacctaatgtagatgatgggttgatgggtgcagcaaaccaccatgacacatgtatacctatgtaacaaacctgcacgttctgcacatgtatcccatataacttaaagtataataaaaaaagaaaaaagttacatcaaaattttaacataatgctacacaaaatgccatgtttgtttaagaagaagaaatgtcttatgtgaaatggtgaaatgttctgcatagaacagtgattatatgatccaaagctgacttctctgcctcccagattcaagcaattctcatgcctcagcctcctgaatagttgggattacaggcacatgccaccacgcctggctaatatttgtatttttggtgagacagggtttcaccattttcgccaggctggtctcaaactcctgacctcaagtgatttacccacctcggcctcccagaatgctaggattacaggcgtgagccaccatgcttggctccaaagctgatttttcttagaagacgttatctgacaggcaaaactgacttaaacactttaccccttgtcttccgcatcgatttcagcaaaatggtctcttttccgctgcttatcaattgctggagtctttcctgcattaaaataaaaaagacacaccttttttttttttttaagaggaagacgctgttgtggacatttttttgtggagaaatgtactatttgtggacccttttggctctctgcccattaaagctttaaagcagcgctatacatggaatcactgggaccctgaccattttacagaggcatttttgcaagctctttgcggtttaagtcccagtaaacaaggcactacgtgtcagatcccttggacgtcaggaccgcatccatcgagaagagctgctctaagagtatctgtaaccctggtatgagggagaacctcccatgggaaacctaaggctcttgagcctgctttgaaaagcttgggcatcttagcacgtgcaaggtgaactccaaagcaacataggggctgggggcctcgggctgactgtctgctgcctgtgtgccccccgcgcagagagcagacaaaccgtccccttgggcgtgcaccttcttccggctcccctggactgtttttaactccatgctccatttcctggttggccgtaacctgagcctccactgggtgaggccttcgcaggcttctccatgagcttcctgcccacgggctccatggctggttgtcctcggatgttagaggtgactcctgaaccttgtgagtgcaaagatacagtaaggaaacagggtgtgtgaaaggagagctatcgggatggtgggttcaagaagcgtggggctggcccgccccgagtctcctgtgggagcaggagggatcgcggagaatatgtcagcatcccctcctgtcctggcctgtacagcctgtccctggggctggccgcagagctcgcagctgccgcgcacacctgaactccgcggcctctgggggatcctcgcggagccattgagacagagctcggccctgctcctgggtcccccagcgaccccgtgtggccggaagagctgtgggatgacagaggatctccccagctatctcagtgggagtcacccggtgtgcacctgtttcggacaatcaagggtgggcactgctactcgcccgcctggatgcccaggggacctccggtgaccccaagtgtcctgtcctgctgggcagccaggcaggagggacccacaccgactccccaacccctgcacatatgcacaggcccctggggctgctcctgggccctgggaaccacctgggcagctccagctctcagccctggcccaccccggcctgccctcagggccttgccctgattcaggccccagacaacgacactggggccatttcctcacaggtcagcctggggcagcccggtgcttcacacggtcatccccaaagggcctcatgccggctttccccgcctccccaccatgggcacaacacctgagggaccccccacattgctccctcagtggacctgcagacgctggcaccacaaggctcctctgagggcctgggtcctcggttctcttgagagcagccagcctgcctgcccgcactcctcgctgattggtcgactcagtgcacatgtgggtggtgggccgctggggccacgccccctgcaggcatgccctccccctcagggaccacccatggtagctgtggactcagggagagggtggctttctgaggtctctgtccccacgatattccagctcctcatcctggcaaaggaagcaaggacccaggagtggggagtgccaggggaccctgccctaaggaatggaggccaagtgaacggggcctaggaccttgcccccaggctcgttccagccacccctacccctttggatgcaatggccatcaccctgagggtggagcccaggctccctcccatgccctgtgtgcttccaacatgcccaactgcattctttttatcaatggattgtgcttttatgttttatctaacaaaattgaagttgcctttggagggtaaaaatatatatatgtatgtgcacacacacacgtgtgtgtgtgtgtgtgtgtgtgtgtgcttaagcaaaggttttccttttatattcatagattacattgcagaggtataatggcatactttttatattcatagatattttatatccttttatattcctttgtatttccttttatattcatagataaattgcagaggtataatggcataaaatgggcatatttaagcctttgggtacttcagttagagaatattcctaaggcaagaattaagatgtattcatgcatcatttctctttataattctgttgtcaagtattatagaaatgtttgtcggtttcatttttatcaccaggaatgattttaaccaaaagctttcaaaaaccctttaattttgacccagcaaaatcaaacatttattcatgtatttatttatataagtttaagggctacgagggcaattttggtacatggatctattgtgtagtggtgaagtctgggcttttagtgttcccatcacctgaataatgtacattgtatcctttaagtaatttctcaacactctcccacccttctgagtttccagtgtctatctttccactctctatgttcctgtgtacacattgctccgttcccttataagtgagaacatgcaatatttgtctgtgttttacttgtttcacttaaaataatggtctatagttccattcgtggtgctgcaaaagacatgatttcattctttttcatagctgaatactattccattttacatataaaccacattttctttatccagttatccgttgttgggcacctgagtgttgattccatatctttgctattgtgagtggtgctgtgataaacatatgagttctggtgtcttcttgatgtaatgatttattttcctttgggtagatacccagtggtgggattggtggattgaatagagtgacatatgctggggagaaacatttagtctatagcagggagtcaacaattttcttagataaaacataaaagcacaatccattgataaaaaggatgcagctgggcgtgttggaagcacacagggcatgggagggagcctgggccccacccacggggtgatggccattgcacccaaaggggcaagggtggctggaacgagcccgggggtgaggtcctagggcccatccacttggccttcattcctcaggacaggattccgagcactccccattcccggctccttgcttcctttgccaggatgaggagctggaatattgtgggaacagaggcctcagagagccacccttgccccctaggtcctcagctaccatgggcatgcctgcagggggcgtggccccacacggccccactacctgcatgcacactgagccgaccaatcagcgaggagcacgggcaggcgggctggctgctcttgcaagaacccgggactcaggccctcagaggagcctcgtggtgtcggcatctacaggtcctatatatatttttttatttaatctttattttatatatatatattttctcaaagtatgtaattttgtggctgaatttaattttatctttgtgcatagaaatctatagacaatcataatgcagggacactttattagcatgacctaacctttgaaatcttgtctaggtgagtcacgaatttagttcattatcagtcagttctctcctagctgggaaacgttcatgcagacacacatggaactcaattagactgggtcagtgtgatatctgcaggggctctagtgatgtgtgaaacacacagggagacggagatctaattttatgatcttcactgtcaataggagagaagaaaaggacttctgaataacatcaccgtcaactgcctcacaaaatctctgaaagcagtgctctaggagttacagtgattgcatcaggagctgcagttttgggggcaattgagaaggaactcctttctctgtataggctgcagagttcctgaaacttctccccaattagaaacatagaaaattattagccttacttaccagtgccatatgacctgggactactcagaggaaagggctgattagttaaagaaaatatgtctagaaagaaaccaaagaacattactcccaaaaggcaccttcaggaatccaactataacatttttgggtagattaatatataatacatatatagtctaatattctaataatatagtaaaacggatgaggtttagaacaaattaggagacacattctgtgtcagatgccaactgcatctgcaattttgggcaaggtaattaactacctggagtttctgctaaattgaggttggcaggggcactgggttgattaatttgatcttgaaagtgccatgaggtcatggactatcttcttatctttattagggagctatttcttacatttataagactcctttactaagttaaaggtgttttccttcctctaccatatacaatttttaaaaactgttcccagctgggcgaggtggcgcacacctgtaatcccagcactttgggaggccaaggtgggtggatcacgggtcaggagttcgagatcagcctggccaatatggtgaaacctgctatctactaaaaatacaaaaattagccaggtgtggtggcgggtgcctgtagttccagctactcgtgaggctgaggcagaagaatagcttgaacccaggaggcagaggttgcagtgagctgagattgcgccactgcactccagcctgggcgacagagagagattctgtctcaaaacaacaacaacaacaaaactgttctcataggccaggcgcagtggcccacgcctgtaatcccagcactttgggaggccaaggagggcggatcacgaggtcaggagattgagaacatcctggctaatacggtgaaaccccgtctctactaaaaatacaaaaaattagccaggcgggctaattagtgtggcgggcgcctgtagtcacagctactcgggaggctgaggcaggagaatggcgtgaacccaggaggcggagcttgcagtgagccgagatcgcgccagtgcactccagcctgggcgacagaggaaactccatctcaaaaaaaaaaaaaaaaaacagcagttctcgtaatttatctctatttctgttttgtatttgaatgaatgacacttaattcatcgagattttttaaagagcattgcagaactctcataagatgaggctggttgtatcatttataaaatatttacagcatctcagagagctctgaataataaatgacttccattcaaataatagacttttaacattttcaaactcggcttttcagtagatatcaacactctcaatctcattccatttgtgagtctactttaaaatacctttaatcaaatgtgtaacttaatagttctattgatagaaatataatttttctctatatgttttgttttgtttttcataataatagtagcaaaagatacaaaccaaaatcaattttctagattaatgttggaatctcctggtttcacttttgagaaaccactcctagtctaaaatgcattattacattgtttgtaatgatatttaaaagctggaggaacataaactccgcaataactgcttcatttttaaatttgacccatcttcggtttgtggaacgtgtctgaaattgcacagctgtttttatttatagtctaactggggaatttcacttgtgaaagatgctgtaacaaaataaatgtccctgtgtccgttgcattctgtggcattctaagccaacaaaatgtcaagaaataccattcaaatcctttcagctacaatgaggctgaattatcattcttttcaagttcttgtttttgagggactgttatagcagaaattcacatgcaaaagaattgctttaatttatgtaccatgctactatttttaacttagaaaaaaaagtcagactcctctttggacctcaatactgacaactttcatcagtaataataggctgtactgttattctgtactacctttattcagcaggaataacaggctgtactgatggatgtactacagtgatgcaaggactccagtaaactggcaggcagtgaagaggtatgcttcaggagtgtcacaaaagtggtgatgactttgcagagaacagagccacccgtttatcggcctgcctctgcttaatgcatgttgctcaaatgcctctatgaaaatactgccccaaatacaaaactatactattggactgcccttcctttataactttgagggatggtcattgccacttgctaattgccaagctctcttacaaagtacatattcaatttatttccctgcctgcaactgtatgatgtatagttgtttccaagaaatgatgactaagaggtactgagagatttttgtcattttttcttcaaaaaaagtcaactggtttcctgctcattctttccatttaagttggccatagaaatcccagtggtgaccctcaggttgtcaaaggcctttcttcttgttgctgtgaggttggcctgctgatagtaacagatacaccccactcacaattatttcaggatcaagtagatccattggccatggagtgatggtcttttcaagtaaggctattttgagaggtaataaaatattcatacacttaatttttcttttgtacttgcttgttttaaaatacagttctgtacataaatatttttgacaagatgagcaatagatctattttttcacattataaaacaaaattattataaagataagtcaaaaatgactaagtagaacattctatttggttattaattttcactggactttcaaaacacttttctgtataacatattcatatattttgaattcagcagtgcagtcagatgtttcatgtaagtggctgggcacagtggctcacacctgtaatcccagccatttgggaggctgagacaggcagatcatttgaggccaggagtttgagaccagcctggccaacatggcgaaaccccatctctcccaaaaacgcagaaaaaattagccaggcatggtggcacacatctgtaatcccagatactcgggtggctgaggcacaagaatcacttgaacccaggaggcagaggttgcagtgagcctcgattacgccgctgcactccagcctgggcaacagagtgagactctgtctcaaataaaataaaatatgtaagtgtaacatgtaagagtaaacataatcttacgtagtgattatctgaattattttttctttacttttattctacatgggtattataaagagttgtgtgttcataataaaggctcccttttctacatagttggtcttcccttcttccctcaacattttaaaaaaattctacagaatttacacaatcaacattcttccttttaagctacattattaatttctccccaaaagaattacagtttttcagcagctgggaaatggaaccaaatgatgtttaattctcccagcagtgaggtgaggaaacatgcacagagcattgctgcccagggagctcccccaaccctggcatccagtatggttttggggcgtgtagtcatggcagactgtctgcatgactgaactcagttgccagcccctccagaggtcaagactgatacaggtggcccaaagcttccactataaatcacattgttagcattaactatctagcataactcaaagctccaggtaaacaaagacattattatcaggcaggatattccaagggcttagaggttatctcctggaaggctgtcaaagagcagatgttctttggaaagtgcagggtttggacaacacagatctgctgagctaacctactactgcactcttattcagctcttattctgaattctctctctctcttcctaaaatgtgcagatccttacggatggatgggaaaatctgggaaacacagcactcactgtaaacacaccatgcctagaatttggctcctcttcaacaacccgggcttttgaactgggtcgaagtcactatgccaggatgacatttttttacgttagaatgaattcccccctggtggctcctcatcctccaggtatacaaggctcctggatgacccatggcctccacggggcacaccacagtctgaatcacagctgattttctggattgcccttggactcagcaggatgattccacatcttccaaattctagatatcctgatatcgcaatattttttatccctgtttcttaatgaaagggtaaatggaggtagaggtgtttctcaacaacctgcaacaacacatgtttctttcaattattcagtacttaattggaaatcaaagcccctttctaatgtatcgataacattgggaattgatgactattgtgtagttgtacttaatctacaccatgctaattcctaacatgggctatggaggcagcagagcggcaggtgacaacatatgcacttctctccctctctgcccaaagctcctggtaactgtcaaatgagcagaggacggggagacaataggaatattttaaaactgtggttttcaggttgggaatatattaatatcatacaacctaattatttccttactttgtctatattgttgtatattacccaagcttcagagctgtcagagcaaacctcaaagatgaggagccagctggcaggtaaaaagcaaaacaaaaacagcccgttgctcaatgactaggatttttagttcaattacatttccttgccatctaaatagccagatgcaatgacccatagatagagccagtgtagaacagatgcagtgacccatagatagagccagtgtagaacctaacataataatgtctaaaggggttagtaattgttctactcaatttgtttcagccattctattggaattcctattaattggaattgatggtaagtatatggaatgtcatgtagtgaaacaaacaaacaatttagagcacaccaagtttcatggacaacaaataacaaatcactttttaaaaatcaataccaaccaggccaggtgtgatgactcacacctgtaatcctaacactttggaggctgaggtgggaggattgcttgaggccaggagttcaagaccaacctggccaacatagtgagacccccatatctaaaaaaaaaaagaagaagaaaaaaatgaataacaacgagtacagtgagatcaaagaacactagctaccatctacccttggtttaatactcttgagaaggctggcatatgtggagtctctccaggaagacatttgaggcagaaaaccagaataggggcaggaaatgtattatttcatcatctgaaatggggactttattaactctcctgagtataaagtcaagaaagaaggtatttttcaggactgtttaattaaatgtcattctgtttatcaaaacagagaaacctggcaggcatttctaaccatatgggatttttggaaatacatgagaaacatgtgattacgtgtttagctgaatattatttaaaatgtatgcaaaatcctgagagggcttttgaactaagttcctaaaatcatcctctgatgcatcctatttgatatgctgctgtgtgcctaaaattattccagtagaaataaagcagagcctcaataaaaccagccccttttaatgagctgcttcttgtaattataattatccataatcatttattttgactgtaagtaatataacaaggcaaaacctataattttctaaagtaatataatcaatataaaaacaaaggtgtttcatactactaacggaagataaatgtatcctgcaagctgaatgttggcagatcagcttgtgctcttctaaatcatctaaatatcatcagtgcctttgattacagcctcgtgcccagtgctttaaaaatcaaagtttgcttttaagaaatgtaatttaaaaactgctgatcatctaaatcttgggaggtcaagggcactcttatttcctttatacttacaagtttaatttgatgttttccaaaatagacttgggtataaatttcacatcaatatgctaagcagagccccatgcagaatatttctgagtgggatttattgaatataaggttatttttatgactgggacattacagttgcaatcatcaatgaataaaaaataaatttaaacaactgtctctagcatcaagttgaaactcaagtctcaatagagcaagtttcaggaagaggtgggatttcaggtaacatggagaacagcagctcagatccttttcttaaaggacgattcccccttgacatgaagccagcaactcactctgcatgcagaacatgcaacacatttccatgccggggagagaagcatgtgacgtcattcattcactcattcagtcattagtcattcccttattcgtctatctaatagctgtcaatactcctagtatgtgttgggcattgtactacatgctaaatatatagaatctcttttctaaactcaaaaagttataagtagatggtagtagtggtcagggtaaaatacatttgtgaaaggaagaaattacagtgacaagtcctataatagatggcaagtgatgtaggatccataaggaagaaggacaaattatttatagtatagatagggaagactttacaacaggagaaattatctgagattagtttggaaggataagaacaaaaaggtactccagtagaaaattgggacaaaaagtagaaaaatggggcactttagtctgggagtcataaaaggtggggtatacttggaaagaataaactttttgtagaactataagagatttcagggtctgtgtgagttatagtttcaggagattaagttgaagatatttgggtacaatatattgaggtatatcataagccaagagagaatataggttttatttttgcaggtcagttgttctcaactgggggcaactttgtgccccctccctgggatatttggcaaggtctatattttgctgttacaactggagaagggggcaggctactggcatctggtaggtggagaccagggatccactaagcatcctacactgtacaggacagtccccacggcaaagactctgccccaaatgttgacagtgctagggtgagcaaccttgctctagataatggagagtaactgaaagattttacatatgggaaagaagtaaagaggtactttctaggaaggtgatgcaacacctcctaggaggtttgccacatcacggtggtcatcaaaacactgggtgtcaataagagaaaaaatattcgcctgcagggagaaagatcaactaacttcttgagcatctactctgtgctggacattcaacgtattataccaatctccccatgatattggcaactgctactttctgcagcaatggggactaccagatgaaacaggatgagactagaggctgggagaccattatagatcaatgttcactctcacatggaaacagtggaggtctggactgtagcagtgtccatggagatggagatgtgagagcaaagaggaaggtcaaatcaaaaggagttttttaccaattaaatgtgagaagggtttaaccaccaaatggaaggtttacagaacgactttgaggtggctggttcagaagactaagtaggtagctggagagactgcaaaaggaagtctcagaggacaggtacagggctacccatacttgtgacctttggggtgcccatgggaggttcagatgtagatgcctggtaagcaaagggaaaaataagtctccagttgtaaagagacctcaaacagatatgtgtttaagagtttgcaacatcacaatggtcatcaaaacactgggtgtcattaagagaacaatatttgcctgcagggagaaagatcaactaatttattgagcatctactctgtgctggacagtcattatgttatcgtctcagtctccccatgatattggcaaggagactgaatgcagacaggcccagggaggtgctcaaagtcaggcagccagtcagaggcagagccaagcttggaatagtgtctcaccaaaaccaatccccatccattcattctttcaagattatttataaagtgaattgctgcgtggagaagagaagccacagaacaggttgagaaagaagaccctgagataggaaaagaaaaagtgaatgatatcatcaagtccaaaggaaggaagagcttcaagtaatagtttcagttctcaattgtaaaaagattcagagtcagaccagaggatgcttctgccataaattgctatccaaatgatatcaagtcatgcacacacacacagagtttatatcagagttagaatgtgtacactgcattagacactgagcatcatcagggtcttgctggagggcaaggagcaaaaaacagaccataattggtagaaaagtacttagagtttgaggaagtagagccaggaagaacagaaggaaggtagggtggttgctaaagggaagatattttacagatgaagattcagacttgagcgtagatgtaggctgaaggacttgagtggaaacaccaaagtttgagtatgtaggagtgagggtctaaatgagagaatgaaggagtttggccttggtgtggagaagggtccactgtttgtttaaaatagtggtcttcaatcttgttgggccagtagactctcttgagaaccttgtgaaagttttagatgtcgccccagaaaaacatctgtaaacatttacaaaactgggtatgatcttagggagttcttgctaaaatctcctaagcataaaatttaacaggctctccttgagagtgaagaggtgctattaatgttattacagaggacaacagcctccatctaagcttcaagcaatcccagattggtgaattggaagtggctggagaatgtgatgaactggatttcctctgtgccggcattgattattgtggcgtgactgaatcacagtaagagttcccctgaaaagagcagtttgagtttgttagaaaaatggcactctggaaattgatttctttcaaacaattcaaccctgtgaaatccttgcaatatccttgtgtaaagccagggttatgtggatgacctctgaaagccattgatgtggaaattcctaatttagaaaagttatcagaaatgtttctggaaatgtttacacctagaagagcaatttggtatatcccgggggaagtatccagagcgaggaaatcaacaggagcccaaagttttgcattctatttattgagtaaaaatatattgattgctagccacatgacaagacctgttccaagtgctttatgaatgaattcattaaatcttcatcacaagcctactaggtaggtacagttattatcctccatttcacagagagggtaatggaggcacagtgagatagcagggttgatcttggtttgggtcagggagtagatttggaacaaggctgtctgtttccagagtctgacctcccacttttactctatattgagaaagtttacatattataatatgttcacacatttactcagtcagttcttttttttttttttttttttttttttttttgagacggagtcttgctctgtcacccaggctggagtgcagtggaacaatcttggctcactgcaacctctgcttcctgtgattctcctgcctcagtctcctgagtagctgggattaaaggcgcccacaatcacacccagcaaatttttgtatttttcatagagatgggatttcaccaggttggccaggctagtctcgaactcctgacctcaaataacctgcccgcctgggcctcccaaagtgctgggattacaggtgtgaaccaccatgcccacccaattcttataagctttcaaatatcatatttgtttaaacacctgtattctttagtgttgtaaaggtaactatccatcctctgacagggactgtagatgagaggaaatgcatccaggaatctaatttatcacaccagggtcctatggatagatttagggttatgggaacagtacctcatcaccggttatagattttgagagccttcaatgagccacctctgaagcctttttaaagatggctggacatgcttaggcagaaggtctctgatttgtgtgctaaagctccttcaaatgaagaagtttcaagtgaacagaaattctcaggtgttaaatgctgctacaactccggaaagactgccaactcctgccaggtgaccagaaactcagtcaacttctctgctaactgacctccaagcaactttacccataatagctaagaataccagccaatacttgctgagtatttcctgtggaccaggctacacacacacacacacacacacacacacacacacacacacacacacacacacacacagatccagatgctcagtttgcacacagtggtacagtagtggagggtcataaaaataagcatgcaagttgaaaccacctgatatggttgggttatattccccacccactctcatcttgtattgtagttcccataatccccatgtgtggtgggagggacccagtgggaattaattgaattatgggggcagttacctccaagctggtattctcgtgatagtgagttctcacaagatctgttggtcttataaggggcttttcccccacttcactctgcacttctcctcgctgatgccatgtgaagaaggtagtgtttgcttccccttctgccatgattgtaagtttcctgaggcctccccagccatgtggaactgtgagtcaattgaacttctttcttttataaatcaccgagtccgggtatgttcttatggcagaataagaatggagtaatacagaggacctgctttgacattggatagtcctgtgagcaagttctgaatttatcatctcacagctcctgcccatgtacaagttacttactctgtcctaatctcagtctccttatctgtaaaatggaaagaataataatattggcttcatagaattgctgtgaggatgtaataggattttggatactaagcacttagcttatagtacttactcaataaacactatttattactactgtgtgctgtatcacagggaagttgtggtggtcagatgagatcattggcattcagatatttagaaaagttaaacacttcagaactttcttctgaaggactttgttgctgagttttcagccccattcagtgaatgtaactaactctcatattagtgcgtttctgcaaaaatgatgaggtcttttgttattactttcattgaggaataacatatatagtaatgtacataaatatgaatgtgcacaaatacagctcgataggtttttaatatgtgaatggcatgttactaccaaccagatcaagatgtagaacatgctcagcaccccggaagagtccctcataccctctttcaggtaatatttattcctcaaaggtaacccttactcttccttctgtcacctaaacaaatctttccttggacaatatttctattattatctctagaattaattgtaatatggaaaatactgttttataagcctcattctctgaatctgatcactttaaaattaggaggtatgcacttcattgctcagacccaacccaagagttccatctgacttcctggctttggacagtgctgacaagtcctcagggcatgccccatgctgggctattcacttggaaggagacaaatgcctaggaggcctggtttcaccctcagagagctagtctaactagagaaagaagccttaaaatggaataccatccctaacagcaaatgaatccataaaaatcatgtctcagggagcaatctcatgttttcttgttttcgaccgtcctgaagacactgtttggtattggtctttcccaagaggatgcccagattaaccacctcccacacagttgggtcctttgctttggggtcactaggatgtggaaagcttgctgccttgccatctgctattgtgtcacaggtgtctgtgaggtctctcatgtaggacatggtttcctcttgacacattagtgaggacttccacaaaagagggcaaagggaggccaatccctatgtgcttattccaagatgtattctatcaggacatgttaccccagttgttcctgcaggtcactgttgtctgtaagacagtgcacacactgggagcagttagcaagcatgcactcatcaccatatgcaccatgaaaacacttctgtgcagtattggtagttgtggagcttgcatttctttaaaagacagaatggcatttaaccacacttattgccatccaaggagctggtggaacataaactgttctgtatggttgcaagcacataagcctcttgagcaagttttctatgctttatgagaacaaaagatgagacattttattcttcaaaaatgggggactccaagacaaaccacagattaatcacaaaggagaagaggaataagcagttgcattgtgcatctctggtcattttgctgaggattttaaaagagaaaatggtgtgctaaagcaatgcttcatttcacattattgcacgtcatccatcattttgtatagttacctattcgtaacattcaccgctatctaattaagtgaaaaaattttgttgtaagtaattaagtgttttttaataggccagcattctcaaagatcatactttgcctgtaaggagacttcaagatgttgtctggagttttggagtttaaagtatatattatccttgtgagattatgtaaactctcatatttgtgggaatacaaatgagcaaaactattttgaaaagcttgattttaccaaataaagtctgagattgcatatacacagatccagcaatgcaacttttacatatacaccctggagtggtggttccagactttaatgtgaaccagactttaatgtgcaccataatcccctgaagggtgtgttcaaacacacattgctgggtgacaccccagagttccagatttagcatatctggagtgggaccatagagagtttgtacctctagcaggttcccaggcgatactgatgctgctggtcccagaactacattttaagaaccaccgtctcagggagacttgtgtacatacacgctcataagaagacatgagcaaaatctttcaaaaacattgttcctaataaccccaagctagaaacaactcaaataccatcaacagttcaatgaggaaatgaactgtggtatattcataccaaaaacccctactatatagcaatcaaaaggaatgatctacagctacctgcttcaacaggatgaatctcatgaagtgttggtgaacaaaataaacaaggcaagaaacagtatccataatgtgattccatctgtatgcatcccaaaacaggaaaaacaaaatcatattctttacaaatgcatgaacagatggtaaaactatgaataaaatctgataattgatcattgcaaaagtcagactagtaattatctggggctaggaggagggaagcatacaggtagtttctcaggtactagcaatagtctacgtcttaacttggcttaacttggctattagatatgttggagttggacttacgattattacttagacagaacatttgtatttatacacatctacatagaatacataagttttaagtatttaagaatcattttatcttttaaaaataatgtcctctatctggtatgtattctgacttttggcaacttgtttgaattttaggatctgcccattggttatgaaaaatcaaatcttttaagctttaatagatggtttagttattctgctgggtcaactattgaaatgaaagaatttttgttactgccaaatacatttgagatatgaactagctatgaacaaagtgttacagagtaaaagacctgtaaggcctaattggagaacagattagaatcttgtacagttagcatgtttatggtctgtgtaataagtcatgacaggccctagtagatcatcttttagatgttgttcatatctatgaacacatacataatgggagagattgacggctgttgccatcaattacattacattaaaactgatttacataatttccccaatacaaattgcgtgactacaagagtgaagattcttatgaactattttcttttggtggcaggagagtcatttttgaaatctttgaaaagaaggaaggattgaatgtgcctgttgattatattgtgatgttctttttccttccaaaaatgaggagtgggggacatctgtaactctgtgaggataccaggaatgctcatttctgtttcataatgcttactctgttttatcctgatattatagtcttgcttttaaatgtattgggctgaatctctttctttacatttttagtgtgtcctgtacaaacaattcttaatcatttttttcaccatatgtttccttgtggcatggtctgcatgtcccctatttgatcacagtgtggattctgaatttgcacctcccacatgctaagttgacagctgcataacctcaaaacgcattctggcaatgatgaatgccaatattttatgatgacagcccaagaatttgattgcagctgcccactgatataagtggtatctttattatttggtgagttaagcagacacattaagtacatttgttgcaaatactagactgtaaaagaatgtatttctgacttattatagtaaacagtaagaaacaaccaaaatgttcatcaatggaggaatggttaactaaattgcagtatagctataccatggaactccccacaaagaaagtagcctgaactgtgttagactccctatgaagagctttatatgtgttgtttcatttaattctcacaacaaccttgtgatattcccattttataaatgaggacacaaagacttgtccaaagtcacatagtaaattgtgcagcaatagttagacctaagttctatggacctccaaatccattttcttatccagttatactctcctagctcgtaaatgtcaaagctatacatgctgttgattctcttctcatggagattaggttcaagatgaacattaagttatgtaaccacagagaagaggaagagacttagataatagtaaaattaaacctatctaaatgtcaaagctaaattacttccaaatgaggtaagtttcctatcattccatgactgaaaggaaattcaagaatatacaccaaaattctggtaatatgtggtatccaagtcaggattttcatgtattctcagagctgttactctgcttaaaatgtcaaattataagtgaagtaagagaaaagccatgcttttgctcaaatgtaattatcgatactgtaaaatatcacttatatgtttatctttataacttctccttttaatatttacagatggacaaaagagaaagaaatctttaagaaagaaactggattcactaggaaaggagaaaaacaaagacaaaggtaaagggtaaagtacccaatgtaaatgcatcttccatggagcataatggttaaatttggtggggttattgaattgcatagatatacgtggttcaactctgttatgaaaactggatttctacagtggaatgtcattaagggctgttttggtctactcttctgtgtttgagcagccctgtactgaactgatgaattcagctggtttgaggagagtgtgacctcggccaagtttgtggttccaattattattttgaccaatcagctatacataaagaggacctgggttgagaagctatggagagcatctctaatgctaaccagctgtctggcaaatccagacaggcagggttagtttaatgagagtttgaattcacctaccaccactactggaaagaaacagtctcatcctcatgggttactgaagataggccattctcagcattttttttttcacccagttgaaaaatatttatttgcaactaacctgaatgcttacattttactttgttacattgcctcagccaagataggttaaagcaaatgcccttaatattttgggggtcacagagccctttaagaatcattgacaatgatgatgctctatcaaaggcctgaaactcacccaatgcccaccctaccaccccctaaattaagaattcccagattagatattcacttgagttaacaagtattttcctttttaaagatccaggaactttagggaatagtcagtggctattagtttttttgttttgttttgttttgttttgttttgttttgttttgttttttgagacagagtctcgctctgtcacccaggctggagtgcagtggcacgatcttggctcactgcaacgtccaccttccaggttcatgccattctcctgcctcagcctcccgagtagctgggactacaggcgcccaccaccacaaccggcttttttttttttttttttttttttttttgtatttttagtagagacagggtttcaccacgttagccaggatggtctcaatctcctgaccttgtgttccacccgcctcagcctcccaaagtgctgggattacaggcatgatccatcgcgcccggcctagtatttttttttaactcttgttttaggttcaagggtacatgtgcatgtttcttatataggtaaattgtgtgttgcaagagtttgttgtacagattatttcatcacccaggtaagcaccatagtacccaataagtggtttttcaattctcactttcctcccaccctccaccctcaagtaggctccagtgtgtcttgttcccttctttgtgtccatatgaacatgtttagctcccacttgtaagtgaattctcagcatttttatgttagatcacagtatactcatcttttgcttcatatgttttgggaattgtttactctcatcttactgttttgtgtccccttgtgcatatatttaggaaactaaaactttagccactctctgaggtatttatggtcatttaaaactgatattcaagctcacataatggacacctgagccccattgacgcagtccaattttttgtgccttttttttttttcaagacagggtcttgccctgtcgcccaggctggagtgcagtggtgcaatctcggctcactgcaacctctgcctcccaggttcaagcaattctcttgcctcagcctcccaagtagctgggattacaggcacgcaccaccatgctcagctaatttttgtattcttagtagagacgggctttcaccatgttggccaggctggtcttgaactcttgacctcgtgctcctcccgcctcagcctcccaaagtgctgggattacaagcatgagccaccgcactttttgctgcttatttttatagtctgttatgaagtggttgctgaatggtatggttgtatgcatttattttcactttatgtgacacagtcaacgagtcttgaatgagaacagccatacacatctcatcttggagtccttttatataatgatagaatttctgctttaaaagtaatggaaggcgatgaaaccaagggtattaaaacatgcattgggatcagtattggacaagagctattccataccattgatctcagtctctacacctatatcttgaacagtcatgacatttggttctttagactaaaaaaaggtgaagaattctaaagaatggaaaaccattgttttacttcctttggagtgaggttactcaaccttgctactgttgtcattttagactggataattatctggggtaggggctgtcctgtgtattgtgagatgtttagcagcatccctggcctctactcattagatgccagtgacaccaccctcaacccaaatatcttcagacatttcaaatgtttatctcaaattggaaaaaagaaggtgaaagtgtcagtgatccgcacccctgactacacaatagaatcacttgtggaacctttaagaagtccaagacccacaccccagggagtctgagttcgtgttcttcagggatacctcaggcatgggtgtttttaagagcgtctaaagtgcaacttctagataagaattttgatccatattaactaggatactcaccaggccacattctgtcacagcagaatctgctgctggaataatgagggctaagggttgtccagctagctattatagtctgataaattgtgttatatttaattgttgatatgtttgtgcccttatttttgtaatgacctaaatattaatagccagcattgctcttttaaactagagtttttgctcattctattcctgcagtagagcacttttatgtctccagattagagcaattttccatatgtatagagcatattaaagggatcactcaggttggtattagtaatgtattctcttttaaacttggtttattctaggatgatgatattgatattgggattcaaatacatctaatgtggactttaggtgatttttcagaaagtgtccatttggctagactaagcagaatgagcatttttgcaggaggttccctcaacagaatgatgagatgttccctcaacagaaggagatgtatgtttgcttgcatgtattatatatacaaagcagcaggaagcaagaatttgaattaacatggaaggaagggctagggaagtaatcgaacaatacatactgggccattatagattttttaaactaaatcatatttacataggctcagtgaaaactctgaaatgttctatagtgcctcgaaggtagctaagtgggaaaaggaaggcagatcctggtggttccaaagaaaagacatatcacccacccaactaaggggagaaatatcaggcttcatggcaaaacaaaacaaaaaaattttaagtagctttaatgtttaaaaacaaactaacctaggcttaagtgaaggttaattacatggcatcttttcagaacataaagccctgtccatgtcaacactgagagtcattacatggatatcctgggaaccagggtgtgaggaggacggggtgccggtctggcacagatgtaatctattcacattatttccttccagttgcgtattagcatttggatttgtaacagctgcacatgtgaaaaacgatcatttgaatccaagagtaaaagaaggaaaacaggaaactctaaatgatctcttgagttaggtcatctaaaaataaatagaagcagccttttagaatcgaattgctctcccaatagtgattcataaatggttgatatgctaccatattaattgatttcatcagaatgaatcatatcctgtatgttatttaattgccttgatatacagcagatcttgtgacactcctatgttcctcatgccacttaggcagtgcccatgtgacttttgatttacatatgggaactaattcaagattgacactgatcagaaaacatattttcatacagaataattccaagtccttaatttctcttagttatatttcttggcaaccaaaagtgtttttaaaactttcagaacttcagaaaatttctgtgtcaaaagtaattttaaaattaagtaattttaaaaatagctactttgttttattaatgtgcttcctaaactgagcacatggggaataggttttactatgatgtaactctgggagattgtaccccccacaacccctgccaggacattttcagattatgccatatatgtatctacatacaatctggaaagagttcaattctggcactgttctttttggtgaaagcatattgtatcatgttttcttttcctcactgtctaggtatgtaactgtatgtgagctgtgaagtaacactatatacaaatagctcatacaacttttaattttgctccacattaaatagcagaataatcaagttatcagttatcactatgtagaaattctcaaagaacatatattgaatgttgtcattgagtgctagtacttctaggataagaagagaagaaagaaccagggagtgtgtggtttctgagaaggttaggaaggggccagctcacacagtactgggccacagcatgacttctgatttggaagttcaggagaaagataatggtaccttaggctagggtgggagtgatcgtggaagtggagagaagtaaatggaaaaaagagataatgtgaaagtgacatgataaagatttgatgacggagtgaaaatgagatgtaagaaggaatgaagtatcaaggatgactctcagatttctggttctcccacatgaagaacaggcaaacttttggaaatctgagtaagacctgataagggaagatgaagaataagaaatgcctttgggacatccagatatgaaggtggaagaagtggttggtgctcaaggaaggggtctgagctagaggtagcaatgaggtgtgaaatatctatggatggaagtttaagttacgggcatcgtgctgtcacttacagagagagaccagagtgatgaggatggttaagattgagctctgaggaccttccacattgaaaacccaggtagaagatgataagccagaaaaaggggcaagaatgtagccagagaggtagagaaaaacccagttagtatatccaggatgcaaaggacagggagcatttcaggaaatggcgatcagggttaaaggctgacagaagggcaaatgaaacagagctgtcaaaaacactgaatttaatgaccctgaagacagcaatgatttagagggagctgctttagaatctaatggaggtaccagctagacgggatgaagtgaggaaagagtggtaggtgagaaagttataagctagaaagtaaagggaacactttagacaattttaactgtggcaaaaggagagggggtaaaccatggagaaaagaaaagagtgggtcgaaggttgtttatttttttaagaaatagctgcttgaataaatttagtacaaaatatctagtagaaaaaaagaggttgaagatacaggcacaagaagatgtaatttatagcaggggtggcccaccagccgtctttgtaaataaagctttactagaacacagccatgcctattcatttacttactgtctgtggctgctttcctgctaaactggcaggtcgagtagctgctacaaagactgcaacctgccaacagtgcggaggctggagtgagacaaattgagcccctaggctacagaattgaaagaaatgccaagtctgcatgctgactctgcacttgccccacgctgaatgcgagcaccttatcattttgcatcctagccattctaagccccagccgtatccacaaagcctaaaatatttactatctggccctttacagaaaattgctgaacgctatttatacctaagagtattaggataatttttttgagctcttgagtgcagtacaccattatccatggtttaaagttatccatagttgaatggcaggtgggaaagcatgggaaccagggagaggcagaaaggctggcaggatgccaagtcacacctacatctcatgcaaaggagggtggtggagggcacaggtacagcaggtgtgaagagttggagcctttgcacctgctggttgctcttctcctgaaacaggaggcagaattatttgctggtggggaagatctgccccagaggtataagaagtctctaaacgagtctggttggttttccttagatggaaaaaaatgactgggaaagggctcagtagtccctatcttatagtaaatccctgccatgcatatgcccacctgagcagacatgtcacttgctacatttatcaatgttcttttcactcttattatcccctctgtttctgttatttcatgtagctgtcagccttaccatccacatgtttccagactcttccaaccttttaaaagtaatatttgatcatttctacagacaagattatatgtatgtgtgtgtgtgtatgtatgtgtatatatagagatatatctatatagatatatgtatatatatatatatatatatctcctcagggtacataacaggaggtctggtactatcccctttggtttctaattttgctagtagtagacacagcctattatcaatagtgagaattacacctcactacactgtctaaattgatcactcaaaggagaagtacctaattattttttattaccatatatcacctagcttgttgctaaagaatggcaagcatcctctgaaaatcccgaaatactaaagttttgacttttttacttcaaaacaaattgcatgctttgatagaaccagaggtgcaggcttttcaagtagcatttctgcttttaatgtagacttggtcattagcccagtgatgtttgaaatattgccatggatcaaggaggaaaaccttttaaagtctctttctacctgatttaatgttagctttttctttcaaagaacaaccaaccttagaattattttcccttgatcattttagtttcattcatagggcttataaaaacaatggagaggttagattccaacttactgctgctaggagacctaatttggagtctaaaaagaataatacatttgattacattatttagtgcctttcagcatgaatctaaaatattgccaataaaactcctggccctaaggatccaaggtacatgtatacaaacagatttacgacagaaattcagaaaggaactctatgtatgtctccaaataaagccattgatttctgcactatgcccctttccccaaattctccttactaaaggatttaacaaattgtttcctgggcctcccaccagatatttagtggctgagtccactctgcatgtggccagtagaatggcttgagtgtagatcacgagagtgacagccccaacatagctggctggaaatagaatgtagggatgaggaacacaacgaaaacagagtggacttcttcccaaccagttcccaagctgctcctctgcctgtcaggttatcatttcacatgctaactcttactgggaacctcaaagtgtattcagttaactaaatttcagccttagtttcatgcatctctctaacacctgatactcactctgttatcatgatttgcatttctgattatccactccttcaccccaacccacactctgaacacctcaggagaaaggactgtaccttttataagctttgcgcctcccattgcctagcttgttgtggcatgtagtaggcattcaataaatgcctgttgaatgaatggatagacttgaaacatggagaaaaactagagacctaaatgtctaagatgtgtgtttataaatactagttttctttattgaaatggaaacttgggccattctgattaacacaaatgtcacctttttgattgatgagtcaattcttcagaaaacattcctttgaatatgtctgttcttacttaggtctgaaacataaatgagagtgttcactggaccagtcagtctctgaaagtgaatgtctgttttttgattccagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggagggtgaggtggccagtatttgctctgacaccagtgctaggaaaactgaagatgtacagttattctttgcgtttttgttcatgtgaaaactggatatgtagttggtgttcaggtatctgtcaacaatgccattaatgaagaatgtgcactgggcacgtggcaccttgcatagcctcagaccttgtcctgactcctcttgaagctgttgggtgtccctcctttgtcacatctttgctccatgctctcctaaacattcggcaatatcaccattaattctggtctcttgtaatctgtcagtcttgccatacttgcccactagactgtgaggctcgagggcagggcctggtgttttagctattaatactttcttcatcaccagtctgagaacatgcctggccaaatgaattggcggtgggtcttcataaacaatgagctttttctttatcaatggagcatttctttttctcaaacagaaccatagaatcctctatatatcctctttcaaatactctaactatatggtaccaattgttaagtactatgttctaggtactgtgctattatttgaattgttcatgcaaactggttggtgattggctgagtcagttgataagcatctctaaagcttccaggtcactggaagatcttctctcccttttgtaaaacaaatctgcattttatttttatcttttattttttgactcagggtcttgctctgttgcccaggctggagtgcagtggcatgatcactgctcactgcagcttcaatctcccgggctcaagtgatcctcctgcctcaacctccccggtagctgggactacagatgcgcaccaccacgcctagctgttattattattatttttagtagagatgtggtctcattgtgttgcccagactggtcttgaaccttcgaattcaagtgatccaaagtgctgggatcacaggcgtgagccgccacgcctgaccctctctccctttttcctctgtcacgtggagacctgaaatttttgccacctccagctgttgaagactgccctagttaaaaccccagacacttcccacttaaaaccaacatttttcaatcagcccctaacatttagggcttgtccaaggtagagggggacctgatccattgctgtttttgcagtattgactatgtttaaaaatgaagaaattacaaaattatggaattcctgaagttgcatgatggaattgttcttctaattctgtcattgtgtctcagactgtgtattgtcgtacaacaataacactaaaactctaaattttagctttctgggaatgtaggactcaggcaatggttttcccaaatgccctctcgtctgtccaggcctggctagccaactgctttctcagtgcttcatcaagtatgggtgcggcaaatgcgactggtgccctgctccctttccctgaccctttaccattcctagcatgccagctcatcttccatctgccaacaccttatttatttgctgagggctttctctgatgccagaggcacccagcctatccaaatggcaggctgtaagtacttaggagataatattatctctctgcccccaccagaggctacccttaagcagtgattcctgaggcctggtgtataaataccccagctctctcacttgatagggatagctctaaggtgcatgatctacagctgtctcctagagctccccagaaagattgagctccagttgcccacaatgataataggcttgataatgctcccttcatcagctgcctttccttccttgtctcatttcccccctcccctacaggtgtttcccaggaccacttctctaataaagcactttgtgttgtttctcgggaaaactaagctaaggctgttttgtggaatcattctattttaaaaatatacttcctagagccatagttgagttttttatttacaagacttctctgactacctcattgattgagtatgtaatttttttcttgtttcaagaaatgaagtggttgggccaaaatactttaattatatgtttcccatcgcttgttcttccatttggaaaatgttgtctattgttgaaattgtaactgccattagcttgaggaaatcttgtagaggttttctaactttttcaaaaggcatcttttttcttttaatttacaaacagaacaattaaagaaatcaagcagtagtatttcaagtgtgataaagagtcatgagcaaaagtatgtattggttagcatctgggggcagctgggttttttggctatctgtactttatgttcacggctctgtgtcacttgcagggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggtaagtagacttgtctgtctaaagtactaaggactttcatttattcaagcatcattcactgaagtacccaatgtcaattctgcttgatcaaatgatcaagctctgaactgaaatttactgtgtgaaagtgtacagatgtgagtgtttgcttaagagattgtggggctaaacaagattggagaagagggtgaatcaacttgatgatattcagactgcttagctcccagtagtcctcagaagttaccttggaggccaagcagtttagggaatgatcagatctgttgggctgggtttgtcaccaggacctctttcaaacagaccagagccacttttattgtttatacataaaagtagcctaggaggttactcacaaagtttcctttaaaaagtaagagtccaacttaaaaaaaaaattggggaatcattgcttaagtgaatagaaaatacatcatttttgacaacaggtttacatattgctatttgcatttttgtggaagctgtccacttaaaatttctccaagccaccctttgcaactcaattctagttactaagttgacttaagaatgatatacagttcttcaaaaatgtttctgaaatttagacttctggcttattaactgccattttcataaactaagtttgtatgctatagtgtttgttagcacgtgttttatatacatgggaaaagcttaattactttttttaactgtaaaaataatatgctcattgtaataaaaaagtaaacgtgaaagcaaagaaaattctgaggctaccatatagatataactactgttaacattctcatctatttccttctaataaaaatggaactttattttaaaatcattaaggatatatttaaatttcttaattcattacaatggaaatcataggataacatatggatgacctaataaaactaatgtagcaaaatcttatttgtttatacaaaattttaagtgtaggttcttttaatttttttcaccttatctttcacttgcctgtgtatcacctatgtatcttgaatatacatctctttctctatacacacacatacacacacacacacacacacacacacacacacacacagtcatgcaccacataatgacattcccctcattgactgactgcataggcaatggtgattgcataaggttataatactgtatttttactgtacctttactatatttagatacacaaatacttaagattttgttacagttacctacagtattcagcacagtcgcatgctgtacaggtttgtaatgtaggagcactaggctctaccatatggcctaggtgtatagtaggctataccatctagggtggtgtatgtacactctatggtgtttgcacaataatgaaattgcctaatttattgcttctatcactttggaagcttgaaaaccggataatcacactatttagaataaaatacaggattatatttcttcatctgcaaaatgaacgtaagtacccacctcaaaagttgtgcaatgattcaattaattaatgtgcatacagtacttagaatagtacctggcatatattattatatagagagaaatagactctgagtgaactgaatgaatcttctatgtacgaaatagaaaacttcaatagtaggtcacagtaattttaattttggctgcatttatttttttattttcacatggtttctgaataattaaaatttctacagaagcaagatatcacataaggacattttctacacaggtgggactattctctttctaccaagagatagaaaacacaactaaaacaaattgagatgtttactttgtttctggatgtaaagaaataatgttataaagatttaaggctgggcaccgtggctcacgcctgtcatcccaacactttgggaggccaaggcaagaagatcccttgagcctgggagtttgagaccagccagggcaatatagcaagaccccaattctatatttaaaaaaatacaattctttctgatttaattatatattgtactagtcataaatttttcagtggcaagagaaaggaactcagaaaaaactagattaagcaaagtgacctcccccaaataacaacaacaatctttatatactgggagcgtgatctagatttaggcacggctggatccaggattcaaacgatgtcatgagtgtcctctgtttgctggctttattctcagacagttctcttcatgtggcttcaaatggcggttagcagctccaatatcccatcactctcataactgattgtctcaaatgaagagaaaatgagccaccaatgaaagaattaatatacatgatgctcatcaatggcaatgatcaatgactggcatagaaaaaggagagccattcagacgtttcatgctcccaaaggaagtacacaatactttttgtgaagtattcttgccctataaaatcacaccgcaatcagagtaatgtctggctctagctatctctttacagaaaataaaagagggagaagaacatacaaatgacactatggagtgtccaaatccaaacaatatgaagatctacagtaggaaatcactgagatttcttcaccaaaacaattataaggaaaaaggagacagagggaggaaacacagattaagagactaaaaggcacatcgaccatatgacagtgtgtgacctttatgtggatgttgactggaaatttaatgctattaaggaactattgttgaaatttctaatatgtgatagtgaaattacttgtgtttttaagagacctaattttttagaaatgagtttctcaacctcagcactgacactatattttcacatctaggacatgatcctaggaaaagcaatcagaaatgtgaacaaaaacgtgtgcacagaattgttcacaatagggtcatttatagtagaaaaataagcatgtatattttggggacctgtgcaccattcagaggggaatatggagtaaattatggcccattcatacaatagaatattttgcatcttttttatatctccatagattttgggggaacaggtggtatttggttacatgagtaagttctttagtggtggtttgtgagattttggtgcacccatcacccgagcagtatacactacacccaatttgtagtcttttgtcccttttaagtgacatttataaggaattgttactagcatgagtgaaaattcatgcgacacgatagtgagggaaggcagtaacattctctctgtcaatagatattatatatatgcagtgtgatctcaactatgtaaaaatacctacattcatgtagaaaaggctggattttaaaaaatgaaagattagctaggcacagtggctcacacctgtaatctcagcaattttggaggttgaggcaggtggatcgcttgagcctgggaacatggcaaaaccctgtctctccagaaaatacaaaaattagtcaggcatggaggcatgtgctggcagtaccagctaccctggacgctaaggtgggagaatcactgcagcccagaaggtcaagactgcagtgagccgtaatcacgtcactgtactccagcctggacaacaaagtgagaatctatctcaaaaaaaaaaaaaaaaaagaaaaaaggaaaaaaaagaaagaaagaaaagaaaagaaaatgaagagtgattatttctgcatcaggtatttctaaaagtatattatttttacatttttccgcattttctagattttctttaagaagcacactttaattatgatcagacgaacaagaaatatcttttagaaattaataaagagttagaatccctataaaatgtgtgtttaggtaataattctggataatggacaaaagctcattttctctgataaggagaagattagaaatataaaatatcacaagaaaaatatttgatcagaaacatttaacgtaaaattctggtgcttaaagggctgacctttaagtatctggataatagaaatagtgtgagatgaaagaagcattactgtatgctgtcaagttactattgctctacatgttacggcactgtgctggcattctgctctgtattttgatttcctccagggtctcaagccatgaaacaagactgttcattttgtttgcttatttgcaggcctccagacagtggggatattccgagttggaagctcaaaaaagagagtgagacaagtaagtgaaaagtaaagattatattttgtttcacatgactttcaattgaattaccttttgcaaagttcaagtttatgcaaattccattttgattatctttttttttttttttaccctccaagctattataatataattgaattccaggaggtaaaaggcaacaactcagaaatgttgttacagttaggatcaaacacttgaaagcaaaatgtctggatgtatctgtgccacgtgcagccaaacaaaactaatttataaacatcttattgaaaattgcaaaagcaggaaattcagagtgactgatcaataaatgatataaagttgtatgtagcacccgcttttactaaaatgtgatatgaaaaatgccattaacattcccttcacataagatgctatgtttatagctttactttatcaaaaataaataattcttatgaagtttccatagaaccattgacccccagtttgcttttcacatagagactgtgctcctttgtttccttcagccctgtgcaacattcctgcaactgaagtttgatattagaccttcaacaataggttcctgtgatgaggcaggtatttgtgttcatgatggcttcataaaaggcaaaccatcctttgagaaaagagttcatttgttggtgaaggaaaattaaagcattattttcttcctgttgttttcaatggaaggagataaggaactcagcaactcaaaaatgaattcaaatgaaaataaattttagttggaagaagctgaagaaatgatatttgttcatattattgaaagtaattgaaataaatacctcatttatcttttttgtcaagacaaaaaaggctttcaacagaaatatgttttctgattggttggttggtttttattcttaatagttacacaagaaacattaaatggatcaacatttaatgtttcacaacagaacttgcaggaagaaagatagtacagtaacatttctgtgcagaattgcagaatatttttacaaatattatctcactgaatctgccaaccggctgtgagtgtagcccctttgacccacttctgtcaaggcttatagagattaagaaacataattcaagatcacacagtttaaccagtcaccattaacttcataggccaaactctttgcatgttccattctttctgcatgtacgtatactcagaaaagaagcatggtgtgtttgaatgatcacaagttggaggagtgccagtggaagtcttctttgttttggctgcctgacacacgctgatggcgtgctgtctggaatcaatgagtagttcaggacagtgatgggtattcattctcatcaggtggacaggtagcgagtgccagaaattactcatcagttatatcgggatccattaaaggggaaacctttgcatggagttgtatttaaggattacccaataaaaatataattagtgtttacttagaagtagatttcaagtatgaaatatgccctaactcactcatcattttactttgttatataaccccttagcaccctgcactttttccttagatcactagccacaatgttaagagtgaattatttgtgggattacctgcttatcacattgtttctctagagggactttgcctctttactcactagtgtattttgtgagcctgtaacagggtctgacacaggaaatgcgtagtaatctttgttgaatgaatggatggatgaaagattgaaaacaaatgaactcttagagaagttttttgcatagtgtaggtttatgaagttacataattatttctacagcagagaacaatgcatacgaaaagttgagctgctagagataaaagtagggtgtggagttattactcccttgctactgtgttttcttgctgctgcaagtgataatagacctagtataatgattaaggcagggaatccttctggtaattgttaataagactactttgacaaatctaagacagcttttatttagttattgtcatcttttaagtcttagtcataaatgtgttatcagggctcttaatttcatttttgcagaaaaaaaaaatctctttgctttcttatagagtgactcagtaaaatatcaacatccaaacatggcaggattggtgacacacagaaatgctgtgtaatagattaattcctccctcccacatttatagctgacctaaattgtcttctacctcttaggtgttcctcctaacctggttgtcattaccaagcccttctgcatacatcattaacaataaatccacagatagttttatttaataatgcttatatatatatatatatatgtatacatatacatatatatgtatatacatatacaatacatatatatacaatacatatattgtatatatgtatacatatatacatgtgtatactcatatatatacatatatatgtatacacacacacacacacatattcatagctggactgtgtcaactcggcagatcaaggtgaggatgttgtttgcttccccttcttggggtctgtgcagtcttaattccagatgctacgtgtcacagcacttctcctgctgggcactgctcattgaggtatggtgttatgtgactgccactcgaaccattgttcttccagttacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctctgtgcgtaatacagccatatgtgggaaagtggccctggaatactaagatgtccaactcattcatcataactttatgcatatgtttcctgataactttttgtccttatttatcaatctctaaagagtgagctatttgagggaatttctcagatttaccctgggaataattagcaagaagaaagttacaataaaacaaatggaaatagccaagaagaatttgagatgctttcaaataacccaagaacagtaaaaagtactatgagttagtgcttagagtaccaacaagagttcacattgagtctgtgcctaaaaatgagtttgtgtttctggtacgaagaaggagggaaccacgagaacccagagtgagaaaggagggcagcaacattccaggagaagcaagatgccatagcccagtgccagggctttcaacatagctgcttctgggctgtagctacagatcccatgaagaagaaaaaaaggaggaggtagaggagagataggccaaacctgggtcaacctccatacatttcttcctccaatgctgccattcaaataggatcacaacggagagagaagacattggctttgctgtatcttggttattgccaacaaaatatctgtcccttgtgaattgctcaacagaaaagagccttaaatccattataaactcaaatttcagaatgttcaccaattttcagccattgttaataaatatttaccaaaaatggaagactgaaatccttaaactaggtgatgagtaatgccagggaaggggggagaagaaagtaagggaaattgagttaccttttttttttttttacctggattacagttatttttctaggtattacacttctcgaggtctaatttggctttatatctttcatagaatcttgctggtaaattgctaaagcaatgggcaaatgagtgaaggcatgaaatgggaattgccttgataatccctttcttaagacaattgagaggaggcctttcctctgtgcctgaatagtatgggctccccttttatttgagtacctctttttgccttgcttagtgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtaagatgcctttgctgccatagatgccgtgactcttcctctcccctattttaaaagggcataccaccaaaatggccattttgcctggaggtaatgatgtctccccttctccaacctagctgtctctgtaggaagagactaatgcagggccttctctggaggcacagttcctaaaagtgcatgggccatgagcctccttatatgtttcaagtatgcttccaaatgaggctgtcattttccatggtgaggctttactcaagactctgaacttccgtttgtaaagaagaaaaacagtgaactacagaagtgcttgcaaccatgtaaaagtggaatgatgggggtgggaggagattgttatccttataattgattttacctgcttctataacttggagcccaaatatgatgtcacctctttattcttccagtttatccctggagctcccatctgcactatgagcaagaagtctagtgtctccctttcaagggatcctttcctttcttaaactctccccccaaaacagggacttgctcgatgcaagggagggtcagtcctgcttccaaaccaggtgtggaggaaactgggtctgatctgctgaccattgccattgtgtcttgatgtcacatggtatcaactgctcaaagcaggttgtacatagtcccacagactctttagaaatgttcttgttggatctgatccccactcaggccccagtgtgccccccccccgcccaccaaatctaagatcttgggttctggttctctttggttacactcatatatttcaagatttttttttttgtttcacccttggacaaatgagatgctggcttgaattttaagttgcttacttatgggcaacgtatttaatcttcaccttaacaagagacacccccttccctctttgataccatgcagttatacctctccctgacctcggattcctcaggaggttttagactccttaataagctaacatgcactgtaaatcaataagaaggggccagaggcattccaaacttacttaaccacagaaacttttttgtaaattcttgttaaacaaagctcagctgcactgcagcttcagttctgtgtttgtcaaatttctttcccaaagaacgtggttatgtataatttttttcactctaatccagaaaggcaattctgcatttcttctcgtcctcctccttacgggtgtgagaatggaactctcctgacttagccatttatctctatagcagttataattagtgaagccccagatggcttcaggtttcataatgtggcactgacaccttatttcagcatacacagctctttgatgggcatactataattctcataattgttaagtagttttattactcatttggatgccaacctctatcaactacagttataacagaagctgtagcatgatctgcctaattgctgggggaaagcagagctctgtgtttaaaggtactccagttacttctctgacatttcttaagtactgtgtgagaaggagaaaattgggtctcaggtaattaggaaggcattgaggaaagcaaaagttccaatcgaactcattgttgcccttttagaatcattttcagacattctttccattcaattgctgaacaagtctccattgcctatgccaaaaagaagaaaatattcttggacaggtgtaaatgaaacagcatgctggaatattagctaccatttatgtctctccttccatgagctggctttgtgctaggggagatatatatatatatatatatatatatatatatatatatatatatatatatgcatgcaaatacatataaatatataaatatatgcaaatatatatatatatatatatatatatatatatgcaaatcctcttaacaggcaaaagagatatcactgtctccatgtttcagaagtgaaaacttagggccaggggagctaagtaacttacctagcaacccacagagagcttccacttaaggttgtacgagtggcatattagtgcatttcacaactctaggggaggtgccatggaccccatagtcactggagatttgcagagttattaggacagtatcccagtggatgatagaaaaagatcttgaagaaggacaatgtcgttatactggttaatgggttgggttggtccccttactagcaaagtccaagctgtgcatagaacctgagccagtctaagagaaaagacgtacagaataggaattagaagaaaaaaaaaatgtactggggtctaggtcatggtttctcagcctctgcacaattgatatttggagctaggaattctttgtcatggggccgtcctgtgcattgtaggatgtttagcagcatccccggcctcttcccactagatgccagtagcagtacatctcctctcccaccaagttgtgacaaccaaaaatatctccaaacatttccaggtctcccctgaggagaagggttcaaaatcacccctggttgagagcgcttgatagctctttaattcactgaccatgtgttgttagaaaaatctattaaccttcctatacctgggtctcctcatctgaacttgaggaatgaaaattcttcaaccagccttgaagagtggttgagagacctagtttactgtaaggaatatggaattatcctggtgacagtgaagttgtaaaaggaagccagggtttacgagggtttctagacactcttgacctgaacattgcatcaaaatgaaagactaatagccaaagattaaagcagcaggagaaatataaggaaagcattgcttccgtgaaatcgttagcagtgacaggagagcaggcagctctcacagccattgtgaactgtagtaaaggctacggagcagtgaagtactgagggagacaatgggaaattgggccatgttcataaattgctgaatgcctctgtgcagggcaggtggttgattcttttaagctgtgaatccttggaaggattcaactaatgggtgatatgatccacgttgtagattggctagagacaaagggagagtgagttaggaggcttttgtatcaatagtaatatggacaacagcaattcctattataaacatttccatgtaagaatggccttggcgggccaggcgcggtggctcacgcctgtaatcccagcactttgggaggccgaggtgggcggatcacgaggtcaggagatcgagaccatcctggctaacatggtgaaaccctgtctctactaaaaaaatacaaaaaaaattagccgggcgtggtggtgggtgcctgtagtcccagctactcaggaggctgaggcaggagaatggtgtgaacctgggaggcggagcttgcagtgctccgagatcacgccactgcactccagcctgggtgacagagcgagactccatctcaaaaataaataaatgaatgaaagaaagaaagaaagaaagaaagaaagaaagaaagaaagaaagaaagaaagaaagaaagaaaagaaagagaaagaaagaaagaaagaaagaaaaagaaagaaagaaagaaaggaaggaaggaaggaaggaaggaaggaaggaaggaaggaaggaaggaaggaaggaaagaaagaaagaatggccttgggatttgaatcatgcatgtcctgagcatctaccctaggttcctgtaaaccaacgactattgctcagaaattttctaatgactggcctcaggatacaatggcatctaagaggtggaggaggtgaggacacaaggcaaatatagaattagggaatgcactgcagagtcattgcagacattcggagaagtgatgagcatgggccagaaaagttaggaatggcttcatggaggaggttgaatttaagatgcacatcaaagggtgtgtagggattgagtacatggaccacataagcacagcattgggatgggagttagccaaaccccttctgttagaagtcaagggtagagggagaggatcaagagaggagttatttattattttttagttgatttggcatgagcaggtagagaatatggaatgggcagactggagtaaaactaaataccaaattgtaaaatatggtcaaaaaccaatatttttcaacttcttctcttccctatttttttagtatgtattatctatttgttagggtgttgtttggggggattgcaacatagatgaaacctgaagcagattgtcaagaagcttgaaagctcacacaggttctgccagcaccttgctgcataacttgtctttatgaaagagaggaagaggaaggaaaacagagttgggatggggggtggtcttagcttcctcatctacaaaatgaacataatattttctctttgatatgtgcttaaaattcaatgcatcattcactggtgagaccttaaagatgtctaaaagaagggcatgagaaaaattgttgaccaatcagtgcttttttgggaaaaaatagcagtattttattgaattgtggtgttttgctatcttgtgtttgttttgttttcttctattttgtttagtttgctatttgctttgctccttagggaaaagagaaattcccaagtgtaagaaacattgcatttcttcaagaaagaatatagcaggaacaaaattgaaacctcctgagcagtggtttttcagagttcaagaaccccctggcactgcctggaaaatgtggtgtgaatatgcacttgtttggtgagagtccgtagctggcattgagttctcaaagggtctatgaggcaaaaaaagaagttacaaatcaccagtgtagggccatgattactaatctctgaggaggtacatgcctctaggaaatggtggttggctttggaacttagcaagacctgtgtctcccctcaccctcattcagccctgttttaaagctcgttttcccgtttccccatgccatggctgggtctgcccagcaagaggaaacaggaagagatgtagcaatgggatgaagagagtagggctgcctagagtggggccaccagcttcgcttctttctataccatctcctggctctgagctttggacatcacttccctcgtctataaaatagggacaacagcagcagctgtttcttaagcttatagtgagaaagaattgaaatggccagtggaaagcccctagcctggtacctgtacatattagacttttaacagatatgagctattcatatgaagcttagaaatgatctaggatgttcatttagtgaagataaaagttttcttgaattgctagctaattaaaaaatgaagtaatggcctggctcgagtgtacgttgtattacctagacacagccgtatagtatatatataaatatatgctgaaacacatggagaaaaggtggatgttgcctgggagcaactcttctttccctgttaaaaaacaataaaacaaaagaaaccccaaaagtgttaacaaaccccagcagcttggtctgcagctggaatctgtgtgcagttttacagatgggttgtattccattcccagaatagcaacaggagaaggaaagagcggaaacagagctctagattgttctcgtatgaaacattcttttaaaagaaaacaaaatcttccatttgttaatgttttttttaaaaaatgagaaaaccctaatatgactttacaggggtaaggggaaacactccaaatacctctgagttctaaagggaggaatttgaaaatgacacgtatttgattttcaccttaaccatgaatttccaggaaaagaaaaattaaatgaaaacttgtcaatgaaataaaaaacttaccaatgaaataaaacaaagaaaaatgattggacgatcctacataaagggcactttctttgaaattgtcagtgtttatcacatgaaatgatatcccttggaggccaatcattcacctgaaaacagccttgccttctaaaaataatacaactcgtgtaccaagctgggattgcagggcagggcagccaccagctcatgacgccacaggatgagagtggggttcagagggctttgtttcagctgttcattgggactcctgaattctatgctgggcacccaggtgtttctcaaaatctatgtagatcttcccaggcaaaagatccccaccaagcagacgcagttcccatacttatcctgactctcaactgatattgacaagagaaataaaaattcacatagaccagtggttctcaaccaggagcaattttaccccacaggggacctgcgaccatgtctagagataattctggttgtcacaactgtgggttgagggcaggggtgctcctggcatctagtgggctgaggccaggggtgctgttccacatcctgtaatgcacaggacagcccccacagcaaagaatgatctggtattacatgtcactagtgtcgaggtagagaaaccctagcctagagaaacttactcagactctcccgttcacctgaaagaaagacaagtagaaaaaattcccaaacctttgaaaacgttcatattccttattacaacaattcaacttgtaggaatttactcctaaaaagtgctcacccgagctcacaaaatatcttttcaaggatattttttgtaccattgcttataataacagaaaattcaagacgacatcaatgcctattagttgactgtggttaaaaaacatcatggtttattcgtgcagtgggattctaggggccaatgaagcctgaagacaggattttttttttttttgtagtggaaagattattgtagcatgttgttaagagatagtaagcaagttacaaaataatatatggatgtgatcccagttttaaagaagaaaatatcaggtgtacatgtatatatgtgcacaggaaggcataggaatggctgattcttggcagtggtgaaattatgggcatttttttttcttttggcttacctgtgctttctaattattaatatattgaatgtgaataattttttatgcttcaagcaaaaaatagttcccttccttcaccccgtactcccctttagctcctcctacatttcttcttcctccttctctgtgatatcttttgaagaaagtgtctacattcactgtttccacttctgcaactgtggctcattcctgccacaccactgacatgactcttagctgggacatcagaaccatcagagagtccattctggagggaagggtcacatctcgatgaccctctgccacagttgataactcacttgaaactcccctgtcatttcttcttggacacaggtttcttttatggtaacttctcacccattattggcctccttcatcagctgctccttaagggtgctggagtctccaggaaccccttttcagcccttcatgttcctcacttaactgtccttccattttttcatttgttaaaacacaagatccttaccctctgcattatcctcttcaccccctccgtaactttggaagctgctcttcatccctacttcttccttcctagttcagatgctagctgctgtggcctagactgttgtggtatgtcccaggtagtcctacttccttgcatcccccatcccctgttccatagattgctcttcctgaaatgcagattccatttccattctgctctgttcagaatcctcttgcccttagatcacagtttgaattccttggtctgacacatgaagatcatctcacctggcccttgcctgcctttcctgcagaactccctaccacactgagcttcctggggctccatgacgtattttagatgtttctgtctttgcatgtgtggtgctttctccattgtaaaattaccccctagcccagatcctttgcttttcagcctagcaaactctattcttcttttgagagtttgtgcaaatgcttccgcctctgtggtagtgaccctggggcctttggagttgagagctttatactttgtactcattacctgtaagtgataggtttatttcctccctagaatgagagacctttaaaataaggactatgttgtaatcattggaaaaattttaaaataattacaatatatgaaaaatgcccagcctatgataggtgctgagtggatggatcagtggtgagattatgggttgatgaatgaagggatggatggagaaatggatagatggatggatgggtgtcaatatttcttaagtgcaaacaggatagaaattttatgtagtacccattttacaataaacaacttagagttgcaaatttttattcaatatgctattgagatgatcactgaactgtgagcttcaatccaagatattaaagcaaaaggaaaataatgatgccctccatggattctgacagagaggatggcatccttgcaggattaaaaaaaaaaaaggagagtaaaaggtttcattgattgttgaatcacccagtatcttgaaaggcaaacataacaacagtccttgtgttctgttctcttataggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggtaggtggcccttctgtggcaggacatcacagcaaactgcctattggtttcctctggaggcaggatgaaattctagtagaccaccctctggggtgcagtgctgctcactgaattcattggaagtcaggcagtttcagcaggagtagaaatttgcacaactatgatgtcattttgagtttgtgactccatgtttaaacaaacatgccaaattataattttcattttgttgtcctctaaaccatggtcacattttggagtcacttaattataaagcagtgtccttgctcaagacattaataaaacccttctttatggaattgtgtccctcatgaattcatgtattcataagcatcctcagtggtttcacctcctccaaggtcaatcttgacattttacctcctacatgaagcttcacctctccttcctttgtccttcccatgccacttctctgtcccctgaactccattactgttcttactgatgtttatcttgcccaacattgtgtatagtaatttatgaccatttcccctagtagagtataaatgcatttaaaacaaggactgcaccattgttatctcctctccatatcctctgtacacttttggaaagccctccatctggcaggcactcaataaatatttttttgatttgtattgaattaccagttcctgttttccttcatcaaactgcattgcttgctacaacttcccttgaaacattaaaacaaatgccaactctcttctatttctgttcaccactaatattgcatgtcaaaatttacaggaaccttcttcatgttttttctcccatttctcttgtcaatttgcaaacgctataaagcctgcctattccactagagccttttgtggctccttccttcaaccgagaattctagttacctcttttaaatttctttagtagtttgtctacacttatcaagtgctttgcattagatttatgtccatgcttgtcttatactaattactttttgtaaatttgagacccagcagtttagagtatttgccctctgtgtcttacctatgtgattgtgaccaagtaattcaatactcattatgcatcaattctagctttagaaatgggaaaaacaaaatgatgatgtaattctcagggtggtgaccagaatcatttgatacgtgaaagtattgtgcaaactgtagcagtttatgcaactgttaattagtaattatattagttgggtaacacgtgctgcctcaaaagtcagtactttaacacaaacataaatatcactctgacataaagtttaatcaggtgttaagtggacagccttccaggtggtgatttaggaatcccagctccttgtattttgaggctctgacattttttagagttttacgggcaaccccagaaaggtcatccatcttgtccactcaaatctcattggccagaacttatgcacaagccacacttaacttcaagcgaggcttgaaaatgtatcctggttggatccccaggaggaagagcaaatgaaaagttcactgaggtagaatggcatcttgttcctgtttgtgtctctgaagcactgtccctgggttgcacatgctaagctctcaaaaaatgttgaattaataattgactctatataaaatttacacatcagcctaaatcctcataattaactacatatttggatgaatcaaatgtctgaacttttcaacattttcatcaagtttaagtcacatatcatcttgccaagtagtcttggcattacttcatgttctctggatttttttaacaaaataatacttctcatcaaacttaattctattatctaagcaaagttctcctttatatgaaaccacatatcatcgagcatttcttttcaactcagataccaacaaaagttttcctggcttctttgaaaatatagctgctgccattttaattgtgccatccctcttctttccatttcctgccacctgaattactaagaacagtataaaaacatcagtattctaccttttccagcttttcccaaatctgatctttgtttgccattctctgtagggattgatgtcggcattctctcatatttttggtctccagttatagtctttacttctcatagaggcctttcctggccaccttgtctaaaatgcacctccaccctccatcacacacacacacacatcatcactccctatttcctttccctgctttttccccttagcactcaccactgttaacattgggtcttacaaatttctcgtttatgttcgccactccctagaaatgtaaactacatgacaggatgatttttttggtccatttctatctatagtactttctttactgcattacccctgtgcctgggacatggtaggaacacaataaatattggttgaattaatgaatgactcaatggttgttctgtgacatatgatttccatattaccaagccttactccttatacgtatgaaaagatttgggcatggagaaattaaggatacctttcttggagtaagttaaccattaatgtaatcattcttgacctctttagaaggattctggtaatcatatattcagaaaaataacagtggagtgggaggaagagggagacaaatatctcaagtcttggtctatgaaaagaaactgactctggaaccagaaaatttactatcgtcctgtccctgttatatattggctacatgacctcatcttcttctatttctttagttatcaaatactagatttgaatgaatgatagccaagaccccttctagttgtaaaatctgcatggtgctatgccctagcactgacttcccttccttcctttttataaagcacaggagaaaattaatctcatcacattttagattatcttggcatatttggcagttgagaaactagtcggctataccaaggctggtggtttgtcagcaaagctgatctgcatgggtggacaaaaatgtaatcttgtatgtcgctatgttgttttgttttgtttggctttttaaagaagctttcagaattattataattccaaacaaagaaggatgaagctagtcagggcctgatggttaaaagtagttagtaattgtgcagtttcacagtccttgggtttaagagctcggaaagggaggtgtcacttctattagcattagaaaggaagacttgttaggaaaggtagctgtgagcttgtcctggaaggcagaacagacctggaggcagtgattccataaaataactggtggaagggatgtagaagctcacagaggcctggcagggacccaaaatttgttctgggtgttctaacatccttcatttcctgatgctgagactgcctctcccaagtggccactctctgagttaatgggaaagggcggaaaagaacctggcttcgtcctgtaatacagaagaggaacctagatgcagaggttgacacacaatttaagagtctggctaggacagtcttttgcattggttgtttgcttttcaggtactggtttggaaatccttgagctggaaatagatcataatagcagatatcatgaccacagatatcaaaatacgaaggcagtagattataatggtggttctcaaacttgagtgtgcagcagagttgcaaggaaacttagacattcagattcctaggatgcactcccgagaatcagattgagtagcactgggatggggcccagaaataatctgcactttctagtgaagacctccacagagttctggtagtttcctaaccacacctttggaaaccatatcttgggaaacactggtatggtagaaagaccatgtgcattggaatgagctaccaaaattcaaatccctgctcagccacttatttgctatgtaatcttgggccccacagttaacttccctagccaaaagatgaaacaatgtgacctaatttacaggactgttataagaattagaaatgacattttaaggcacctagaacagaattaacatatattaggcattaaaggaagatttctgctattattacattaaagggataaggtgcctgctctatcaaagcgtgtttgggtgttttcttggaaatcaagcccactctgcccactgtgtataatgctgtgacctgatcccacacatatatactcctaggcccttactctgctctttttattccatagcatttattaccttttaacccactatataatttacttatttttatgcttattgaaacctaacagaatacaaaccttataaaggcagagatttttgtttgttctgttcactgacattcataccacctagaaagtatatggcaaaagatgggtgctcagtaattatttgttgaataaatattgcaattctgtattactagaaaaaaaatgtatttttgtttcgattttgtccagtgtccatactgcttatattcccttacctttaaatcatgaccctccacttctgatatcaacacctgttgaaaaactggctaacataaaatgatactctgtgggagcactggaaatcaaggataagaatcattaatatctacacaaagtcattggtattatcctaaccagaaagttctcactgactaagtcattgatacatgaattgttctgaaagttgttacttctgtaactaatattgggaattccagagaaaactcatcattgctcttgggattagtaagaacttcagagcagaatggagaaaactgtcagcttcttctaagggctgatattaaacgattcttactaggacttcttcttaggagaggggcaagaaagagaagacaccacccttgtaagctgatgaaaagtccggagtgcagtggagacgtgggaaagccagtgtgttcccaccccactgagttgtcagcctgaactggggaccagcttagtgcacgtgggaaatttcaaatgagcactactgggagcaagggtcagaggctgtgatgaggattccgagtcagaagccaagctttgctttgtgttctcttcattccctgatgaaaatcgcattttcttaaagccactttgcacaccaagtcaaagagtcaagcattcatccaggtcatcaagcaagaaaccacccctcccagtatatccacataattatatatgatttccatttccttttctatatatcacaaataccactgtctacgtgccagggttgggctactcattacgtacattattggcttgtttaaatctcactaccatttcatgaggagtaagccaagtttgtttgcccaagtgatgcagtgactaaatgaattatttctacagcatgatgcctccttacacaaaagaagaggcattttgatgtggtatctcagatatggagtccatttgtggggaaagaacaagaaaatatgttttagccaatctggaaatgaggaatgaagacctttaacagcagtaatactgctggactaatcatagcacccctgatgttcaggccagcagatggcttccagagccagcaaatgttctgctatagtctgctcacttggccctgtctgtaaagacagaacatgtgtactgtttgtgtcccacaaaggtggaaggaagcagaagcaaattatgcctgaacctttcccactccctttaacctgttgccatggagcaaagactgctgatttctttcatctttgcttgagttatcctccaacatcgttccatgagccctggacccttccactgtatttgttcactaatgtacctgaattgccaaaacatgctgcctgacatgtatcaagcacttgagaaatatttgccgaatttaatgcatcttgaccctcccgtgcacccagaccccttaaattattaaaccacctgtcacaacagagccacgccaaaggttctaagctgggcctgtccttgtttgagcttttgctcccataaacagccaaagtgatttcttttagtgtgtttgttaactacaaaatgccatcatgatttccagtgctatttacttttgctgggttttaaatgctaaagcatccttcttggtcaagtgcaaagtggtggattggtgtggaacatccagtgacaagtgcagtagggctgggtcctgggaatagctcttcaaaaagcccttaatggtttattgtggtgacttagtaaatggagaaaactcaactcataccacttttctctctcagtggtttatggaataaactacctcatagcagttataccccaggcaataattcaaggtttcatttttaatttgatcgggtagattttaattgtgacagttttattctttcatatgtgcagtgtttacatttttttctctgaagcaggaggggccaaagttcttttgatttttggaacagcattatgctttgaaggaactcattaaaatctaaggagttgagtctccagataaacaagaccataaatggtacccttagaaaatatctagaattgttacaaggttgactaaagcccagtagagattttgatgtgaaacaatgaattgtaaatgaagaatcactttgggctgggtttcgtttcttctttttaacatgcagaattgcttgattttttaaaaaatgtaatatgtctttcactacccttctccttagttcccattttgctatatacaaaaatcccagaagcagaaaatgaaaacgttgtttaattattgagctatctttttcaaaaagttttgaagtttttgtattgataagaaaaatagcttaagaacttagaaaaaatctgatgataatcagttgggaaagaaaatgtattttcccactctagaaatgaacagcaagaagactgtgctgcagcatgacataggtaccactgataagtagagagaaacatctagacaagggcaacgtaacacatgcagtccataatcctgggtgattttagattattattatttttagccatttcagcaacattcactgcacatccactgggtagaaatcaccaccctagcttgtattctgaaagagcataaaattgagcaagagagtgtgtaagtgaatgacggggtgagggtcatagaagtgcaggtaagaccttccagagaggaaagagtaggaaggcaaagttagaggaggaaaatgagacatcatttaggaaacatttgactggcaaggagaacaataatcaactgcaaatggctttcgacatcagcatttattatgtgacacagtaaatatgggggggggggcacagtttcagtagctgggtagcactttgctctctctctctctgctctgccatcttcagctgcaaaatggctacagttgataacagcatctcttccagccatcattgcatcaattaatgaagagatgatgtttcttttcatgtacccattttcaatagggaagataaccttttccagaagctcctacatgccccacttcaggtaccagcatgtgcatacgtgatcttgccctagctttgagggaggctagctgaaagaaaactacaaatttctgagcctgtttcagttctgggtaaacaaatcagataatccctgccttcaggaaatttaccttctaatgacttgaatggtgggaagattcaaggtctagccaaaggaactggaagggtgaggctacacagagtctgacttcaagaccattgcagttgaagggccaagaggtcataggctgtaactccagaaattcagagggggattagaagcagaggcatagcaagagaaaatcccataactgagttacccaaaagaagtgttaagcaaaagagaagagagtgcttcttctctgaaagcgaatggatgactgttaataaaaactaataactgcagaataaatattgtccatctccatgttatctgcttttattttttcaagtgtttaacttacttatttcatctatttctaataaaacattttattactagatctctttgcaattggtaatctattttcatttttttttagcgcttttgattcccgtaacaccccccattaagtaaaatgaatatgcatatgttttcagatgtgggaacagaatcctaaagaaggtgattgatgtgtccaagtttatattaattataaacagcagagccaaaactggatttcaggggctgttgcctcagtcagatttttttttacagcatcctaattcctgaaaaggtatgcttaagtcagtggtctacctagatatttctttcttacttatttcaagctgctgtttcctatcagtttatttacttgacttttatttctccattaagtacctaaattaatagagaaataagtgttcatccaatataactgagccagtagtttgaaatttttattaaatgttaggaaacgaaatgtgcagttatagccaaagattagaagaattataggaaaacagtactgggtgctgttgtatgaacattaaaaaatcagtttcaggcatcatttcaaattttttacctcattttcccactgactccaattttctgaatcattcctttattttttagaatgtggtttaatcacatacattttgaagctgccttaaatcactctgtaacaaaatggattataaataaactaatgaattatatacaactgtagttagttttgcataatacataggaaaatattatttgccttcctgtaatacatggatctacaattttaaactatgtcttttttatgcatttgtaaatagtgtctccaagccaaaatggtaccatgggccttttaaaaggaaactgtagatagatttataactgtgacccttcctatttgcatttgttaccaagtaagagtcacatatgctacataaaatagacctcagtaattatgattgctcgcctagttgaatgaggaaaacctctgaattgcagactagcttgacaaaaatttatggaaagttattttttaagtaatgatacttctgaaacctattctaataatgcatccaagttgataatttatcttagacatactacatactctcaaagaattaatattgtcatgcttgcaccactctgaagggcttgcactctaactgtttattctttaattaaatccaagaatggattagtgcttggagcgaaattttttttttttttttgagacagagtctcgctctgtcacccaggctggagtgcagtggcatgatctcggctcactgcaagctccgtctcccggattcacgccattcttctgcctcagcctcccaagtagctgggactacaggggctcaccaccacgcccgactaattttttttttttttgtatttttagtagagacggggtttcaccatgttagccaggatggtctcgatctcctgacctcgtgatctgcccacctcggcctcccaaagtgctaggattacaggcgtgagccaccgcacccagccacgaaattttttattacatgtcaaagcctagcaagttttaaattaaactaactggatgaaaatgcaagtacttttcctaatttgtttatggaattttcttctaaaaaagagatcgggacatacatttttgtcctatattattttttgctctgctgttcattaaaaaaatatgagttctctttcctctcattttcaccctttaggtgttacgtttttaaaaactgttataatagcacatggctgttgggtgatgatctttggaaaaaatacagtaaaaatgatgtctttctgtttaatttatacagtaagagaataatctcacccttgacctaaatatcctgccctttcccttctccccattttcatacccaggccactgcagctggtcacagggttttaaataccatctatatgtgcctcttaaatgtctatgttcaacccagacctctcctatgaactctgaatccttattgccaactatctacaagatacctccttcatttggatgtcttgcaaacctctaaacattatcatatcaaaaccacactccaaaacttgacccccaaccttctcctcctgcagcttctccaaaccagtcaacagcaactccatctttctagttgcctaggccccaagcattgaggtcatcctttcttctccctctccctctcttctctctctctccatccaataaattaatgctattacctctatcctcactatgtccactgtggaaatatttctcatcacctcactgccctggttcaggacccatcatcttatctgggtagatcagcaggccctctctgctctccttgctttatctctggctccatgcattctactctcaactcagcagccagagtgatgctgcttcatgttagtcatctgttcaaaatctccagtggatccccacccactgcaagtaagtgcagaagtccttattatgacccataagactccatgacacctggtcctggccctatgaccccttcctaccacccgcctcctttcctactctcttccagcctcacagacctcctcatcactcttgactcaagacctttatcattggctttcttttccttccttctacctggaatgattttctccaactccttcatcagtttgagttttctgctaaaatgtcagcttctctgggactgacaatcctattgaaaactgcgtcttcccaagcatttctcattgcccttctttgccttgtgtttctctatgtttttcttgtatgtttgtttaatgcccgtctttccatatttgttaccagcttcatgaagacaaggattattgtctgtttggtttgtaactgaattcccagcatccaatacctggcactcaggaagcattcactcaacatttatgcaatgaatgaaaggaagggagggaagagaagacctgagggagaagcacagtggtgctgaagtagagcttgtgtggaatgactgctaggggagaagatgggaaagacagattgaggacagtatgcaagtggatggcttcagccatgggaataaaaagagtttccagtaaatgagtgtcttgaccatggcattctgacaaccacatagagaagaaatgtgctgcacatgttaaggaaatagcagacaaatttgaaagctgttgtatcaaaggttcatcaagtacgtatttttctttgcaatgcaaaactcaaactagcttaagtaatttgaaggctcacatagctgaacaatccacaagcaaatatggcttcagacatagcttgtcccgggactcagatgatatcaagacatcccttttatctctatttcttggtattgtttgctcaattgtcagcgcaatcatcaggcctcatatggatacaggccctgtatcctctcttagaagtctcagggaaaacctccagggttttcattgcctctgatggagtcacatgcccattgctcaggcaactatgatgatctgggaatggaatgctcaatagactttgactacgatacacacttcacccttgagctaaggcttgggtagcagttggtttaccagagggaacgtggggtataactattataagaggagggaaatggagacttttaatgatgaacagatgaccactacaaaaggctaatgagggcttgaacttgagtctctgcagttggaatggaaaagggagaaaagaagtaacagagatgaagtctagtaggcctcctggctctgaatggagagaggatgcagagaagctttagtacaattctgagatcttgagcttgcgtgattagaagttggcaatgtcattaatgaaggttcacgataaagtaggaggaacagatttgtaagagacagaacacatttccttgctttctcatccctgtttttattaataaaattgtttccagattctcagagctcaagaactgtagagttctgcaagaggcaagaagcaaattcttccaccaaccacttattttcagaagacttaaccctgcagttttaaaaagtcttctctctgagctcatgtgtgagagaatcagactgaaattttattttctctcaatagttttgagtttcctttggttgagctatcagcttctatggaataagaaaccacaagtcagagctgggttcaatcatctcttatagaacatttccacacagatgacttagggttgtgaggccatcttctaatgtactgtggatggattaggcttagagaaatatatgatgctcatctatagaactctactggatgcctaacaaattacaaagtgagaaacttttcatcactgatggaccaggtgcaagaaaggagtaaaggcaggcaccgaataataaagtgacatatgcaaatgtagtagccagcaattttttgagtatttaccattgaccaagtactgttttaaagtctcaacatataataagtcatttaatcaccatagcaatgcttcgtggtgagtactgttgttatccccattttacacgtgagcaaactgagatctaggaagatccttgtcgatgtacgttgtcaagggtcccacagctagtgactggcgtggctaagattcaaacccaagcagtctggctcaagggcctgccttcttaataaactgatcatatattccagaactgcccaatacagtcatcatttctgcctgctgccttggcataattataaatgtgaactctagaaagtgcccccattgggcaataaattatggacactatttctctgaaccatgatattttccttattcaaaaccaagaaaatctaacctgagcaataaaggcatccaagtggttcagttgtatctccaggcatatgaggggtgacattttggattgaatatgactattggtaatcatccagttggtcctaagaattaaagcagctgcatgggttggcgtaggtttggttttaaccagcaaatcattctgctgtcttgcagcttttagggctctgttttgtgctacagtaaaattgtcagtgaccatatgttgcctgtttctggaatggttttatttatgcctcaacatttggctccttcaggttcccccagatctccagaacgaagtgctgatcagcctgttagagaccgatcctgatgtcgtggactatttactcagaagaaaggcttcccaatcatcgtgagtattccagtgttccatcttctaaagccgcattggagatttctatttccatttctgagaaattggaaaggtttacataagtacatgcagggtgacctgaagtggaattttggcaactctttggcaattctgatcagtccatctaaccagaaaatgcttcgggtcccatcaatccacttaccaaattagaaaccacattacaagatttttctgttttattttcagctttctctagcctctcagggtccttttgacttcatttacagggaaaaagcacaaattactggcaagggactataatacacgtcaatgattctacttctagaattctgataagcgtgcataggggcccttaaggctgcgcctggatgcatcttgcttgtgcagctttaccagtgggattaacccattatcaaaccacaagacagaccttagctgaggcctaggtgcccatttgaaattagaggtgtgcaccttcttggctctcccactttttatagctagtattattttgataaaaatgcacatgggtttctacatgcactcatgtttgcaattagtaaaatgcaagccatgctgcaggctatggcttgctgccatttttgctcccaaaagaggagcacagagtttttgcattagtcagattttatggttacttccaatctttgctgcagaggcagagggtgtggggatgctgagcatttggcataaccagttaagggcataatatagcatcattaaccaggagtagtatcatcaccaggacaccaaacaataaatttgtgacaggaaaagttgttgctatgctcttacaaaattatcacttttgttatacttttaacctactaaatttcagcaattctaagatacgtttctcccatgacctatgatctctgaaattgagactaatcttataaccaatgataagctcctaacgtaatcccgtacctgtaaccccagcactttgggatgccgaggcgggcagatcacctgaggtcaggagttcgagaccaacctggccaacatggctaaaccccctctctactaaaaatacaaaaattagccaggcgtagtgacaggtgcctgtaatcccagctactcgtgaggctgagatgggagaatcgcttgaactggggaggtggaagttgcagtgagccgagactgcaccactgcactccagcctgggtgacagagtgagactctgtctcataataataaataaataaacaaataaataaaataatggcatgtcttaatcgatggtgtcttataaacagtaacacatgttaagttattcctgtatattggtgttgaacttgataaattaattttcactcatgattattgcagatacttaaaaagttatattatttagaaaaatttggtgaaaaggaattccatgttgttcaacctccttctttcccaggtcattacgttgatagcacagctaaattcagcttcactccatttccagcttagcagggaagaccttttaattggattatcctttcagatctactttaaaaaatctgtgtctgggccattcattatcaggccaaattctgattcaaataggaccaaattctgttgaaagtaaggcctggattcaagccccaagagccatgagtgaataaaattatattcaaattgtatagatgagctagtattttatggtcttgcttttcatatcagagaattaggcttacatttaaatttttcctagatttctaaccctcatcaaggtataagtcctaatttatattaacaaatggcttttcttttcagcagatcatgcaccaccataattttgataaactcatttatttccctcccttgtacagaaaagagacatgctggcatttccatttatgagcccctcatttaaactgcacttataacatatggttggtactgtgtgggaaagctacaaaacacacacttttgaggaaaaccactgatttttgcctggccaaatttctgcttttgtgtggcattatgagatagataaatactatactttaaagaacagttgatagaagtttttttacatggttttcaaatacactctttgcatataaatgctgtggtaaaaagcgaacctttctttctcttctattaggaaaaggaagaagcacacatattaagcccattccaagctgtacaattgtccagccccttctgttccctatccgtaagagtaagaagtagaattttaaagtgtaggtgagcagaccctagaccaagatcttaggtgagtgtcagggcttccaagaaaatagcaaagacttggaaccaacccaaatgtccaacaacgatagactggattaagaaaatgtggcacatatacatcatggaatactatgcagccataaaaaatgaagagttcatgtcctttgtagggacatggatgaagctggaaaccatcattctcagcaaactatcgcaaggacagaaacaccaaacaccgcatgttctcactcataggtgggaattgaacaatgagaacacatggacacaggaaggggaacatcacactccggggtctgttgtgggatggggggaggggggaggaatagcattaggagatatacctaatgctaaatgacgagttaatgggtgcagcacaccaacatggcacatgcatgcatatgtaacaaacctgcacattgtgcacatgtaccctaaaacttaaagtataataataataaaataaaaagaagaatgagcccataggagctctgtgtatgtcagagactagcattatcagtgaacagaaaacactgggggaagacttacttaggagaagaaagtgtttggtttttgtttgtgttcctctaggtacaggccaaggaacagcccagaaggcagagaatgatgtcatgaagtaaaaatgcatatgttaataaatgagtgtttacttttagtggtcttttgaggcttgagctccagagtgctacccctctagctgtagttgcctttttttttttttttttttttttttgagatcgagtctcgctctgtcacccaggctggagtacagtggcacaatctcggctcactgcaatccccacctcccgggttcaaacgattctcctgcctcagcctcccaagtagctgagattacaggtgcatgccaccacacctggctaatttatgtatttttagtagagacggggtttcactatgttggccagactggtctcgaactcctgaccttgtgatccatccgcctcagcctcccaaagtaggtggtctttttgtgttttaaactcactcactcatgcttctcaaactttactatgcatgggtatcaccagatcttgttaaaatgctctttctgaatcagtaggactcggggaggtagtctatgaatctgaatttctaacaagctcccaagtgatcctgatactactggtccatgatccacactttgagtttaaaaagcttaaaatatcaaagtatattcttgcttttaggagctttcagacttgttggaggaggcctccaagggtagaatgccaaacaataggtgctggcccactggctgtcagactcaccagccccttggaatcacctgggagcctgaagaacaactatgcctgggccacccctcagagattctggttcattttcataggctgcaatctggacattcggatttttgtttaaagtctcttgcatgattttaatgagcaaccagggttaagaacctctagcttagatctaccacgttggatatcacaaatttactatcatgtgggagtttgagctgggtgatttttgacattaaaaaggcatccttgtgttgacaaaggaagggaatcaatgctccagaccatgaatccacttggagtttggagaaggaaaagaggtgtgatttgaagtctcagagatagcttctgagaagaggaaggatttgcagtgaactttgaagactgtggaggatataaacaagcctggatatttggggagcttgcaccaggacctggacataacagtaaatatgttggctagctggggtcacaataaagaggctggccagcagtgaaggtagaagcccttaaatggcaggctgaggggtggtgcttaagtcaagaagcagtgacaatagattactgtaaggctaaattatagtaaattacagtaccctaaactgccagatggtgctggctgcattggcaagtcaattatccatcagtaacacatgtttgtgtagtcagttatctgtcaataacacatgcttgtgtagtttaatagactggttaccatttcagatccagagccagattgcctacgtttcaattccatttctattgctattatatatgcggtctattagttaagagttaatatctgttaatacatagatagatctctctctctagtttcctcatctgtaaactagagataaaaagtagcaccaacttaaatacagaattatgctcttagtgtatagtctggtatatcataaacatcaccaatttgctcatttacaactacttaccaaaggcgtggccatcactagattctactttggttttcatgagatagcaaccttccaggcaatatgacacaagagagaacccgttcactttaagttatagcattgtgtctaaaagcaaacactatatttgcttctaaccctttgatttttttttcctgaagcttctgttctctgccaccagttcacatacctaaacaaagctttacattcctgtgaggccaagtggaaactgcacaagattttatttggaggggaaaagaaacaagtttcaaaagagtgtaaaaccaagaacaagaaaatattataatttctgttttgaaagagcaaacatttagtgatatttgggaacttaatattttgttttgatttgggtttttcacttctttatgcaacatcggtattggaggagttaaaggataattccttgttttttctcgtgcttgtctgcttaagtatttggcttcaaccaaaacgggatgccagagggggattagaagagatttttatgactaagaatgcaagaccaggagtctgtgaccagcctggtcaccacagcaagaccccatctctactaaagaaaaatttaaaagttatctgggcatggtggctcatgcctgtactcccagctactcgggaggatgaggcaggaggatcacctgagcccggggttttgtggctgcagtgagccaagattaggccactgcactccaacctgggcaacagagtgagaccttgtctctagggggaaaaaaaaaaaaaaagaaagcaagactttgatttttaaaaatatatacttgtcaggtatgtttactagcattatatatgctcttttcttcaaaggtacttaaaatagttcccctaccctttgatttaaggatgtgaggaaatagggaatgagaatgggaggttaatcaaacaggacaggatatgttgaatgtgaatatttgcaacaaaacaaaggaatcacagtaggactgggacttagtgagaggcaagtgagacgcttgcctagacacagaatttaagggaatgccagaaaactcagtcagcaaaattgattatattgcaatgtaatattttttaaaaatccaagctaatgccaaaaatgtttgataaagaaaatatcaaaattttaaaaagactagccatgcttagtcatagaacctgaaacaaaaggtaaaatatgtgctgctgccttaaatggaagcaactcataagtcatatttattttttgagacagggtctcgctctgtcacccaggctggagtgcagtggcacgaccatggttcattgcagcctcaaccgcctgggctcaagcgatcttcctgcctcagctcccaaagcaagattttcaaaatctactttgtttatcttggttccaactgagagaattgctatgtttgacagtttctcttgaccaagtgacaatcttaaataagttctaactaaattaacctgaaataaaataataaggaaattctgtttgggcatacataaaacatttaaatttaatataaatattataggttcgaatgtatcttcttttcaatttttcaattttttcaactgctttgatgttctgggaaaaaaaaatatacacaaaaccatgtatatagaggtacacagttttcttttgcctgaggcatctcgggcccctaagttccgcataagggatgctttgcagaactaagcatgattaatgtgaaaatcccccataaatccagagctcaggagagctcagcagagctcagatcatctgtgacacagtaactagtttcagcaacaggtcttgtaatttttaaatataggcttgaggaaacatataaagatttgctcttattctatcaaacctcaggggctccccagaaatagaatattaattaaataaggctaagtaaagtatcttcccttctatactctggaaacaagatcaaaatagaacaaatttaactgcatttggagagaaggcagatatggatgaactaaactcaggtatatatatttaaatttcattgtggttaattctattagtagccttcacaaagtttttactggaaaaaaaattaaactaaaattaattttaaaaattagcaaaactggtgactagtgtatcaagagcatggttgaagatctgtactagtctgaaaaaaaataaaatttcagtactgaaaaataattgtattgtttagctagatgttcatcttattgaatgacaaatctgccttcttcattctgggggagcattaggctttcttctaatttaaaggtatcacatttaacttaccaaatatcacatagatcatttcttttaatctttcaaagctcatcattaaaaatatcttttttcacaaacatggagtgttatgtgacagattataatttctgtttttcttttactaggatttttcatatcagaaagggtttcaggaaattttcagacaagaaatctaactttaccagtacaatgtaacagcaaagagtcctattgagtggcggtagctgttggcctcaataccctggaaattatgaagcattaactgcccctgcccccctcccccaacacacatactccattcaagaaagtctttccagccagatagttttagaaaaagcttatgtggaatagagaattccataatgaaaaattctaaaatgtgtgcatatatgccttctatggaaaggcattcaagatggagggagaatgtatcacattaccccttccttcctcacaccttcactatgattcacagcttctttataaatttgcagaatgttaatttgaagatgtttttatcaggccctctgtaaataatgaaaacaacactgtctgatcttcacctgtcataagtgctccatttgccagagacattaggagggaattaataaggactaaaaatgaggggaaaaatttcaccaaaggcttatgcccagggtgttagcttcatcatccagtggagagtttagagccatgtcagttcctctttgaagtggggtacctttatccctagcaatctgtcaaagggaggctttgtagaactgatggtgattaatgtgcacattcttcatgattccaaagctgctccagcagtggattcctttcccagtaccattgatataatccaagatggatgatacaatgctttcagttccaacagactggaacttatcagtcatatgattaagccaaggatgaagccaacacacatttgaaacctccacagttcttcttgctggggtagctcagcaaggtgctgggcgggccccatccggtgattgaaccggagttttccatttgtccccagaacaagttctgtgcttccggctgcagtgcaggcctgcccacagtaccctgccagcatgtttacgccctgacctggagggaccagctaagggtgagaatgtgactcgctctccatgcccatcccttgcttgtctggttagctgagattggccatgcatgctgtatgtagatggtcctggggtttgggggtctaacggggaaaccctccatgcatggaggcaaacccatgtagactggtgacctgtccacccaacctcaatccatgatgctctgagactggaaagagaagccaccaggcacttttggatgccaacttatgtcaactggcaactcattcacccaacattctgaacctcaatccatcaaactccaagacatacaaagagatgtcactatgtgcttttagactattcctcatctagtgaatcactgatcagagtaaaaatttcatgtaaatagatacatgagtattttaatgcctttatttgggaccctgaactcaaaactatcttcttagggttggattatcctagagtcaaatctgagagaaaacattgtggttgcttatctcatttttcggacatatccaaaagatggtatggttttctagatttgacactgagtgtcctgtggaaaatcactaaaacctcccctcctgggcccatttctccaccagtgttcagaaattagagtgctgccaattggaactggtttgtaggaaggtaatgcccactcaagaagctcccagagctgactcacaatgatgggttttagccaccatcaggcaccctggtcctggcagacaaccacttctctgacagttgtagcctgaaaggtagtttttctttcttttctcacttttatctctaggtttcagggtcagagaaatttcctttcctataaacttttaccatccacatttccactacactacacccggatttattcacaccctgtcttcttgcagaatttctggattataagaatttgttttttgatttgtgatttttatatggaaaatcttacagaactttatagattttacctgatttataaatttgacaagctgcttttacaatagcttccataaacttagaaatgtttcagaaactgggatagaatagaaagatttagaagtggaaaatggaaaatggacagacacaggaagcacaggtgtgtaatgaaggtatccacaatgactggatgcccagcccccattacaggagagacatgctctgaaaggccctcacaattctgcttccaagtctctggaaatttctccggactccagcctccattcagcaatcctactctctctctgttctgtgtctttacttccaattgtatcacctaagtgggtgtatgtgtatatgcatgtgtatatagttgcatttatgtgtatatgtaatatgtgtctgtgtatatgtgtacatgtctatgtcatatttgtgtgtgtgtatatgtgtttatgaatatgtatatgtgtgcatatgttgatgcatgtatatgtatgtgttcatatgttgatgcatgtatatgtatgtgtttatgtctgaatatgtatatgtatgtgcgtgtgtgttgggtatgtatgtatatgtgagtatgtgtatatatgttgatcctggatttgcttctgacagatataaaacaatagaatgacactatttttttaaaaaatctatgaactgcctatgttgttatgagagttctgaggagtgaataaaacagcttttttttttaatcggtgtgctttcatgtgagaagataattcttggacataggttcttaggcaaatttggctgccacttcctgacctctgctaagacaataaaatgatagggaaatattttaaacattttaaaaggctattaactctaagtaagaaagagcattttactactgatttgtaataatgttgaacactatctaccaaataaattctagaagaatcccaaccctaactgcctctgctgctagagagcatggtattcagcattcagtcagctccttgtttctttcactcaatcccagactcaggtcaggaaaaaggagagttgttaacagtagcttagtacagtgcctgccacataattaactctgtataaatattaacttttactctcctcacaggccaaggggatatttcacataagtatatttcccaaactgcttgccatgtgtactcacactgtatctcctcccatggctgggatacactggggggtggggaaactgtgaaaagaagacatcgtctctcattggatgccccctctgtctatgtccctggctgtgaccccagccatcccaaggaggttcagagcctgtgtctactatgagacacctcatctacctctacctccagggattcgcttcagccacccccactgtttcctccctgatggagggcccagctgtggtcactttgccggcttgacttaggagactgaaccagaagagcagagaacactacactggtacttcctacccccctttcacttcaaaatgttctgatccacaatgggactacactacattcagttgtctggatcctgcttaaggcagacagaggaggtccaggaatcggctgggatggggacacccttcctccttctcctaactgtggcctcagtcaccccaaggtcaggaccaccacattcactcccagggcagccaatgctgcagttttggctaccatctttggtttccctcctgatttggctcttagcagacctttagcccactgtcacatctacagattgagagaggaaaataaggtttggttattagaggttcccaaacatccccgtgcatcagaatcacctggagggattctttaaaaaatttgctggccccaccctgagtttcccttttaataggcagagctgactttcagggctgtgactccacactcagaagaagcccacatttggtttactgatttgcagtggccatcttgaaatgcttaacgctttttaaacacggggcatcacatgttcattttgcactgggctccacaaatggtgtagccagtcctgtcagtaggtccagaatggagctgtagaattggcattgccaacaagttcccaggtgagacagatgcagccaccctgggatgcacttcacaaccactcaatgagatcttgcagacctggaaaatcatcctcatagcagtcctctggctccttcccataagattacgtgatgagagttcaaagaggaggcaaggaaggggcttctttattccatgttggtaggaaatgtcctcagcaaaagggttcaggcccgtgtttgcctcagttacggctgtggcagtatcacagaagctgggatgtttttcccggcgatattaacccctgctggaaacctcagaggaagctagatccctgtgaatgcacttcctccagtttgcatgcacaaaaccatttggttaggaaagtgttgttcaggcatgtgtttaccttctttaagaaataaaaaggatttgttttgaaaaattaagccaaaagagagcaaagactagtaaagagaagtgaagtaagggggaaaagatgtaggttctggaacttttaatcaatctgtgattgtttcccttcaagatgttgtcagggccagttttgaggagggtagaaaagaaagatgtttccaggtaagacttcccatgctcttttcacgttgctcaagttctcatttttctgttccacatacattttcactgttatttctgtttctgtgacaactcatgaacacagaactatgataatggtatactaattagtacatcatatcagtttgtaaaagcactagtgccttgtagaatcattttagatgtatttgaataaaatggagtctagtgagggtcatatatttattgtttttgtcactactttatacatgaaacacttattcccaccggtggcatcaacatctttatcacatgaaggatggatttatttacactaagtacagtaagtattttggtgggatggaaaagttgtccagaaagccataatgaacttcaagcaaagtgtcaaccatagttttatctgaattatttttaatgcaggatattgaggaaagtgaaagagttatctactagtgtatccttacctaatagatagtgagcatcagactttcacttaaaaatggaagcaggaatgagtccctgaggcacttagcgatgcccattggcaaatgcagggctccttgtcggtttcattctcaccgtgccttctccatcattgccttttcctgttatatctgttgggttttactgccctctgctggtcatatcgttgaaaccctttcacgtcatggatgtacatgtcttggaacattgctcaaaatggtctttttgtttcagcccgtgtccacgcatactcctccagtcatttgtgtaatagccatattgtttaaatctggtcactacttgttaacaaactcacgcacctgtaattgtctcattgtgccagaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtc

SEQ ID NO: 3024 - DNA, 516178 bp, human
atgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgaggtagggaccagcgctgcgcgtcccacggcccaaggaggaggcccccaggcagtttcaggagaccgcctttaattccattacatttacagagcaaggcacccactaaggggtttccgtggtgtgggttttcctcttctacttgctaaatggtgcctggaaatgggatgtccctagtggccacccgcttgtgcgtcttgtaggacttgttggctctactttggagcagtcgtgggagctggagaaagagatggtgttctggttttctgttagtgctgcaggcaatttcaaagggtcaccttatcccttcacccaatgttgatattttttccaactcaaatatctattgctaagctgtttgtaacgattggatgaaatatattttgaaatatgtctgccatcttgttctgtagagaattcagaaacattattttggagggtgtcattgactgtatgagtgagtgtgtgtgtgtgtttgggtggcaggggggacaagaattctctagttttcaccttttctttccctgaaggggcaatttcagaaatctatggtactgagtattagtttaacctaggagaagaagaaaatctctgtgtaggggtgtgaaagatcatggaaatatgctgatgcctaaattccatttagaacaattagtagtttagtgaagaatcaacaatacataggggactcagagggagctatcagatacccttaaaatatttgctgtccagttaagaaaaatagtgaattgacctattgggaaactgtcactgatgggcgctttgaaaataacacactttcagagaatagtaattgttttaaaaatgaacagcccctatccccttcggtccacaaactctataggtttgccttggatctgtttccataagggaagggagattccatcagttgtaatttaatattttaaagtacagttagcattacagaaatgaaatgaaataccatgtaattgctggagatttaggctaaatacacaaccaaggaaaaccgtttgaaaatagcatctgagatcatactcagctgtgttaatgtgagataactgttagactttggctttagtaaaccgccttagaaaaataagcatcatttatcagaattattagcatcacatattattaatgttagttactgtgtcaaagtaactgaggctgttaggtgttgggggtgcagattacaaaaaactaacaaattttgctaggtcttttgcccattttcttgagaaagataggcagtagaaaggaaagtcgaggcagagggcaagatgttacctccaaaccagggaactcaagattagaaagagcatcaaaaattgaaatgttgaatttctcttggtctttaggaggggctggattctcattgtatttcagaagcacacattatcagattaatctgtacaagttgagagaaagagaaatacaaaagcaagccagcattttggattagctagctaacattcgtgcttaaaactaattgcatcattaagaacatttctgcttttcttagcaaccatatacatacttggaatatagtatacagatgctgctcattactgttatgaccaaaaggcatgtggctgtagatgatttcacttgttgcaaattatcttcttatccattagcatctcataattaatggacaaggatctgaactgcagtgatactgggtggcttctattccatacagtgggcagtctgcacaaaactcatctaccatgatttttaccttttcatggtggttaaaactaaggatgtagccatctagcaaaaagccagaattttctcatagaatatgtgtgtatgtgtgtgtgtgtgtgttggaaattcctttatgcttgaggcaggcatggagtgattggatagaactctagcatgtagctccaaccctggttttgtttaataaaggccaagatatcctaacataacccttggatctctaatttaatggcctggattacctttcaaaggtttaacgccctggaaccctctgaaaaaccaagaaaatgtatcctattgggcactgcctgtccttttcacttgcaggcaagctgagtctttggtccttaaaggagagtctttactaatgacatcaaaatgtcagccaatgagcatcttgcaaggctgcttagaggccctggagggaatatctggttcatatagatttggttcttgaacttttctggttgctctggctcagggtttctcagccttggcactattgacatttgaagctgaatgattctttgctacagagctgtcctgggtattgcggggtatttagcagcacccctggcctcttcccactagatgcgagtagcactcctccagaccagtgtgacaacaaacaatgtctctagacactgctgaatatcctctggggatcaaaatcgccctaactgagaactgctgcgttagtgaggttgcccatagtaccccatgctggccatcaagagagtgcccacagaagtgtttacagctggcctaaactttgttggcgccttcgtttgattccaaaaccacgaggatccctctggagtcatgtaccccttacagtctgttcaaattttctatttctcttccattgaatccatatgaaatcctaagaattcaccttcaggtttagccattgatggatctcatccatttcccactttgttctttcagaatcttgtctgcttttaacgtaaattgtccatacaacagcccctgctcccaagactctcacaaatgcctgcagctttgttacttgtgctcgttcaaagcttacaaatgaccattttatggcctaaacctgggaagtgttaggcaaagtcagctacgatcttgttagcatttcctcactacgtgtttcaggattgctttaacaaaatctgattcctggacatgctgggtagatcatctattgagtagaaacatggaggagacaaagggtaaatggtacgtggtaacacagttggaacgtgtttctcaacttgtgttcttagcagccaagctctgcccctgactctgatcacaggcaaaggaataaagtctcatttcaatcctgagcttctcctaattcttgtggatcagagctgggattatgtccatagctaacctggagtttgccaacttttgcaacccataattaaaatgatttctatatatcactggcgtctatacttttcttcattcatggcacaagcatttcttgagcatacgcatttctgtaggtactaggaatgcagagaggctaaagagctcatagtctaatgaggggacaggtgagttaactgatagggggaatacagaagatcagcagaatgagggaacagagaggggcgggtgatgattcactgtgctttggggggccttgaaaggcttcactgtccagagaacatttaaacttgatcttcaaagatgactgccatttctaaggagaagaaggaaagtgatgccttcatgaggcagaaaagagtggacaggcaaaggcgcagaggtgttggtgattctacagctcccaaaaaagaagacttagagggccctaagcgcaataatttgtttggaggagcaggttagggcacctgcagtttgatacacgtacaaccacatggcttttcatgtaataaaagcctgaccgaataaagtcagaaatcagacctgttgggttttttttttttttttttttttttttttttttttttttttttttttttgagagagagagagtctcaccctgttgcccaggctagagtgcggtggcacgatctcagctcaatgcaacctcccatgttcaagcgattctcctgcctcagcctccccagtagctgcgactacaggcatgcaccagtagagactgggtttcactatgttggccaggctggtcttgaactcctggcctcaagccatctgcctgcctcaccctcccaaagtgctaggattacaggcatgagccaccacacccagcctctactggggggataattatgggtatgaacaaaaatgagagactggtcaaagcacattactctccaaggagcccctgggcatcacaactgcagagagtgaaggcatattgagtgttgcccaagtgaagtttggggtgcctggagaagaggatgtatcttgctgtgtgcaggataatagtgttcaacaggtaggatagtggtaattacgaagcgtctcactgtgctcatctcaggagtttggacttgtgtagagcagtgattcttaacctggaggtgactttgtccccaggggacatttggcagtgtctgaagacacaactggaagtggtggtgtattaatttcctatcactgctgtaatgaccacaaacttagtggcttcaagcaacacaaatttattgtcttacagttctggacctcagaaatcccaacaggtttcactgggctaacttcaaggtgttggcctgactgtgttccttctgaaggctctaggatctgttgtggttccttttccagtggcccccttccttcattttcaaagccagccaagttgcatctcatccactcttcttgtgtggtcatttctctctctcgctcttttcgggactcttgtgattacattgggctcacctggataatccaggataatctcattattttaatgtcagctgattagtgacttttaattccacctgaaaccttaagttccctttgctatgaggtattcacatgttttagggattggggcgtgggcatttttggtggtatattattctgtctaccacaggggagttcctaccggcatctagtgggaggccagggatgcttcttttaaataccctgcagtgcacagccccacaaggaataatcatctggcagtcaatgttaggagtgtggagactgagaaactctgctgtagagagtgggagaaattggtgatttttaagcatgaggtgtaacatgatcagatgtgttttagaggtaaactggtgtctgggggagcatgggttagaagcataaaacaagtggaggacagatcctcagaggaggtgggcatggggaaatcatgccaagcatgcatcctataaataactgggagttggcatataaacataatacttttatatttcccacttctctgttttagtaaagtttttcttgctctgttgaactccttgaaagcagaactgttactcatctttgaattcttaaaatctggcccctgtactctgggggttttagagagatcatcataaagaccagtggttctcaaccaggagaaagtttgtaccacagtgtacttttggcaatgcctggcagcatttttgattgccagaactggggcaggagtgtgctactggcgtctagtgggtataggccaaaggtactggtaaacatcccacaacacacacaacagcccccacaaacaaatacttatcttacataaaatgtcaatagtgctgaggttgagacgccctgtatacaagaaactgaattccaggttttgcttttcagtaccattttctctcatgcttgtggctttactctttgtcattttcctcttcttatctagtatatgtcaaccaaggctttgaaattcaaaaaaatgactttctatgggtattgagcatatgaaaaaaaataagggatttctaaatatatctatagggaagaagtgaatggtaaatatataatgatggaaactggaattaaattttaaaatgcagcagagaaaaatattgtgtttaaaaatagaggctcattcatgtcaccaaagagaaagtaattagaataagacagcttcaaaaagaaattgacaaaaagtgttttacaaggatttttgtctgaaatcagtataatgccttaaggtttttttaagttaggaaaaagagttattcaactttcacacatacactctctctcaggctatctctctgctagaattccttctgaaggcaatttttaattttaatggagaatactgtgaagatagcttctcagatgacttagaattgagttttcaccaacattttgagatttgagggttgggaagagcaaagtttagactcagaaagaaccttgggtagcatctagctccaaattgcttattttacagttgaagagagggactgtaaagcttaagccactcaaactcaggcaaagagccaagggcagaaccaccctgaaatccttcttgactctctatataaactgccaagcttctggaaaaagtaagtgaccacgactgcttttattctctggtgagcaccttaaaccttggcaatcagtttttatcctgattacgtactgaaactattctctcaaagttccctaagttccaagaatcttcttagactcctttggctagacttctgggcaaaactgagagtaccacgtcccctccctgctcctcctatccccatcacacacagagaatcttggtttcctccttacctttcttcccactcctctgactctgggattgtcttggccaaccctacagttctgtgtttttccttcaggtcattgtccctcctattgtctcattcacttttgtgacttcaaccatcatccctctgggggagactcctcactctgtgcctacctggaatcttgtagttgagctcccaatatatattttctgatttcttcctagatatctgctcatggatgcccaatggactcaaattctacatgtttgaaacagaacaaatcacctcccatttcctctgaacatgtttcattttatgtattccttattttggttggtatcgctcttcttctgcttgcctaggtttaccaggccagaatgcctttactcctcccttttttgtttcctcctttattcttccataagttttcgaacgctgcagtgtgtacttcccatttgctccactctagaaaggatttgaagtggagtgtgtctgagttcttacatctctctccagctgttcattcacaatgtcactgcctagtttgggttctcatttgctgtgacccccttcttggtcaccctgccttcagtttctccttgttgccatcttggacttatcctcaaaagatgcaattgtaatcatgttaacccctgattgaaaacctttgatgggtctcagagtgtacagaataaaatccaaactacttagctagtcatttcaatgccttttacaacatcatctcagcctgccttctcccaggaactctagtccagcaaagccaagctggccactcacacagatagtcatcaaatatttatcgcatgccagctatgcaatggacactaggaatgtaggtggagcaaataggtatggctctgcaaggtgcttccagtttatgaaagcagtaacttcaaatcaattaatctctatagttttttcagagtgttaattgcattttgacgagaggactgtggtagacagaacaatgtcccccaaagatgttcatgtcctaatatctagaacctgtgaatatgccactttacatggcaaaagaggattttgcagatgcgagattatcgtggattgtctgggtggggccaatgtcatcacaaggatccttataagagggaggcaggaaggtcagagtcagataaggagatatgaggatgaaagtaggcagagagagagaaagagggagagcggaaaggagggagggatagggcaatgagagagattttgaagatgctacacttctggctttgaagatggaggaagcagccacagcccttggctgtagcagcccctagaagctggaaaaggcaaagaaatggattcttagaaccttcaggaggaatatagctctactgacatcttgatcctagctcagtgagacttctgaccttgaggactgtaagagaatatgtcagttgttttatgctacaaaatttgtggtaatttcgagcagcgataggaaactgatacaaggcataaacaggtctgggatgtctcagctgaaatcattggatgaggaggcatttgccaaacaaaaagaaagggcacagagctcctgcgagaaggaatggcgtgtatttaagagggaacatagcatgcttcaagaatttagagaaatccaactagaatggattatgggattgggaagatggtgaagaataagtctcgctggactttgggcttaatgatatggattttaccatttaatgtaaagattccccacatagattttgtttcctctccttctcactttacttttgataacttggtcccatatctacctgagaaggctccatttgtactttatggctcagccaggtgcctccaaataaatgagcttgactctggtacatgtcatgacacattcaggatttgcagaaacagaagctcatgttttcatagtgagattcacattcttccaatctggtgcttgaaaaagagaaagtgtgtttcatatcaaaatctagtcaatgactgagggagtctgcatgcagatagcagttctcccagattcccagaggcttgcctttggggcgtgacatcttgttctaaaatttactgcatcctctctgagccattacttagataaagagagtgagactgtgattgtaactatgttacgacatggcagaaaaacccttggaatgtaatgtgtgaaaaaatgaaattagttgtgttatctggtaaagaacgatgttttcattagctattagggaaacgtgaatcaaaactacaatgagatatcatttatacccactaagatggccataataaaaaaagatagataataacaagtgttgacaagatgtagaaaaatcggaactctcatacactgctggtgagaatgtaacatgacgcagcagctttgggaaacagtttggcaattcctcaaaaataaaacagttactccagagctcagcaattctacttctgggtatatacctaagagaaatgaagatgtatgtccacaccaaaacatgtatatgaatgttatagcagcagtattcataatagccaaatggtagaaacaattaaatattcatcaacggatagatgaatggttaaacaaaatgtgattaatgaaaaattactcaacaataaaaaggaatgaagtactgatgaatgctatgccttggatgaattttgaaaacattatgctaagtgaaagaagctagtcacaaaggtccacatattgtataattctatttatatgaaatgtctagaataggcaaatccatagagacaaaaagattacttgttgtcagaggctggtagggagggatgtggagcgacagctaatgggtataaggtttcttcttagggtaatgaaaatgttctggaattagatacaggtgatggttgcacaatcttgtgaatatatttaaaaaatcactgaattgtatactttaaaagggtgaattatatggtctgtgaattttacctaaaaatgatatttataattttcagaaaatatgttgttgccacatcttgttttcaataaaacataaatataaatgtagaagagtagttatatagtcagttgaagcttcatgtattcaacatgaaactagggaggtagtaacggctctgggagattgaacagagtcgtcggcagccagccatgggattttctgagattggttactgtggaaattcgatgtcctgattattgcactttgaaagcaagcacagagaagctattaaaagattgctttttcagagaggcagagattttaaaaactacttacaatcttgaaaaattgcctggccttatctcacctgaactattaaaaagcctaagattttcaggagccgttagaagtaacagtaattctagaaaccacctatcgaatgatatgctgatggatccaagaggagaatgctgagcctgagaagctctcctcatctttagagaaattggaagtgaattgaattatgtggcttgatggaccaagaaaataacatgttttcatttctgtagaagtggacagctcatggaaataggtgaattaataccacctataggagctgaagtgtcaataagcattggatcagttctcagcttgtattgctcataacttcatctctcaggggtttgaaaaacaattgggcaagctggtactttgaggcccagatatagatggagtaggggaaagagaagccttaggcaacaatagccatgctgcctcagcgtttaatataacaagggctttgatatagctagtaattttgtccagggaaatcctggactgggccagcagactttctgagcaaagtgtaattctgctcaaattagaacctccaggtgatttcttgttcacttatttcagtcaaataatcgttgatgggtgaggatgatgatgatggtgacaaacaaaataacaattagtatttgtagaatgcacgccagtttagtgttcttagaacaactctgtggggtgatagtatcaaccttcattttatgagtgaggacactgagactcagattcagaggtaggcagatttagctgcagagaaaatgaagtgaatcggttcagctagactctgaaccagactgcctaggtttaaatcccagctctgttttgtgacattaaacaaattattaagccccttttttgccttagtttcttcatctatcaaatgagaatgatgaaagtgcctacctcaaagagtttttgtgaggatttcatgtcataattacctggaaagtgcccagcacgtaggaagtactaaaagatgcataggagtgcaaggctaaataacattagagatgtggtcacacactaggaagcaacaaaggtaagacctaagctaaagaattactttagtcaaaaatagttatcgtgcacctactatgtgtgccagaaactttggtcagtgagttaagcccagctgcatgagacaacagcaggaaacaagtggaactttattttgcgagctgttaaataaggtatagttttcatggtaggcattggagtgacagcaggctgtcactccaggcattttggcctagtgacttggaacacaggaatttgtcagacttgtattgtggatttggtgtaacccaagacatgccaataggccaaggggctgccttcattccagtacatggtaacttcattgcatttagacactttttagtagaatatttagaatgttggaaactgaaaagttcttagtcgagccctgttctttaactggtaaatggcagtgtgcttctcatttcaagccaggtgtgtttttatttccacatactacagtgattacatgagaccaagttgactgcttttcaaggcccatctcattcaacatctttccagggtaaaaacgcagcagcactaagttaagacaatcctatctacaatcagattctctttttgctcaaaatctaaatgtaaactccattagcatttctagactgattttagcattctacgagcaaatagaatattaggaagaaaaagtccttgaaggtcttctgtctattccaaacatccatgtcgtgcttaaatcccatctatgacacccccagtctatgcctagctatcacccacaaacagagaccttcatggttctgcctttagattataatagacataaaaattctccatggaactgtgttcacaaccagtctccctgaaactttcatcatgttacagacaaattctgcctctctggttttccagaaaatcactaatactgaattattattgttgctagggaagtacgggttggcctagcttgctttctgagcatcaacacaaaagtttgggtcatattttctttctggcagatgagaattgtgaatatatccaactacaactggaaaatattttaaacgaaagttaaactcttgcccccaaaggtattttgcaaactgcttatagaaactaggtttaggcagggaatcctttacccattgcttgtttttgttgggtttgttgaaggattccctattcagtaaatggtgctaggataactggctagtcaatatgcagaagattgcaactggaccctttcctttcaccatatacaaaaattaacttgggatggattaaagacttaaatgtaaaaccgaacactgtaaaaaccgtggaggacaactgaagcaataccattcagaacataggcatgggcaaagatttcatgacaaagacaaaaccaattgcaacaaaagcaaaaattgacaaatgggatctaattaaactaatgagctgcacagcaaaagaaactatcaacacagtaaacagcctacagaataggagaaaatttttgcaatatatgcatctgacaaagttctaatattcagcatctataaggaacttaaacacatttacaagataagaagcaacgctattaaaaagtgggcaaaggatatgaacagacacttttcaaaagaaggcataaatgtggccaacaatcctatgaaaaaagctcaacatcactgatgattagagaaatgcaaatcaaaaccacaatgagataccatctcatactagtcagaatggctactattaaaaagtaaaaaaataacagatgctggcgaggttgtggagaaaaaggaatgcttatacactgctggtgggagtgtaaattagttgaaccactgtggaagacagtggggtgattcaaagacctaaagacagaattaccatctaaccccagcaatcccattactcggtatatacccaaaggagtataagtctttcttttataaagatacatgcacatccctgttcattgcagcaccattcacaatagcaaagacatggaatcaacctaaacgactgtcaatgatagactggataaagaaaatgtggtacatacacaccatggaatactctgcagtcataaaagagaatgagatcatgtcctttgcaggaacatggatagagctggagaccattatccttagcaaactcacacaggaacagaaaaccaaataccatcatgttctcacttataagtgggagccaaattatgggaactcatggacacaaagaagggaacaacagacactggggcctacctgagggtgagcagtgggaggagggagaggatcaggaaaaataactaatgagtactaggcttaatacctgggtgatgaaataatctgtatagctaaacccccgtgacacaagtttacccatgtaacaaacttgcacatgtaccccaaacctaaaataaaagttaaagaacctaggattagtactcacagtctctagattcccgctgctgatgcaatgagtcaggtttctgcatttcatgatttataagagagctcaaagacagatacagttttcatatcatatcagagtgttactctagatatttcagcaagtcctcaaggaggtgtgttgaatctggcttctaatgttttaatatattgtcaataaatgatattgtcagaatgtgtcaaaatgctgagaaagtaaacatgaaaggtgatatgaagattatccacaggcttgaaggtcacaaagtgtgatatgaatcccagaccagctccagacactccaaggcatgagctcagcaaatatattgttgttctgctgcaatggcaatattttaatcttctaatttatgattgaattgtaaatatattactttttctcatgtagctgaaagtgtatggtgaaagataggtatagtgttatggaagtaatcaaatatttaggtttttgttcagggttctttagctgaaattagttattcagagttacaagtttaaaaaatgtgaaatagttcattttctttgagctattctgttttggtgctccctggggagagccggatgcaggagagtcaatggatcttgattgtctagtttgcctttcctcatcaagaaatagccttttttacagaaaatgtttaaaatcctactgtgtattttactctccttatgaggttatcatttctaatttatataaagatatagtagatgctgcttatataaatgttcattgactgaatctaaaaccaatctaaaaataaagttattttttaaaaagttcattgaataagaaagttgaatgattgggccaggtgcagtgactcacacctgtaatccccttgaaagcaggctgaggcaggaagatcacttgaggccagaagtttgagaccagcctgggtaacatagtgagaccccatatctacaaaggaattttaaaaattaaccaggtgtggtggtgggtgcttatagtcccagctacttgggaggctgaggcaagaggattgcataggcccaggagttcaaggttgcagtgaaccatgatcgtgccattgcactccagcctgggcaacagagtgtgactctgtcttaggaaaaaaaaaaaaaaaaaagaaaagaaagttgaatggtcaagaagaaaattaacaatatatttgcaaagattccttccaattaattaattaaatgtttctatgcaatatttttataatgcagaaagttgattttttcattttatttaaaaagacttcttacagagttttagatcacactctattagtataatttccctgtctatatgtacatacatgtaacttttaacttaataactgctttataataaaaaatgaaaggttggctattaccatatataattggagcaatgtggttacattatttttatgaaaatacaagtttttaaaactttgtgaagaaaagataagagtggcaaaagctctgtttcttagtctgagttttcccaaaggcaggatctgggtgaaagcagtttatttgggaggtgctctcaggaaggagtaatgaagaaaaagggataatgaaatggggaaggaggggaagtaaagctgtatcttggaagttgtaattgtggaaaaagggatgattcaagttccaccaggactgctggaaaatgtgtagaatgtctatcgagatgatctacccatgttttagttctctattgctgcataacaaaccacctccaaacttagtggcatgattctgtgggtcaggaattagatcacagctcagctgggtagttctttggctctgcatggcattggctgggctcgctcacttggctgcttccagctggtgtctgggatgcctggaaagttcaaggtgtcttcattcacatgtgtggtgcctcagtgatcctccatgtggcccttctctctccaactgactagtttgggcttcttcactgaatgttggtctaatggtatttgatcagagtgagtcacagggccagcccagattctagggcaagggaaaaagagtctaccccttgatggaagaagtgacaaagaatttgtggtcttctttaatctgccacgagctaaaggaagggaagctggagaatgtctctgttggtttccatcttccattttttaagattgcttctggggttttaacttccacatgcttcttacatatgatgaggtgtgcactagagatgaatcactagcagcacacaacgtcagtccgagcttgcacagaactgcccagcacagttgtagcagaactcaaaaactttagcacaggctcatgggaagtagcatttagaatcagtcacccacaatcttagctactcaaaaacataactgaaggacaatatgatcttagacaagcctaggatcaaatctcagtgccactatttattaggtgtgaatttcagttttctcagttgtttaaggggagtataacagtatgtactttgtaggagcttgtgaaatgaattggttgagggtacacaagctataaggggtcatgtagaagtatttattgtttattactttaattcgttctcaaatgttataggaaggtgtacatcaattttataatgcttcagcgggaagaggaaaggcaacaatactatggtaaatgtaaagagcaattgtaagatgcaactttaggttttttaaactgtagggaaaataagtagtagttgaagaattatgatacaatgtagtttatcctctacattcatgggaactaagaaacaaactttggcaacaggtttattactggggcaatcttggtaatgtttttaattaatactttaacaaaacttataattgatacataacagttgtacatatttatggggtacagtgtgatatttcaatgcatgtatacattgtataatgatcaaatcagggtaattactctgtctaccactgtagacatttattatttgtggagataacattctataccttctagctatcttgaaatgtacactttattgttattaggtatagttaccctactgtacaatagaacatcagaacttatttttcctgtctaactgtaactttgaaatacttttaactgaaatatagaacttacttggatttttatcagtttttccgctaatatccttttcctgcttcaggacctgattgatgcagaatctcacattacatcaggttggcaaggcttcttggtctcctccaatctgtctttatttatttttcgtgagcttgccacttttgaaaagtattggtcaggtattttgtagaatgtccctcggtttcagtttgtctgattttgcatgattagaatgggatacttggaagaatacataaaacatcatttgaacaccaagtgtcactgtttatctatgttagtaaaatacaatgtttcttttattgatgatgcttttcacccaatcagcccacattctcctgtcctgtctgcctggtagcatggccatatgcgtgttgataagatgcaatactgaaggctgtgctgagggactgaagaaagccaccttataacagtgacctcattagcagccaactgacttcattggcccttcagctggattctctttctctgtaatttggattcgcctgcccttttttttccattacatgggaagctctctggcaggctattgctttgtctgtccttattgccgcctcggggcatcaacagcatgtctttgggtgctgcatttgttaatgtgggaggctaagagaaatccaagatgaaaatactccttgtcattcccctgtcagaagggggaggaagagctaagctttgagtacatattcatttacatcagcagcattcttctgtgctcattggttgcttacttctctcttattaacagtgctagaataaacacacaaatctaccaaaatattagcagtgtgtgctgttttctttcacttgccaggattgttttataataaataccattggaaaaaataccactggcaagcatcctcagcaattacgttaacatctctagagaacaaagtatggtatcggaaggtgctttgcaaagaggagcagaacgtgtctggtttatactgcattccttgaatatactgatcttgttacctatgagtttgattttaacttaggtatttctcttgattgacaaaaattgatgccatcattttgtatgatattcactaattaaatatattttggaagacaaatataaaggttcctttaaaatgaagtgacactaaaacagatgttcataatgtgctttcatggtaggaatttgtagattaaatcagatattcatgtttgtcaaaatattttagtcaaatggaagaaatgagttttctcaacaattttgtttgtttggcttatgtcatgtcttagtttatttcaactatcatttctatcctttagaggtaaaaattgttatttctctccccagttgaaccctagttccatatttctgtttgcaaacaaaatgtttctacttgttgattccaccatcacttcaaactctaaatatttaaaataattaccaaccctttcccccaacaaaggaaaagtaaatacatgaatatacaaaccgcaaccagttctttctctaaaccttcctgttttcttctgtgataaccatttttgtaaccttggaatcttgaacacatttcttattgttcctcagcgtttatattctgtattgaaatgacccccaagacttgtctcctgttctaggcaatgttcctatttagccttttctctctgttccaccgggcatggcccttgtctctcatgctgggtgatatggtttggctctgtgtctccatttacatctcattttgatttttaatcctcatgtgtcgagggagggagagacctgtaatacccatgggtattacatggagagaggtggttggatcatggaggtgatttcccctatgctgttctcatgttagcgagtgagttttcaagagacctgatggttttataagtgtgtggaagttcctccttcgcttttctctttcctgccaccatgcaaagaaggtccttgcttcccctttgccttccaccatgattgttagtttcctgaggcctcccagccatgtggaactgtgagtcaaacctcacagcaatgtgaaaacagtttaatacactggaccttctaactactttcctggatgatgggttaaccttgttttaatccatgctttcctcttccttaagcattaataacatcatttaataataattaacaacatcatttaatttcgttatgaagtccctgttacaatcaagacaaaatctcatctgtcatatagacccttcctaccatcatcagccccttgcccatccttttctagtaggtcttctttgttcctactcctctccttctcctctttcctaattccaagcttcttctttgcagtcttcaacaaccttattcaaatttcacagtcatctctttggctctaaaagccaacgagggagagcacccaaggactttatttgaaagtttagagacaaataactttatttgaaactttatttgaaagtttagagacaaataaaatacgtatgtttgtctaatttctgagacaatgacttaaaataaaaccattttccatgtaaactgtgatagcatctttggggttgggcaatcatgaattgctgagaaccttggtagccacttcatattgttgaattatagtttctcttttttagaaatgaagtaacgtttcccccagaagctactgtggatgagatgtttggagcattgagtagtccatattaatataagggatagcaaaaaaaatgattttttttcttttggagtataattctatggattttagtacatgcataaatttgtgtagccactgccacaatcagaatacagaacagtttcagtgtccccaaaaaactgtcttgaatgattgctttatcattcctaacctgcccctactggcaaccactgatctgttctccatcactatagtcttgtctgtttaagaatttcatagaaattgaattgtacagtatttagccttttgagactggcttcttttgctcaatataatgtctttgtgatttgtccaacttgttgcattatcaatagtttgttcttttttattgctgagtagtaagttccatgatatggatgtccaagtttgtttttccattcacccgtcaaagtaaatttggcttgttttcaatttgagggcaattagtatggctataaatgtttatttacaagtttttatgtagatacaagttttaatttctctagagtaaattccaggagtaggattgctgtgtcatatagtgagtgtatggttaactttatgagaaactatcaaactattttccagggtggttgtaccattttcattcccatcaacaatatatgagagtttcagttgctctgcatccttaccagcacttggtattattagtagtttctatttttttcactttaataggtggtatctttaatgagtggtatcttgtcatggttctgcttggaatttccctaacagttgatgatgctgaccatattttcatgtacttattggccatccttatatcctctttggtgaagggtctgttcaagacctttgcccattttttaaaaatcaggtagatttaatttttgtaagaaaattcttcctagatttctctaggtaagaacataatgaaggcatctattttctagcaagggtggctagaagcagaagtttttagcttttacaggcagcagtggcagcaaagttgagtttctgatgagagtggcatccatctggtaacagtgtggttgtagtaacatttaggtttgggaggcaacataaattatagcatctggagcttgaagatggccaaattcagttaaattaccagatcagctccattatgtggttttgaaaatttttctcggaagcttggttctgggcctctccatgatccccttagctagctgcccaatatcttcacaactccatttttcattaggtggagttagcttctaagaacctaaagtacaacattgaattacctactgcaccagttatctatgaccacgataaagttgtataacagacaaccacaacacttggtttcatgcaacaatggatagttaattttgcacatggatctgtaggtttgtgtagtctggttgatgtggaaagagtgtggcggatctctactgggtttgctcatgcatatgcggtcagctagcatgttgttggggataattcatgctgatccctatggcctcattctccagcaggctagctcagatttgtactcatggtggaagcagagttgtaagagaggaagaagatgctccaagcctcttgaggcataggctagaaactatgcactgtcacttgtgctatcttctattggtcaggctacatggcagcccaaattcaagggattgggccatagactctatctattaatggaaatttcttccacaatgtaagggattgattctgtaatcaatctcctttatatataaatggtttggaattttgaaatgagtgcagtataaaaagagaacccagaaaaatacatcaaaatattataatatctctgagtgaatttaaatcctcttttgcatttttgtactttaggttttctaaaataaacagatattacttggtgtaagttaaacaatagttgtaaaaaatttataaagtgttttggaaacaaagaagagggagtgattaattctggcgttagaaaggtgctaacattttttcccaaattgcaagaattgtaaatagtagtccttcagggagtaaacttgtccagaatttttttggcataaaatattaaatacactatttgtagatgggaacctctgacttttaccaaacctttggatattttagacttatttttttacaatagctttgtgctaagaagaaagactgtagaagggaagacaaggctctggtgttatcctcttaaatttggaagactggaatcatgcaggggaaaggactctatagtatgaacttttgtgtgtgtttgatgttgagtagacagcttggtggtggatctatggatggggcaatggctatagaaaacagcttttcttcctcaatgccttctgacaaatctcaaatgagttgttcacaaaaacaaaagcagggaaatgctacaggagaacccatattaagtagatttcagttatacccattatttcctttattgttttaaaaaaaacagctttattgagatttaattcacctaacatataattcacccatttaattttaggacatttttatcacccccaagaagaaaccttgtgcccattaagcagtcattctccactgttccttgccctcagtttctgtctaatctactttctatctctgtggatcttccagttgtggatatttcataaaatggaattatacaatatgtgaccttttgtgtctagtttattttacttagcaaaatgttttcaagattcatccatgttcatgttatagtatgtatctgaacttcattcctttgtatgactgaatgatattccattgtgtggatagaccacatcttattgatccattcatcagttaatggatagttaggttgtttccactttttggttattatgaataatactgctatgaacattcttgtgcaagtctttgtgtagatacatgttttcagttctcttgggtatatatgtagcattggaatttctgagtccattgaggcttaaacaaatttattgcttaggcacgtttggcaaatatgatagttgatttttctaggaatatatattttttggcctaaacacagtgaatataggacatgttatgagtaatcattctaggagagttcctcaaaagcagagctgtagatacgtttaagtgatggcacccaagttggaataggtctccagcatctgtagctaagtattttgaagtgattgtgcaaattctgtggattgtttccaagatgtactacatctattaaaaattaaatcttatagttaatattcaatatatgatgtattgcatatacttggtatcagcatgcattcaaacgtgaattgaaaaagagaaaatggatccgtacttatggtctgaaagaagtaaaagaaagggtaaaatcggtctgtcaagcaatgtagaaaaactctggatgtttgctatctttttaaatggtatttttttttccatggggagaaaacacatgatgagaaaagaagagaaagcaagtgatgatgatatgattgataattaaatgcagctgagcagaaacaacgtggacacgcttagaatttgctttagtactttctatgcttccttcccgggaggctgttaaaactcttcagcataagagcatttaaacaaagagaatattgccttttttccttctactgcatctattcaaacatgcagaatgtatgtcttggtgaaatgctccaaagatagcttgtggaaatatttataatgcgtgtaccagcatttttcacataatttaaatacatgcttttaaactgtttattcttctctgaagttttgcaatatctatatgaccaaatttattgcatcatctgctaacttgaccgagctgttaatgtgtgatgcgaccttcttcaggttgaaagtgacagtttagcatatcacaaagaaaaggttatccttaaatgttgagactttgagatactagccaccgttgtcaatatgccaagtcccaggctacttgctgctcatacttaaggacaagataagtgtctttggaaaacattttctcccatttgggccatctttttggaaccagaaattgctctgcttctatgcaagggaagagaattttgctctctccattccctgtatcattttggcaaatccttgttactgttaattcagggggactgccaatttgaaggatgtggtgaatgtcaaagtaagaggccatatttgccccatgtttctcctgaggcagaatataatttttacattgtgatcctttgtgaaatcagataactaaggaccactggttccaaagacaagtcttctccctatatttttttcccacttactagtccagaaaaaaaaaatgggttactcaatctctgtgccagcaagtatttgttaaacacccatgcccctgtcacttacacaggcttgtgatgtaaaactgccttaaccttcatacagcttaccattctaggtaggtaggacacagggaaatttacagaataacacatcaatattaaactgggataaaactatataaggatgcctgccaattccatatatatttagataagggagaatttgggatgactgagagttaacaaagaagacctcacagatgggggtactttgagctgcctctggaggtagacagaacagaatgtcaatatatgaattggagactcttctgggtgtttgaggttggggaagaaacaaacaatgcctccaggagagaagcagcctaaacagcaactccaaggaagatgggtatgaaattcaccgtgtgtgtgaaattatgacaggagtcccagttataggataaagcagcaaaaccagaaagcaagtgtttagacatttgagcaaacctcttattttcttatctgtgtttgccccgtcacataatttacagtagaaagttatttaaggcgaggcagcactgttcttcatcagacttgcatttatgtattcaattttggaaacactatgacttttggaagcaaagaaacagagttaggctgaacgcccaactccagtgtacgagaatttttcttcaactcactgaataaatgagtattttggggtttttgtaatgttcagatgggaggcaaaatgcagacacaagcctagaaaataatgcagatgccaagttgatgtgttcttgagcaatggacattgaatcaacaaatagcctgatgagagagcagtgagggtgaagtagggagtggaatattcatgtttcctttcccggggcactgttcttacatctcctttacattttgttagatttaaaactaaggaatcagaagctgataaaaaattactgtaagagaacacattgaataaaagagtggtgagaggattcattcctctattaacatcagcagtcatctaaacatgtactttttttctggcacaaaatcatagctgtagcatgaccttcttgcttactaaagatcacttaaaatttttaacaaaaaatggcttaagcttgaaaggaggcttttaaaatgttaagtatggttctgatctacttttaaaaatccaatggttaaggccaggggcattggggttagaagttggtggggggtcaggagcaggttggtgattatctttctctctctttctctctctttttctccatgtctctgtccctttcaatctctctttttctttcaatctttctcaatcccccatctctcttaatttatctatttctttttctctcacagatatatactgtaaagtatataacaaaaatgaagtcccatgataatttgttgctaaaccacagtgcagctgtctaatcaagaaggcatatttttttgtggcacatatacaccatggaatactctgcaaccataaaaaaggatgagttcacttcctttgcaggaacatggatgcagctggaaaccatcattctcagcaaactatcacaaggacagaaaaccaaacactgcatgttctcgctcataggtgagaattgaacaatgagacaacttggaaacagggaagggaacatcacataccggggcatgtcgggtggtggggggctgggggagggatagcattaggagatatacctaatgtaaatgacaagttgatgggtgcagcaaaccaacatgacacacgtatacctatgtaacaaacctgcacattgtgcacatgtaccctagaacttaaagtacaataaaaaaataaggcataattgtaaaataatttatactcttttcataatctgccccaatgtcccttgtttcagacttatgttttttcccttgtttcagacttatgttttttctcccttccattcctactgccttgtcactttcttaccctttcacattccttagactctgggtttaaattcctgatttttggcagtcagaaatcccttcaaatgaggctgtcaatccatgcttcttgtagcctccaattttcagattagctaaattataaactttcccatttacaagtgtggcattcctccgcagcctaatgtttatctaaaaatggtgttcattatccattaggtcttattcactctaatttataaatttagtagtttgaccacttttactagtgaatacacttatttaaaaatactttttacatttaatttttgtggatacatagtaggtgtatatatttatggggtacataagatgttttgacatgactttgtatttaatagtcttgggctatatataatttttcttttatctgctagaaattactatcttcttcctttgggttggggactaaaacttgcatttaatatggaggggtggtaataatttggccctgttttctctgtatgcttgttgactccttgttcttaggacacatactgggaagaattatttttgcaactgaaaacaagtagagattttaatagggggtatagaatgaatttcagatgacagtaatcactaaaagtgtctaaacagttcaaattagttgtgtgtcttgtggacaactcatctaaatacctgaagtttggttatttgcacatagaacctgaacactatttcaagcttcaggttttaacgtgtgctgacttgtaaacaactttcaaaaatttaaggcaggcaagttcacctcaggccactgaattttcattgcttctgtgtatatttttcagcgttacccttgttcttttttgactttgtcattttcttcagtccaactgaaaatgttagtcagaatttattttacattagagtatatattcctagatgctaaatccctgagaacaaccttttctacccacttttgtttcttctggtgatacctatttacattttgctttcaaagggtgcccaaccactggatgccatacttgtgttattagctatctctatctgcctaagcctctggtttgcttcctcttgggaattaaaaataagatttctcttgatttcattgaaaaatcatcattctttcagctttgaccatattgttttgataaaaacagctgatttgtattattgaacatctttctcatttttctttctccataaggagaaattcatcacgatttattacctgaacatttgtgaaaccaatttgagagaatcccaaaagaatcattttaattgaagccacctaattacttgtaattaagaagacttaaaatgccaaaaaaaaaaaatcaaaattacagctaacaaattcagaggataggataaaatcaattactgaaaaatccaattaggtttggggagaagctgaacagaattttatttaaacccagtaaaatgtctttgagcttttcacatggacccatttgagttcaaactctttattattaagagttaattttatctttgttttctggtagtgtagtaggtttgaataggagctcttgaataggagtgcaaataattaggttaatggtttttcttttcatacgttattagaggaataatacaggaggaatgaaaatgaaagcaaaatttagaataaaactttaaaaagtttatgaattgttaaagctaactgttggactcccagcagtggctgggaaaatggtaggattttatgccaaatattattattgttgccttttgccagagtttagtggaattgccctgaacatcaacttggccatttcaactctcttatgtttgaggtctgctgccagtagtcagaccatgataaaaacccatgacatgctaagtaatggatgctgggcaataaggatctttctaaaaatggctcttaaaaaaatcatcatcttgcaactgtaaatggcctgtttgttaatagattatttttctcctttcagtcaagattttctgcgtaagtttacagcctataagtttataaataaagtactacattgaagcaacatttttattagtaggtatttcaacttggatgttgtgagggccttttaatttcactttgcacaaagtgaaattgtagaaatattttaaacaaattgatcatggcctaaaattttctgcaacatatttggttgactgaagttattgttaaatttggcctgaccaaaatttgaatttcatattttatggttaccagtgtactctttgtaacaagttgtgcttctcttgtgatgacaagaattctgaaagatggttgatttagtacttcgagtttcacattatactgaaaaatgtggatgcccacctgagccttgatctgatgaccagggaaacagcagcactttttcaaaatcttaattgattttaaacaagcaaatcatttaattctgtgagccttacactctgtttcttaaaagaaaactggagaagaaaccctatctcaatccttgtccttgagaatcctagaaaatccacataacccttttccccaagtcattggagaccttttttcatcctacaaactctagataggcttgttaccgggaagctttaggagccttcctagtacctactgtagtatcttgctagctctacagtaaagaaagaaaataatatgaaaaagtgctctgatttatagcccatatctctaattggctattagtctgcgctgacagtaaaaatattaaaacaaattacccttttaagttaaattcacacccaatgaatgaacaaataatctgaatgaacaagcattctcttgttgatggtgatagtaattattatctgttgagcaggttgacttaatttagtgaacataaatggcctctacttagggtgttcatataatttgttgtcaaaattgtagcattttggaaagtgaaaagaggcgctattaataattacactaaaataacaggcataacctgaattgtccctgttaaccctcacctggaatgtattgttctccttccttccatgtgtagtcaagtgctacccacttttgacggcccagatgaagttttctctaagaaggctctttagagtactttgtttatattttacctgaattaaggcattgaggtgccagcatgtcagaaattaagatgttttatatatttcaaggaaacaattgttgctgttatttgacatgtatttgttctctcttaccaagtagaatgcaaccttcttgagcacaagggatatgtcctatccttctgtcttgctgaagcacttaggtatattgcaacgcccaaagtgaagagagaacacattcttgctgagttgctttaccttcatagtaacattcctctctatgtttgtgaataaaataatggatattggtgccaaaaatgctggttatttaaagagatttcttctgggtttataatcttatacagtagaaagggataagaatcaagccaaatatagttaattatggcctgagtacccatttagtcacccgatgtttgaaagtgtccactcagatttagacattttaacaacaaccagacctttactagcagtactttatcatagaaaggatcatttgagaatatcttaattgtagcattctgagcaaaattataattaaattttactaagtatttattaaaaatataaagtggatatttttctaattataaaagtaatatatgctcattttaaaaaaatctcatagaatacaaaaaaatgtagaaacaaaaccaaaaaccactcataatcctttattatagagataattacttggactatttgggtatgtttccttgaagtagtcttttgtgttatttatatactatacagtgatccttgccttctggcattcacagccttgtgtaatcccctccgtataacttgcttataaccaataagagatgacaactttgggaggacatcacttacatgatgaggtcacaaaagattgtgaagtttgacttgctagccggttctatcttgctggatttgatgaagtaagctgtcatactggagaggtccacatgacaaaaaactgagagtggcctctggctaacagccagcaaggaactgatttctcagtctcataactcttaaggaattgaatcctgccaatgaccatgtgggtgagcttgaatgtgaatccttctccagttgagcctccagatgaaacccccacttcagtgacaccttgatcatggctttgtgaaagtctgagcagaggactcagctaagctgtgcctggattcttgacccacaaaatctttgagattacaaatgtgtgtggtttaagctgctaagattgaagtactttattacatagcaataggtaactaatataattacagagtgtctcatttatagtttaatagcatttttacttaacattttcttattaaaaatctcctgtgtcattaaaaattactgaaaatatgatttttcttttccaggtggaaaagaatcacatagtaaggatatgccaaattttaattattcttatctaattggatatttagattatttctaattactggctactatgactaccactaaagtgaacatcctcatacatccatctttcactacaatgactacatatcttattatcccaacaaaattcattgccataagataaatgatccaaaaggtatgcataattttaaggatttaggaatattgctaaattaccttccagaaagttaggctattaaaatgcctctgagtatttcaatgtaccttggccagcactgaatggttaaacaaattagtcaacttgagaaagagtatctctttgtgattttaatttttattttattatgtcttcatatgattattagttaaagcttattaagaatttaaataaaaataattaccagcctgggcaacataggcagaccccatctctacaaaaaattaaagaaaaatcagctgggcatggtggtgcacacctgcagtcccaaacctttgggagcctgggagacagagtgagaccctgtctcaaaaaaaaaaaaaaaaatagccaagcacatggcttaaaccactcaatccataagtaaatatacacataggagaatgcttttcagtgaacatttatcaagtgctccttatttgttttacaaatattaacttatttgatcctcacaacaactctgagtcaggtaccactataaatgctgttttacagaaaataggcaaaaagcaacttactgagagcagcacagctagcacagagctgggagctggagacaggcatgcccttgactgatatgtaatagacacccccatttcaaacaaaaagccacatccattcaccaaattccaaaggaggcatcaattccttcattatagatcagaaaaatgaagctcaatgcatcttgtctagtgaatggttcaaggttgtgcagcttgtcagtactgtgatttagaactcaaatgctagtctgtccagacgccttccacttccacatttcctatgaggaataagcacacaaagcaggtgctcagtaaatataggttgattgaactccaacaggctacatgcaatatgaaagggtgatggaatgtcagtgaattggaaacagtgggtatagtggagtgatgctaaaaatgacccatcatggcaggtcacaggaggtctcccagtggctcagtccctcagaagaaggtatggagaagtaatgggggaggtagagagaaacaaaaggtaagtttaaagagatcctactcataggcaagcttatgactgtttctgcaaaggcattcatggcactgggacagggagggtgtattgacacacagccaatactataagggaaaaggtaaaacaaaaaccaaggcatgtttgtccaggtagccgtagctgttaccagcagcatttagacaattgcatatgttttaggttgtattctccacaaagcagacagagctaagggtttgagtgctagtgatttgtagggaagagctttagaaagaagccagaacagtagtggagtaggaaggggaagaagccaagcaagggtgtagttttgggtggagtcccagggtcagcctagatcccacggggtgcttgggagggtaaattatacctcagagtttgttccaccatgaggcaaaggctctgggcattggtactcacacaccagtcaatggctaagtgtctcaggcacttctggcatgtgtgagctggcttcagcacaaaggggacaggtgccagtcactagcagcaaagcccacaaaagccaagggatggacacacaaagttagtaaaagggatcttagaagatgtggtggctaccagcagtgcccattacagcatgttttaaactacatatggcagggcatccacttaaatacatgtatttgtgagaactggaaatttctaatttgacaattctaatttcctcagttcctgctgggtcttaatgtaccagacagaagtagaaattatattatgttctttacactgtgaccattcatgcggaatctgtgggagttataattacgtcaattaaagctgcaatttgctaaaggaaaataaagaatagaacaaataattccaagtctctaacttagaggattagtgttcaaatcaaattggagctttgcaaatgttaatagttaagctatgtttaaggtatttcaattctctacccataaaggcaggttttaataaagtcacataaatggtaaccccaaaggctttctagcagcaggatggcaagttgttatgtattattgggaaatgaagtatatttaatacctttccaattgtcatcactctaaaacacacttcaacaattgattaagctgaaaccagaagaaaattatttccccttacttttgttttcttaatctaatgtctttgctagaaaatgtagatattagctaatctgtgtctggcagcaaatacctgcatgttttaagtattcacaaatttcactaatagagtagcttaacaatagttcttcatttctaggtgaaatattaaatattatattcttaactcttactgtcagattaggagaacatttacatcatatttaaggcaaatattcctgagtccttaaagcactctagctgggtatttaaaaaccaccttctgtagaccaggggtcagtaaactatggcccatgagcccaattcagcctttcatacatgcatttttgtacatcctgtgagcaaagaatgctttttatatttttaatggtggaaaaaatcaaaacaatattttatgacatgaaaatgacatgaaattcaaatttcaaggtccaaataaagctttattgggacatagctacacccattttatttacatattgtctgtggcagctttggcgcttttatagcagatttgagtagctgtgacagacactggatggctatcaaagcctaaaatagtttttatttgatcctttacagaaaatgtttgctgctccctgctgtagacttttgtgcctccctttgcccgtagtttgtgatctcttaaaataacattggaacacttagaacttggggagtcgtgctatggagacactggaaataaagtccattttactttttttttttttagacggagttttgctcttgttgcccaggctggagtataatcacgtgatcttggctcactgcaacctctgctccccaggttcaagcaattctcctacctctggcctcccaagtagctaggattacaggcgcctgccaccacgcctggctaatttttgtatttttagtagagatgaggtttcaccatgttggccaggctggtcttgaactccagacctcaggtgatccacccggctcggcctcccagaatgcttggattatgggcatgagccactgtgcccagcccattttacctttttgagggaagagttgattattttgatgagcattttacttaaagacatatggctacaacacagacattgcacaagatcttttatctatgcatatttgaaatgattgtagatttccaggggcctgaattatctgaactattatctctgttccatttacatgagtgacatgtcctttggcatagagacaatcatcaactctcttcaatttaccttgtcccagcattttaaaaaaaacagtgcctggccaggcagccaagcggccgctttcattgttactccatcccatcctctcgataatcctacaaataaattttatttttcaattttagcgatgaggaaatcggacaaaaaaggtgatgctattcatattaacattgcatacttaatcaaaggtcgcttcaggatccacactttgattcatctaacttcaaagctttgctcagagtattttgtcttattgccagtcaaaggaagaatgtcgttaacattggtcagaaatcttttcctaaatcattgattattctctacccctactcattctccgcctgtccaggtaactatctgcattcatctgcttttctgtctgtccatccatccatccatccatccatcctttcattcatcattaactcaaacatcaaatgtttattgagtacatgccagccatcttgctaactgcactaggcagtagacatacatttgtgaacagaagagacatggtccccaccctcatagcatctttttgacctgacagaactgcacagaggatggattttatttgtccacagatttatagggcccaggcatctatatcataagtgggatttgatgtctatatgtttcataatctgcccttttggaaatcatttgacttggacctcttggatgtcttgcttttacaagtagcctaaatagtgtattgaagaggttataatcagatttttaaattgaagggtggaaaacatatgacactgcatcttttctttttaactgaatgtaacgctttacataaacatttccctcagagctactaaacacatgccaaattctactaacaactttctatctatctatcatatatatatatttggtaatacatttttgttgatcctatcccaaaagctttccacccattgcttgtcactttgagacaacagaaactggcaggaggtaattaatagacttgacctgtagggtgaatacacacacacacacacacactagttgggggagcttcgattcttttcaaaggactttgctggtgagacttgaaagtgccatatgcctgctgggagaagttttgttttggtagtagttactggttaggctttggaaatttttcttttggaaatctggctggttctcaaaaattgcctttaagaattgtattttgtaagttaagagcagaagctattattagctgtgtgtttgtggttgaaacatgaggtcaggtttggcagggaactcttaagggtgtgtgaatgcgagcctcagcccagccatcctgtggccactcagtgccttggggagcggcttattcctggatacagaggcaatgcctttgtcttacaattcgtgggagtatgtgctttaataatggaatgcttcctttgtgatttaagagtgacttatagtaaatttttattaaggattcaatgtcctattgagaatatatatatgaatatatataatatttatattcataattgctttattagatcagggatcatgtttgtcttgtttatcattttattccatgttccaagtgcagtgcttggcatacattataaatatcaatatttgttaatgaatgaatgcataaatgaatgagtgaaaaatgaccacaaagagcacatgtagaaagattaaagacatatgttaaattgaaggatagaagttggtagtcagagaacatttgtaggtcaagcacttccaagtgatggcagatatctaagatggggtgaccacactcatgaattgcaaatacagaattctctggacctaagagaactgtggaactgtgaggtaattgtatgctctgatgttgaagccactaaaggtaatggcagatgaaggtggtggagatggaggaaagtaggcaggttccctcctttcctagctgtctcttggaatgaactaagtaattttgtatagatgtgtaaagatagtaaagatagaagatctgtaagactcgagctctagctcgtgtatacacacacacacacacacacacacacacacacacacgtatctgaagcatggggatgatcatatgacagtaataataattaaacacttactgtaagcagatgaccaaaattagctgtggttggacattatggaatgattagtacacataattattttctgctaataacaagacaggaagtatttatacccacatgaaatatttaagcagggagaaaacaattccagttttgccaaacgtttcttatatccattttgtggaaaagactccgtactagggaaaaggagttgatctgttcattgctcacttgctttcacgtagcagatttttagcgacacttagatggtgagctctggaggaaatggctattattattctagttcacagcagtacctaaaattgtgaatggttagaatctcttcatgctctgatgacccaactagctgtagagtatcacagaaagaaatgttgtcttgctaccatttgcacgtatgcaaaatatgcagagaatatagctgttttaaaagaaagctttgtaaaaagaaactagtaagctttcaataagaaatcctttaaatcctcagcattacacaataatacaattccctctttacagattcacttatacctttactgaatcagaagatgatgttgggggaaaagttgcttttcaaatgtaaccataatagaattttccctgtatctttcaaataattgtctgtgaaatcactttgtgatgtctatttcagaagcttagccatgacagcacaatcataaatattttcctctatgtcaaccattttagatgacagacagatctatctagtacattttgttttcttctaaaatctcaaatactacccaagtcagctgtttttaaagctgtggcctaataaacaattggatattgaattgctttattgcaaataaaaatgcctcatctttgtttcaacttattctcaaattaccagtgacattcacttttatattacattgttaatgaaagtttacctgtgggtctaaaaatagagacaaaaagcagtgaattgactggaaaactaaccattagggatattaattttttggaaacagtagttttattctgaatagtgtacactacctgaaggcttgaaggttgcatataccagtctctgaactccatagtggaaatgatgtctaccatagcaatcatcacttaatgagaaattactacttattacgccaggtactgagtgaattagattagtaattgcattttatctctcattaatctcatgtaaataatgttaattctccactttacagatgaggaaactgaggaccagagattagataatatgctcaaaatcacacaataagggcaaagctaagacttgaagccagatgtgggttcctaatcactttgacctaattactgggagaagcataataataaagacaatttattgtgacctgtgtattatgtattaatgactaaacagcatttttgcatgtttaaaaaaatctctgtaagtggtattatttgataggcattattctgcaacatattttctttactcagcatagttctaattatccattttaattgttatataatattccattttatgagtataatatcaattattttatctcttttcctattgatgaacagagtattcttcaaaattttcttggctattcttcaacacttcttcatttacataagttctatggtatgcttatctagttcctgattaatcatgttggaatattgtgtggaattgttttgcatttgtatattaatttaggaaaattggcacacatatgatattgagacttcatgtcatgaaatggtatatctctccatttactaaagtaatattatatgttattagcaatattttaaaactttttcaacataccctgtatgaattttcttgcatgtattcctaggaaccttaggattatcattgattttttttgtatggtatgtttactttctaatttgttattactctgatatagcaagggcattgattgaatgttgatcttgattaaacaaccttgctgaattatctaacttgttctaatagtttttctatgaatttctgagattttctttggaatatcatcatatttttgccagtatgggctgttttatctctttctttccaattcttagacatcttaactcctttatttttgttttgttttatttacattgattgtggccttcagaaaagtttggagggaaagtggtgatctaacatcttgtcttagattttaaaataatgtctatcaagttaaaaattgggagttctttaatttttgttaagagtttttaaaataatgagtaatgaattttatggattttttggtaaatacaatgagatgcagatataggttttcatgtgtaagttactaatgtggtgttttcatttttagatttgcttttccattgaaccatccttgcattcctgatgtacattttatgatgcattaagaaatacctgctatattttcttccagactttaacatctgtgttcattgtcaggtagttctcatattttaattttttatacagtccttatcaaattagtataaagaacattttagcttctttcagagaattgggtaatttttttccattttctgaaatagtctgtacagatcataaaaccctgtgagcctggatatcattttcaaggcagacttcaaattgacaattgaatttctctgatggttatttatttgttctggttttatgttttctcttgagtagtttttgtaatttatatgtttcttgaaaattatccattttatccaagttttgaaatttattatattacattcatattattctgatttaagattttattgtatttgtattttttgaattcttaatattgtgtatatgtatattttattttggcatatctgacttacaggttgccattttactagtttgtcagtaaaaaaactagcttttgcttttacatatattttattacatcttgttttatatttcatcaatttttgcttttctcttattctgttttttcatggtattttattttatttatttgtgaaaatgtgttgagaatatattatagaccaggcactgtttagagatttggcatacacttagtacaaaatttcagtagttattggaaacttaatgactcttttgtaatttttttcatttttcattttcatggatacatcacagttgtatatatttacggggtacatgtgatattttgttacaagcatacaatgtgtaatgatcaaatctgggtaattgggatatccatcacctcaaacatttgtcatttatttgtgttgggaacatttcaaatcttctcttttacctattttgaaatatataacaaattactgttaactatatttgtcctattacagaatacctgatcttattccttctatctaactttatttttgtatttattagccgagccctcttcattcctccccactacccttcccagcctctggtaaccaccattctattcactgtctccatgagatacacctttttagctcccacatatgagtgagaacgtgaagtatttttctgtgcttgacttacttcactaacataatgtcctccagttatatctgtattgcttcaagtgacaagatttcagtcctttttatgactgaataatattctattaaacacacacacacgtaaacatatatacatatacacacacacacacacacacacactccacattttctttatccatcaatccattgatggatactatatcttgactattgtgaatagtgctgtaaaaaacatgggaatgcagatatatctttgacagatgcattttctttcttttggatgtatatccagcaatagaattgctggatcatatggtgttacagttctatttttagtttttgaaaattcatattgttttccataatggctatactaatttacattaccaccaacagtatactagcattgccttttctccacattccatccgcatttgttattttctgtcttttggatataagccattttaatttggttgatacgatatcatattgtgggtttgatttgcatttccctgatgattagtgatgttgagtattttttcatatacctgttggccaattttatgtatccttttgagaaattcagatctttggccaggcatggtggctcatgcctgtaatcccagcactttgggaggctgaggcgggtggatcacgaggtcaggagatcgagaccatcctggctaacgcggtgaaaccccgtctctactaaaaatacaaaaaattagccaggcgtggtggtgggtgcctgtagtcccagctactcaggaggctgaggcaggagaatggcatgaacccgggaggcggaagttgcagtgagcactccggcctgggcgacaaagcgagactccgtctcaaaaaaaagaaaaaaagaaattcagatcttttgcccatttaaaaattggatgattattatttgctattgagttgtttgagttccttatatattcaggttgttaacgtcagatgaatagttgacaaatatttcctcccattctgtatgttttctctttactttcttgattgtttcctttccactgcagaagctttttagcttgatgttatctgatttgtcaatttttgctttggttgcctgagtttttgaggtcttactcaagaaatctttgcccagaccagtgtcctgaagcatttgccctgttgttttcttctagtagtttcatactttcgggtcataggtttaagtctttaattcattttgattttatttttgcatatgatgagagataggggtctagtttcattcttctgcatatggatattcagttttcctagcatcatttgtggaaaagactgtcctttccccattgtatgtttttgtacctttgtgtaaagtgagtaggctataaagtgtggatttatttcagggctctctattttgttccattggtctgtgtctatttttatgccagtaccatgccgcttggttgctatagctttgcaatatattttgaagtcaagtagtgtgatgcctctagatttatactttttggtcaggattgctttggctattctgttttctattgtggttgcatacaaattttaggatttcctatttctgtgaagaatgtcattggtattttgatagggattgcattgaatccgtaaatcactttgggtaagatggatatttttacaatattaattattgcaatttatgaacataggatatctttccaatattttatgtcttttatgtcctcttcaattttttttttttttttttttgagaccgagtctcactccgtcgcccaggctggagtgcagtggcgcgatctcggctcactgcaagctccgcctcccgggttcacgccattctcctgcctcagcctcctgagtagctgggactacaggtgcccgccgccatgcccggctaatatttgtattttttttttttagtagagacggggtttcaccgtgttggccaggatggtctcgatctcctgacctcatgatccacctacctcagcctcccaaagtgcttggattacaggcatcctcttcagttttttaaaatcagtgtttcatagtttttattgcacagatcttttgctttttggttaagtttattcctaggtattttttggtagctattataaatagctttcttgatttcttttttgagattgtttgctgttggcatctagaaatgctactaatttttgtatgtggattttgtatactacaactttactgaatctgtttatcaactctaacatttttttggcagagtctttaggatttttttaaagagtctttaggttttcctaaatacatgattatattgtctgcaaacaaggacaatttgacttattcctttccaatttagatgtcctttatttattttcctcgtcttattgctctggctatgacatccagcactatgttgaataaaagtggtgaaagtgggcatccttctttttccagatctcatcttttgcaattttatcagcaaatggtaaaggtaacatagaacatggttctttgacttataaatattaagattttacttaggttgttgataattactatatttttgttccatggtctttattgaatatatactactaaaaacttggcatagagccattaaaaaaatacaaaatgttttcttggaaacagcaaaatttctaatccatatacacatttcaaggttaatattttatacttgtgactactagatcatttatgctaaatagtacagcttaaagataccataatgataaccttttagattaaccaacatctttgatctaggatcaaggaaatttgatttccctcaatcccttatttttcagattaagcagttaaagtaatcagtcatttttgtgacacagcagggtccaggttacaatagttctccccattttttatggttctagacccttctcctacctatcttcccccaaccccctggtttggtaactatttctctgaacagtctttctgtttctttggtacatttttttccatgtataattgatttattctggtcatttacaattcctattaaattctctaaatgcttttccttgcccaaatttattattcatctcttcacttgaaagtagaattttctttcatagtgaaattaaaagcaatatattaaagtgggaagtatgaggtaaaatattagaacaactaaactcaagggcatttggcatttctgagagtgaagcagcttacataccacagcaatgtcacttgtttttcattgatgagacacacaaaattgtttcctttgtcctatgcctttcccttgaattcacatatctttttgctgaaatgaatcctttcatagttcttttaatgagtgcctgtgggtgttaaacagtcttaatgttttatattttgtaatatcattattttaacattgcatgatggtttctctgggagtagaattttatattggcagttatttttcctcatcactttaaaaggcattgcttcaggttcttctaccatttgttgttcatgatcagaaatctgtgtgtatgatagtaacttcttcacaggtcaaactgtattttgtctctgctaaattttaagactgatattttgcagtttgactaaaatgtgtctaggtgtaggacttatttgtatttatgtttctgaatactcatagggtactttcaactgaggattctcatttttttctgattctggaaaactcttggatattaatgttcaaataccgttcttcattaaaaaaaaatctctaaacataagttctaaattttaagtaagcctttgaagctagaggctctcaaaccatctgccctgattcttaaatgctcctttacaagttttgattactttttctctttttgctggcttctgggtaaattttttggtatcaaaatctaattcactaaaacacttaccagctgcctcaaatctaaagtttatcctatcttttgaatttttccttttaaaacaccattttttttcaaatcttatttatattcacctattcttatctcctttctgcctgattttgtgtcataatttgtttgatttttatacatgtgatttcatctatcttcctgagtattttaaacatgcttgttttgaagtctttgtcaagctattttataaaattaatttcaccacagtaaactcatattctggatattgatatattggctgtcttcttcagtgttatatttcttcacatgttttgggattttgattcacaggctaattttgagtgaattttttgtttgtgttcttctgtctcttgctctctgttcatgtatgtccgttctctctctctcacccactttctctctctgtatgagcttctttttgtggctggtatttttcagttgatgtccaccggggtccccaggacaaaaccacattttaggtgatggtttggagctcctgccctatagtaaaataatgcagagccagtctccaggccaggagcagcttgtttcagatctttgtctagacagaggctgtgttgacgtcttttaaatctgtaggtttttaggttttaacttcatataaaccaggttttctcagtagggcactgttgacattttggaccggatgattctttgttgtgtagagctgtcctttgcattgtagaatgtttagaaacatccccagcctctactcactaaatgcaactagtgccaacttccctccagttatgaccaccaaaaatgtctccagacattggccaaatgtcctctggggaagaaagtcactgactcccccttgataaccggtggtaaaacctgtaaaccctggagtcaattggcaatgtctgatgttagcttcctttatcaaggaaagggtgccaaatccagtccagctttaagcctaaagcctggcttcagcctttcatagtaagtagaggacttttcgtctcccattggaaagagatttctctgtctcactgcctgatttggggctcagcacccatcaggctttggcttcaaccacactcactattactggtcctgaggatgtatatcttaatttatattctggcattgtcttttcagtattcttttgttatatttcacttatcacaattgcatgtttcgagcaatggggacaccatatagcatgaacttaaaattctttcttaaccagaagtcatagaaggaagtttttcaaaaaaagtttgtttttttaattgcacttcttggtagttcaacattttagatgccttattaccttatgccctgacttgattatgcttttgcttcttctttatttgtgattaacaaaagcctccataaacctgctttatttgtagtcaaattctatatttggagtattgatcagactaataaaaattagatatttttgaatgatttctacagatatctctatgactttgtgtatgacctcattggaattgagcacaggcattgcatttgggaaattaagacaattaggagattgtcctacaaagtcagagcaaaggaagcctgtagttagttataatacagagggacagtgaagactgtgagggagaggagggcagcaggaggcttagaccttgctggaaaatcctcaggaatgaagtgaaatgtagccaatttggaacctaccccagccctttccctccatgttaaagttagttaaatcaattccagtgcctatttatagttaagccttggttttgattaatgatgttggagagagataggaaagcggggaggacaactgttaggaggaagggaggaggcaaagctgctgaggctgatatgctcatctgttgtttgaaccctactctttgtcacacacagatttctggccaaatatgataaaaaaatatttttgttagagggcagtaatccatgtcaacattttcactgtatgccaagtgaagaaatcaaatacctaaaccctgaattaaccatatgataaatcatggttccctttttcattgagtcatccagcatgcatcatcatggacacaacctaagacttaaatgtctttagaagttatgcttttatacattaacaaaaatgaaattattaaaacaaacccacattaatggttaagcatagattgcttttgagctgcaaagagctttagagacacacaactggtccaacatttaatattgtctggagaaaaccaagatttgagagtcctaaggacttgcttaaagctgcacaatatcttggttgcagaacagggactagatcccttgtcttccctccaatccaaagatctggttacttctgcccaaaagataatcaattttaattttggtagctagccataaatacttttctggttgacttattctctgcttttaatgttggaaatagatgaaagtttatagttctcataaattagcttcagttactaaggagattagtgtattattaatccctcctattttttcaaaaaaacttttactaaaacccactttccttgaaaactgatattttctaaagatttagctctccagctatgcactcaaacagaggattgtgaatggggattgtctgcattaaaaaaaaaatcctttctttcttgttaatcatgaatttaaatattatagaaaggtagagggacatacagtgactatgctcctccttccacttaggtggctatgtaaaatgtcttttccttgatatatgtaattgttgtttactcacagtaattttatgtcagaatctcaacagcatgggttgggtaatgactatccatttgtttatctacaggaaaatggtattgtgtatgaagcaagttcattatataggacaattgaatttttatttcataactttatcttctttttctctttagtgatttctctttgtggccccatgcatattgtgcagattaattaatcatgcatgagctcggtacaatctacaatgattcactgggtaaagcagttttagggaatgcattgtattataaatgtggaaatgggatagacacctagaatatatcagctatcagtgaatgtccttaatcatagtcatatagatttctacttactaaaatgaagtcatatattttggtagaatccttcattttgaaggaaagctgacatgcaacgtaatttatctgtgtatgtgtataaagctgtattaatttcctgttgctgctgttacaaattactgcaaacttagtggcttggaacagcacaaatttgttatcttacagttctggagatcagatgtctaaaatggatttcactgggctaaagctaaggtgtttgcagtacttcgtttattctggagggtctagggaagaagttgttccactgtctattccagcttctattacagaagctgcctgcattccttagtttgtggccccttcctccattttcaaagccagcagtataacttcttctattttctctctgacaatgcttctgttatcacatttccttcttgctctcctgcctccctctttcccttataaatactcttgtgattattgtgaaaccctaaggagtaaaaagaaaattagaaaatgggcttacctggcaggaacagaaatagataaggggagcaaatgttttgagaaatggggtcaaccacaaaaggctcactggcacccatagcatcctgttacgagcattcagctcatggcccacctgcattcaagcattctgtctgcaagcattcagctcaagcagcacgaccttataaaactccccttccagcccctgactctgcagatagcagacagccttctttctgctgtcttgcaatgtatctccccttctcctctaaataaatctgcctttctaaactcattactatcttggtaaattcctttaccaccagtgcactggcttcagataatcatcaaccatgacaattatattgagcctacctagataatccaggattatccctcatttcaaggtccttaacttaatcacatcttcagagttgcttttgccatgtaaagtaacacaatcaaaggtttagtggaaatctttggcagggggttattttgcctatcacaaatgcgtatgaaattgggagactattttgaaatagcctgtactcatgctactttgcatgatgaatatgacacatactatttaaactatgtattttctatagcagcaatctctatagcaccaatggtcatagaaatataatgtaagctacaaatgcaagccacatctggaaattcaaatgttctagtagacatatttaaaacataggtgaaattcatgttaattatatattttatttaattcagtagatccaaaatattatatcaacatgcagtcaatataaaaatatcaatgagctattgatattctttgttttatactgtcttcaaaacccagaatgtattttacacctacagcatatctccatatggattagacacatttcatgtgctcaatagctgcatgtggttcatggctctaactttggaaagcacaactctgtagccaaggtttttatagctccacacccatttaagagttatattgtctactcaaaagaatgtgatatgatggctaagacattgaataagacccgggtttctcaacactggcagtattgacattctagaccaggtagtttttggttgtgggaagctgtcctttgtattgtgggatgtttagcaatatctctggcctctaccactagattccaggagcaaccctccagttgtgacaaccaaaaaagtctccaaatattgccaaatgtcccctgggtggcaaaattgtgcctagctgagaactactaggctaaacatagaaagtgtgttagtctgttttgtgttgctatgaaggaatgcttgaggcttggtagtttattaagaaaagaggttggctgggcggagttgctcacacctgtaatcctagcactttgcgaggctgaggtaggcagatcacttgaggtcagcagtttgaaactagcctggccaacatggtgaaaacccgtctgtactaaaaatacaaaaaaattagctgggcatggtggtgggcacctgtaatcccagctacttgggaggctgaggcagaagaattgcttgaactgggaggtagaggttgcagtgagctgagatcacaccattgcactccagcatgggcaacagaacaagactccatctcaagaaaaaaagaaaaagaaaaaagaggtttatttggctcatggttctgcaggctgtacaagaagcatggcactggcatctgcttggttactggcaagggcttttgtgctgtgccaaaacattttggagagggtcaaaggaggaatcagtcacttgggaagggggaccaaacccagggtatactagttataacaatccattcttgccagaaataatccattcccttgagaactaatctgctgtcactagagtgagaacagcaccaagccattcatgaggaacctgcccccatgtcccaggcacctctctctacgcttctcctccaacactgctacactgtgggccaaatttcaacatgagatttggcagggataaagaaactatatccaagccatagcagaagggttgggtttgaattctgttctccatacattactgtgaccttgaaagaggagccactttaaattgttaacatagtttcatcctctttacaatgggaaaagtattatctaggctgcttgagcctcaaaagagacagtgtagataaaacagctctgtaaactgtagatactctgtaagacaaactcagcattgtctttatttgtttatgttcagcacttgaatgtaagtacagctatttcagtactgatgtattttctcataatatttaacttattttttaatgccctatttataatgattggactacagtgtagacaagatgttttaggtgttttgttttcctgtctgtgggtgctcatgggagtacagaaataagtagaactgggtcttttcaatgagttgatcaaatttgaaataactgggagttgttctgtggccttctcagctctgatagggtacacctgcctaaggaacttgcagagatattctgcaaattactttgtttgacccaacaattattgaacacccattcctgttaggaatagtgctagttcctgggagtagaaaaaagaatgagacaagattctatccctcagagtgcttgcaagagtagtaggagaaaaggcatagacattaatggaaagtatttggatggaagtggtgcttggaaaagagtcaggagaatgcaaagagaaggttgcaaaatgacgtttacaggaaggtcagagaaaggcctgagaaaggtgcagaatgaaaaagtgcatggactggtttgacattttgggaaatggagcatagcatgaaggaaagagagagaaaaggagaacataggagtatagtctccctaagaaaggtgggtccccttttgcaaaggccaattcttgggagaaggagtaagctaggagttcttagcaactgggaatgggtccaccagcagtaagggtctgtggcagcaccacagcatccactataggctctaatgtgtctccaccttttttttttcattattgccccctcaaggaagctttttaaaacattttttctctaatctccccagcctccacccatgaaatttacatagcacagatatcctatttatctgtttgtgttgtgtatttctgtgctttatacataaaaataatacgttttcttcgcctctcccagtaatcgatttttacccccttggtggcgatattgcctagttgagaatacatgtgctacgtttgtcactcatgagctgtgttattggctttggttcccttgactcaaaaatgttttaacagtcattctgtgtttcagggtgatatggtttagctctgtgtctacactgaaatctcatgttgaattgttaatccccagtgttagaggaggggcctggtggaaagcgattggatcatgggggcagatttcccccttgctgttctcatgacagtgagtgagttctcatgagatctggttgtttgaaagtgtgtagcagttccccccttggttctctctctcctgctctagccatgtagaacgtgcctcttcctcttcaccttcctccatgaatggtaagtttcctgaggcctcctcagccatgcttcctgtacaggctgtggaactgtgagctaattaaacctcttttctctgtaaattacccagtctcaggtagttctttatagcaacctgagaacggactaatacacaggggctacactgaaacaatccctttctcaacacttgggggagaaggctggagtaagagtttctgagaggtataggggtgtgatcctgcttgtgtgccacatgtctgcccagcaggtccttgaggatagagttggggtggaagtggctaggtgggccgtggaaaaggtcctatttactgaatttgccatatagagaagtgggtggtgcccgcacagggaccatttgtgccagtggtctgggagccctggatgtggtgccatgatggtctgcagaccaaaacccttcctggttcctgccaagggttcttggcctcatctggagttattgggaaaaggcccagctaaaagtaaagtacaaccttgttttctgttttgctgtttttctttgtacatgtaactcttccaggaacctgtgggcaggggacagagggtgaatacagtcaggatttagcccaaagctatcaaacagcaccaaccattgactcttcctaagagtgtgagtccattttctcttttccaaagaatggcagcctggtcacaaactacattgccagaagaatgatgggattgatactcaaaagatttatagttgaattatagacagggaatgccaaggaagaaacgctgtgagaaaactccacatttgtcctttatcatttactgttaaaaagctctgtcagagcttcccagaaccttctatattagatagggctctggtcgctagtaatctaagctgattgaactagctaaaggacactctgtgaaagtgtgtgggaatgtctgtgggtctcaaaagtagagatggagccagatctcagaaaaggctgaaacctaaagttagaattatatatgcatcattccagaatctctcattgctttgtatttgctttattcatctttctctgttcactgtccttctcagattctcaatttccatggtggccaaaaggtagcctatcctcagaggttatatcaaatgagccctgttcctcacagagccgctaacagttcttcagctttgcagtctcaattcccagatgcaagagtgtgattgaccctccttgggtcaggttaacgcttaagtttggtcacacataatggaacaaatatggctgctatgggccaacctttggaatagggatagagcgagtagattagtagatggaaggtcccagagaaaataatatcatattgttggcttctgaagctatctgctacaggcagtgatcactgatttttccagccagaataaaccattcaatttcaataaattatgggcattttagataatggaaaccttagtgtttaaacaatgttctttccttattctaagtttacagctagtaggcttagttggttggtacataaacaaggagtgataacttaagagtgagaatgtagaaggactagctggatcataatgccacttactgaaagaacactgaagaacactgaaagaacactggagttgtatcactagggatgctgagttattatagacctctcctctatgagaagtgttatttcttcccatcttagttcaggctgccatataagaaatgtctttgactgggtggcttataaacaatagaaatgtatttattatggttctggaggctggaagtgcaagatcagggtgtcagcatgtttgggatctggtgacggtctacttcctggttcacagatggacaactgtcttcttgctgtgccctcacgtggcagaaggggcagatgaactatctagggccttccaaaggctccacctcaaaataccaccacatcggggactgggttttaacatgtgaatttgaggggtacacaaacattccgtttatagtatctcccatcccaggtaacagctgtttagatcagaagtggatacctgacccaaatgacaacctggtttttctcttctgaaatttagaattgagattggaagaccttagtcagtttggacatctacagtgtgccagaagctagcagttgggtgtacagtatttaacaagagagaagttgctgctcacttaaaacatgcatttcagctttatgttcagctatgtgcaggcaaacagacacgtggaattatgatgattttcacttcctcctgaagccagctgtacatgtggcccttccaggtctgtgagattgagatcacattatcagtgatcacactaggaagattaagctaatttgaggtgaatttttattacttaaaaccaagaatgtgtgtgtatctttgtttatgaaatgtttttgataatttatttgattggttgattagtctccatctttttaaaaagaggttaaattctttgagggcttttttttttttgtacttttctgtccccagggtgtgccacccactatgcttggcatattatagtcactcagttgtcactgcatgttgtctggtgcccctgagcactcagtgatatggagtgagagaaagaatggttataacttgggggaactccaagaaaacttgatggagtgagtagccttgaaggatgaaaaacttttaagtggaaatgcaagggcaaggagtgagacaggctattgtaaagaggggatttactgcttgttggtttgaattgaaaaaaattcattgtgcgcttcctttggaaggttttttaagattttttttctcagctgcagagtgaatattaggcagggacatataaattattagatcttcactagatcccaactagtgattcattccttggaaagataagctttagcaactacatcttttgtcctaatggaaataatcctatttgttcctcatcatgcactaagtcaaggggaaagaatgctggataactttttctcattgttgtgttcagaaatgtagttacactccattttagcaagcacattatgccctagcttcttgccgtttttcttaagagtgtgtttcattccctacaaggtcttctattctcttgtaaagtgtcttttattatgggttcttagtaattgttcccttcattagttagaaaagttatgttttagagccctagctgtagaactctttcctctttatgctaagatggattatatgaaaacaatctgattaaaactaatgcatatttagaattaaaacacaaaaagttgcacacaaatgtttatagtagcaatacccataatagtcaaataatagaaacaactcaagtgtctgttgacttgtgaatggattaataaaatatggtacatccataaaatggaatataatatggcagtaaaaatgaagtactggtatatgctacaacatagatgaactttgaaaacattatacgaagtgaaagaagccaaacacaaaagaccacatattctatggtcccatttatatgaaatgcctaggacaggcaaatccataaagacagaaagtaggttagtagttgtcagggcctggggagaggttggaggaggggatggggcatgaatgctaatggacatagatgggatttctttgtgtggcgatgaaatattctaaaattaagtgtgatgatggtggcacaaccctgtgaaaatactaaaaacctctgaattttatcatatgtatcatatgtgaattatatcatatgtaaattacaccttcataaatctgtttacaaaataagacatttctgtgtgtgtatgtatgtatgtttctttgtgtatatatttacatatgtttatgatgtttcagatgttggcaagtgcagcaagcatcattaccatgggcacttcctccatatgaccgctggaggaatttagagtgcatataacaatccagggctctgccattggctgtgtgaatttggatgggtcatttcatctttctcagcctcagtttctcacctgaaaaatggggataagaaaccacctttgcacagtccctataagaattaaatgaaatggtgtatgtgagatgaggtgactcactcattaggcagagcaggcacagtgcctggggctcacagtacttcaagggcccatgaaaatgttttaatttcttttaaatgcagaagaaagaaagatgtccttttaggtccaataaaaagttttaatgtataatactaatgtatttgtctttacaccaatctggtcatacagcatattttgtatttttttttttttttttactggaggaagaggcccatgaaacaaaggtaactcaggcccatggaaggcatcatggacacttgaacgtggcagctcaatgacacaggctgggtttatcttattgctctgcaaattcaacagaaacctcctctaaaatcataccaacaatttagcaacagtgtaagcagtctgtgttgagcagctcacctgcacacgcctggaggcatacacctagaggagaggaggaacactgggttggccagcctgggttactggcaggttcttccatttagtagtgcccagcctcctctttcttctagggcatctttgccaccattgctcccatttgttgagtccctgttatgaaccagacacttcatatttcttatctctgatcctcacaatctcctgtaaaggtgagtagtgtcctgaatgtagcagatgctgttgatgccctttccacttttcttctgcctgatattccctgcagctttacagtgtgcagtttttggtatgctgataggttgccactgcaaggtcctgccattgtcttctttgccatagctgcctctcctgcttctcttccttcttaaactctgcctgagggcttcctctggcatcccaggagcttgctttattgtttatagcggcaacctgaaaatgtcaagcggggttaatgcctcagagaatagccctcaagtaatagtggacagaagtaagtagaaaaatgccatagctccctcctgtctagtgagtgattctgaggtgtgttccttctggtttctcagagagtgctttacaagattgagccccacctgtccatagcaggaacctattcatctatgtactttttgacttttttttcttcttctcacatttcacttcctcccttggacctcttgagatcacttcctatgtaaactccctgcatccccatacttctccagggtcttcttttggtggaacccaaatttaagataatgagtttgtaaatgtaaaaactaaggctagggagaagttggggaacttgtcccaggaccactgcccctaaccaatggagccaggtttgcaacctacatctatctagtcgcggggcattctgtctttcagccattgcagtaagtactattacaagccaggagttgcttttttagttatgacggaatctgccattcctggtgccccataggtggttagccatgccttaggtgggtgtattagtccgtttttacactgctgataaagacatacccaagactgggaagaaaaataggtttaattagacttacatttccacatggctggggaggcctcagaatcatggtgggaagtgaaaggcacttcctacatggcagcagcaagagcaaatgaggaagatgcaaaagcggaaccccctgataaaaccatcagatcttgtgagacttactaccatgagaacagtatgggggaaaccgcccccatgattcaaattatctcccacggggtccctcccacaacacgtgggaattacgggagtacaattcaagatgagatttgggtgggggcacagagccaaaccatatcagtgggcagagaccatacagctgaaaggacacagagtcatgatgtctcatagccagacttgtccagcttcaaagtctgggtttcttctccaaaagcctcatgcttcatggtggttatgatggtagtgatgatggtggcgatgatgataatattgatgatggtggtgacagatttttcggttgtcagagtttactaggcacctattttgagcctgaaaatgtgcaatgtaccataaccatgtcctcagatttaataatccaattttgcagaaaaaattatttttatattttgaacactaaaatgtaccagaaccatcattttctcattgatactattattccattacttaaatttatttgtacttgaaggaaaagtatcatttcagtcactgtgctcatataatcctgccatgtttgccgggttaccttagggttacttactctagagttgtagctgtgaattatcactttgtaaaactgaaatatatttatgcaatggtagtaagtgggagagtaatgaaaaccaggctttatctatttttgtccagtaaggacaaaacattcttaaataataatctgctgtatccacaagatataattgcatacagattgcagacttaattcttaaatcagcgtttttgaagaatatacccaaagaaaaaccaattatgattatttccccttatttttcattgaagcctgtagtatcagatgtgctgttaggcttttgcactggttcgctcaaagctttgttgaaagaagccagaagattacaaattatttgttgccccagctttttggctacaatcaaacataaatttaaagtagactgtaaggtcactgtcacaagctatacttttatacatggcataacttaacagtaaccaagccaacaataagaagttgattacattccttcacggctattttaaaaatacatacttacaaaagaagatggagattttaaaccctgaacataacctcagattctcagttactttgtctataattctgttagcttcatgaatttttcctctgagtaactccaacatcatctaacccatctctgaacactaaataatggtggaaataccttctcagtttgctttctattagggaaagaagtatggaatcaactattgtgctgtaatcaccaccagggatctgtccttttatatccattcatttctggatctggccttttcggggtacttcagaaacaaaatcctgcctctagagaagctccatcatttgtacattgtcactgttcaacatctctttggacctctgttgatatcattgcttgagatgacagactatgataagagaaacaaggttctctataaggcagcattgactgcaggaagaggtgagaattgtaagttgtcaaaatgcaaagggcaaaaaagtagtctgccaggaatatgttcatacagattattatatacacttactgtctgtaacagctaagcattcaaagattacaatgaagatgtttccaatatttttaatgggaactatgaattagttcatgagttggcaactgtaagaacaaaatcctacttaatcaaattaatactgactgaggcagaaggatttgagcatcttgttatgagaaattggaagaatgaaagaaataagaaaccgacttgagagaatgaagtattgaatgaagtggttttgtaacgtgggatttgtaatcactacattttgagcaacatttatgttttgtgaagtggtcttcctaatgtatttaagcttttaaattacccctcatatataggtttcattcaaaagtgaaagtggtacctaaattaaacaatgtctaaactttctattgggttcagatgaagttttaagattttaaagagtaaaactgagcctcaagagacccaaaagtaatttaagaaatggtatcctcacactaataagatgctcccactgtgctttcccctatgtgttccctggactgtgtctaagggagatcctggccattgatttcattttcactttaactaatgatgtgaccctatcaggatctattcattcactctcacaggcctcattgatcctgtttgccacaaggactgctaagacccttggatctgcatggacaaaccttgccttcagggagatcatgaagcatgtacacactatcaataagtggaaactgcaacaagagcacattcttggggttctcagaaacagataacatagcaaagagtttaataaaaatgcgagacaacccttggagaaccattacaaggagttccactaagtgtagcagctctatcctggcaaatctttattaattccctcagttcatttgtataacttgggtaaagctaagccacttcctatccagtccaagtgggtgtcacattcaaaccaacacaaattcaataaactaaatctttgttgctatcttctttatggtgaaattaaattgcacaacacacagaaaatcatcctgaaaatcttcaacagtctgaactcccaaatcctattcatcacagcgaactgcctttgcataatttctttccttcctgttctcctcttccctcccttctcttccttttccattccccacctagcttcctctctcacagcactccatgccccacaacttactttctggatctattcttttctccccgggatggggttgctcttggctctcatatagctcatactctcttctctgggctttttttcagttcacctttctacccattaccgagatcatacaaattaaggccagaccctatactctcaataaaaaaagactccatcttttttgggggctgatgtgaggctgtgaatattcaattgttgttattaggattttcctctgtcacatcagtttcatggagtatttctgggagaaatagtcttatatttctcagccctcctgggacatccagattagaggaaaagctcttgaaattcaaaattacaatgagatgtttaaaagaaagtgtcgggcacccaaatgcctgcctacttgccttcctcacatggcaatagaatctgaacagtgtactcattatttgggggactatccagagagctcttgtacaagtaacacagactagttagctgccacgcccactgccactccccctgttcttcttctcctgccccatctccaaagccacttggcgaagcttcacccaaacaccttccctatagcagaataccagtgtctctatcaccaggcactccaaaattcccagtcctctgtgtgccagcttgctgctgggttccatgtagaagtgaggaagagtggacagctccccatctcttagtcaggcttcgtcatttttacctgaagcttaggtactgagtctcccatggaaatccaagagccttaaccagagaactcaaacccaaacttagggaccaaatggagaacattgcgtccattctccccctccctcctcctgtcccttgtgcacaatcaccaactcttatctcctccctctgttacttagcatggcttcccaaacagatcagtagataccaactgtagtggatgctgtgaggcttcatccaggcctctcttcagggacagctcattcaatcctagcttctgggaatggtttgtactgaaggcttacagctgtcccctgaccagaattatccttggccccagggaactggctgtccaaagattacacttcctctgaaagggcaatccattaccattgactggctgatttagggatatgaaggtcaagcctccttgcctctgaagggccaccacagctccagagctccttgttgagtcagctgaggcctccattgcaattgtattgcaagtcaactcttctttctgcctgatccttccttgctcacttcctcataggtttatctctttagaggattttctaataaaccttctacatgcaactacctggtttagtctttttctagagaacctaatctaagaccccacaaatacttttatttggagaggatggggacttgggagaggccccagataggctaggtttgagcccagttacacaataaatagcagctatttatgcatgaggtatgtagatttcatggggacactgggaatttctagatgtctgtagaactcagcctccaaattcactcatgaaacttgagccactttgtgactcaaacttgagccactatgtggcagtttcccactgttgataaactcagtgactaaatcacttatatctaccatctacacaaaactattcatcagaatgtgtttggggcccttgatctgggccctttttgggttataatgatgggattcttgtacagtgtgatagcttggttgtgtttttaatgcttcattctctctaaggcagtatgattttccagtgcactagagtgggttgagtatatttttgcaccaataattggtgttgggggccatatgacttgctttagccaatggaatgctagtagctatgatgcaagtggaggttttgcatatgcttacatggttaggcttgtcctctggtctcccgatgttgctgtgattagagcatgctccaggtacttactactctttcatcctgggcttcacgaaacagatgagcctgagccaaaccaaactgactgcagtctaaagcagagacactgaatgggattggatgatacttgttactgctggacacagagctgtaactcaacaatttgggttagcatttttgatagtttcacacataaaatattgtgaatttttcatttccattttgatgtattatactcttttatcttgttaaatcagagatgttatgcatacagaccataaaagtgcacctttaagaaattttgttctttatgtgtaaacctaggtcttctctacacacaatcctgttttcttctctaagtataaattgcattatttttcttgataaattgtattctaacatataatctcatccctctttcctcactatatggataatgcaaaagcttcctgttagtaaatcacaaataatgtttaatatcagagtcacagaaaccacagaccctttgatgtctcaaatctgatgtatttcaagcatccccctctacacatgcatatacacaaatgagatctgtaaacactgcacatacacacccacccatgcatttgtaagtcaaagcagcaatcgactgagggtaaaacactttctagagcattattttgtaccttgttttgtgtgaaaaagcaaaacagttttcacattgaagctctgttaatttaaaaaaaaattataaaattaggactgaaatgctcacacctatagatcttcttcatcagggtagcatttgctacttcccaggatataaattatactctcagtggattaagtggcctgaaaaccgatttaggaatttcacaatttttgctcagggcttaaatgcttcttgagagccactaccggtgagatggaatgagcaaccttagtgctactttccagggcagaaattccactctgcttttcagagcgaaggtcatgttcatggccctttctggagcacatagcctcaatcaatgccatgctgacgaaaatgtgtatcacaatctccgtgacttaagaataaagtcaggtgggccagtttagtggttttcagtctttagggatttttaaatgtcctatcactcagacacatccggtgttctgggcaaagcatgagtccataagcactcaagtgagttgagctcacctcctcagtggggatcttaatgctaatgcttgcatgtaagtgccctgatttccagtatcctccagtgtcaattggggataatggtaattgaccacacagaggtttagtaaagagctccagcgtgggtctggcagataagcacacccagaggttgtggacagttggtagtgccacattaccacccctttcctcaactggacaatacccactgtgtgagttgggatgggaagcatatccctacctcctcttgcaagaggttgagagggaaaataatccctctcccatgcccaggtgggcagagcaaggggctcatgacatagacctaaccaatcagttatttcttcctgaacttgtagcctggaggtaagtggcagggtagtgtggccactgggccccatgatagtagcactgcacaggcacagagaaagtgtcaggtatcccggagagacacttttgttatgtagcctcccttgattcctgtgcattttccaagcctgaattttgagaaaatgctaatattcttccaatatattgcaatatacccctctgctttttaagttagatttagatttctgttgcttgcaaccaagaatcctagcagatacccagacaaatgtttcatttgataaactttaaagcatttcactgatgggaggtattgctttttttattaagatatgtcatgatattaggaacaaattatatatatatttatgaagcatcaaaataagacttaaaaagtatcagttacattttactatctagtggtagagaatatttgtgctgtccacagttatgatataaatatccctagttcttttttcatccttaatcaactcttgtactcactccatttttgctaagcaaccccctctcacctccatacacacagcactactatgactagcaaaactgcactgtaggttctttcaagctttgtcttactttttttgtacttactcgccatttgttcttagcttcttttaagtgttttctttgctgtggttgtccttcagatgttggagttgctcagagttctgttctcaatgttcctgctctccctgggcatcttctcagctgccatggttactgccaacatggttgtgctgtaagcttcaagaaggaaaggacttcttacttcatattcaccactgcatgtctctagagattgacacattggccggcacatagtagacatttaaaaaaatctctgttgaatcagttttatcttatattggatgctatgaaatatttgtcttcagcacggactgcttctgggttccttaccagtaatatccatagcatgcttttatttggataccccataggcctcaaactaaacatgttaaaaactaactcgtgatgctcactgaggcataaataaatggtctgtccctctgtgtccctggtaccatgaatggtgcagccatctggtgtctggaggcagacatctgagaatctccctctttctgtgattctttaccctcccaccattcaccacatcctcttgattccatcccctctctccagctctacttcctctccctgccaccaggcatgcaccaccactgctcttttggatcagttcaccagcctgccacctactaggcctcccttcataatggctcccttcccatacactgctgctgtccctctcccacacccctcccctaagccccactagctcctacaatcctttaggacttatcccgatcagtcacctggaactgcttgctggtaccctctttcctggtttgtgcttctctgtgcttaacattcaccattcctgtatggtctgactgttgacttccatctaccagccaatgccaatctctggacatgcctctgtggatgctgcagtctttctagcctctgcacagtacaggatggaagtgccaagcagtcacatctgccaggatcaaccctcagcacatgtccagtgtgcttccttagttttactaggaaatctctgagacatgttccacccaggctcgcaaaggtccccagcagaactgaacctcagtggcccacaatgggaagctgtgctacgggctttcttcccttgccaatctcacttcacactcccctactggtgtttcctgggaacatcagcaaaataaactccatacactcatatgcttgcccactgggctcaatcctgccagaacactttgggcgatagtatagaacacctctcagagttatcccaactggggaccagggaggttgatgtatttgcccaccaacacttcatttgtcattggtaagggcttcttccaaggacattaactttctggtatttccacttagccctgcacaggaggtcttgctccttcagccagaagaaaagccctcaggcagagatttacaggtgttcccggcaggcaggcttcagcaaacaaggtggaggtcgagggtgaggcatcaataatatctgttccacaagtttaaattttataaaagactttgttattctgctgcaacgctgagattttccctatttgtttctgggcttggagcttatgaaatagaatgcgagagtgtttcttcccccatgttcaacgctgaaagcatctggtccttgacagtctggttaatctggtgtgttaccatccagatatactctgggattcttacatagtcaaaattacaactgtccttctgcatactgatactgttttcctttggcttaccttggattcccaggaattcatgtatgggcagcatgctgtgcctgtattctggtcaaatggcttttgagagtagtgcatggtatcttggctatcactgcagagccacccacctatgagagtttccagaaaaaagagcttccctagaacatagggtattatgtcactgaaagcccagacttattacaaattgccatctctgttccatttactctctgcattctttattttgcacaagtagaaacattcgttttgaaaccacacatttcattgttctgctgtgtttcctttttgtgtatgttcttaaggtgtgcaactttataatttgatatacatatacattgtgaagtaatcactacagtcaagtttatgatcatatccgcacctcacatagttaccggtttgtgtgtgtatggtaagaacacttaggatctatccccttagcaaatttcaagtatacactattgttacctgtagttaccatgctacccaccagagccccagaatttactgatctggcataactgaaacttgtacttcttgagcaacatctctccatttccctgttcccccagcccctgaaaactaccattcttctctcggcttctgtgagttcgactattttagattccacatataagtgatattatgtagtgtttgtcttatttcatttaccataatgtccaaaaacacatggagattcttcagaaatttgaaaatagatttttgagtattgttaccataaaaaattataagtgtttaaagtgatggctataaaactaacccaattcgatcattatattatgtatacatgcactaaaacatcacattgtgccccataaatgtctacaattattatggagcaattataaatttaaaaaataaaaaatagaactatcatataacccagagattccacttctaggtatttacccaaaggaattaaaatcaggatctcagagagatacctgcactcccatgttccttgcagtattattcacaatagccaagacatggaaacaaccttaattcccacagatggatgaagagatcaagaagatgaggtacacagacacacggtttattactcagtctgaaaataaatagctttatttatttatttatttatgtatttggagacagggtctcactctgttgcccaggctggagtgcagtatcatgatcacaacttactgtaaccttaaccccccaggctcaagcaattctcccatctaagcctcccaagtatctggaaacacatgcatgccccactatgctgggccactttaaaaatgtttttgtagagatggggtcttaccatgttgcccagactggtctcaaactcctgtgttcaagcaaccctcccacctcagcctcccagagtgctgggattacaggcgcgagccaccatgcctggccatggctgtgtttcttaaatggaaattatgtatttagaatataaaaatgtggtacatatacatcgtggaatactgtgcagccataaaaagtatgaagtcacgtcctttgcagcaacatggatggagctggaggccataattctaagtgaattaacataggaacagaaaactaaacactgcgtgttttcacttagaagttggagctaaatattgagcacatatggacataaacatgggaagaatagacactgtggactactagaatggggaggaaaggagggggtatggattgaaaaactacctattgggtactttgctcactgccagggcacaatatacccacatagcaagcctgcataggtaccaccatatctaaaataaaagttgaaatttaaaaagaaagaataataaaagtatgtatatgttttaaagaaagtggcactgtaagctggtattctttgtaggtttttgtcaacttaagggtcagtgtataaagcagctgaattcatcatcttcccatccccactcatcctcttccagagtttccatccctgtgaagggcaccaggtccactgattgctgaagccaggtacttgaatgtcagtttctgcccttctgtcctcccatgtgcccaccctacatccaatcagttatcaagtgatatgtcttccattttctaaacatctctccagttttcctctctccagtgtcccatgtgagatcacaccaagacctgtggcagtcttaggactggactctctgcctccaatttgacccatcagcaatgcactctctccttttgttatttgagtgattttttgaaaataaacatctaacatctacttccctgcaaaaatgttttgatggctccgcattgctcttagaatcaagtctaaactctgaattcacttctctactttttcatccttagccccaactctctatcctctcctcaattttttcacaaacaaaacacacttttagcttcttgaatatgtctcatggcccctcacttgtaagtccttactcacgctcttctctctgcctggaacattattgcttagtcttgattgcttgtgtttctcaagagccaagttcaagccctgacctgctgtcagtttctgattaaaaatgttgattttggctttgctttttatattaacagtgataaactctgtaattccttacggcttacagaatgatatttgcttctcccatggggattcaaagtaatttttaatgcaacatatttgacaaggaaaaaagggcagattcaatactctactatcactaccaatgaaaaaaggtggtagaacagatactaatcagctatattaaattggccataaacttcactcctactgagatatttctcagtggtcacagataagatggagacttagttaacacggatttttctagctgtgccatatttttttaaagctattaacatttttggctttgaacttttctttttctctttaggttgccaggaattggcagaccatttttgtctaattataacagtacttggaccttatgataaattcacagaaaatcactattttggaaatggatgcttaaaaatgcagcaacaaaaatgcatgcaattgaaattaatcacaaatatttctgagtaaatgttatgcttaaagccctgtattaagcctgtgaaaaacacagataagctcataatttaaatcaaagggtatagggtgaccaactatcccagtttgcctgggactgagtgggggaaggagtcctgagaaattgaattttcagtgagaaaaaacagaaggtcccaagaaaactggtacgagttgatcaccctagctacatatcaaaataatagcatgaattgttttatgaaaagtgccacacattagttttaacaaaaaataattacatgcttgggtcaggtggggaaagaagagatatcaagacactcacaagccaggaaaatggctatgatcaaagacaatgtgctttgaaacctttgagtatcaaagataagtatgagtcatgagaccagagaatttagaagaggccaaatttgaacaccttccaaattccaagcctgggggccagaccttattctctaaggacttgggtgctaattttggagaatttggggcaagttggaccaaaaattattataaaagcaatttttatggaggagtagtctaagttcttttttatttttaatatactttaagttctggggtacatgtgcagaacgtgcagttttgttacataggtatacacgttccatggtggtttgctgcacccatcaacccgtcacctacattaggtatttctcctaatgttatccctcccctactcccccaacccactgacaggtcttggtgtgtgatgttcccctccctatgtccatgtgttctcattgttcaactcccacttatgagtgacaacatgcgatgtttggttttctgttcttgtggtagtttgctgagagtgatggtttccactttatccacgtccctgcaaaggacatgaactcatcgtttttttatgactgcatagtattccatggtgtatatgtgccacattttctttatccagtctattattgatggacatttgggttggttccaagtctttgctattgtgaatagtgccacaataagcatatatgtgcatgtgtctttatagtagaatggtttataatcctttgggtacataccctgtaatgggattgctcggtgaaatggtgtttctagttctagatccttgaggaatcgtcacaccgtcttccacaatggttgaactaatttacattcccaccaacagtgtaaaagtgtccctatttctccacatcctttccagcatctgttgtttcctggcttttcaatgatcgccattctaactggtgtgagatggtatctcattgtgtttttgatttgcatttctctaatgaccagcgatgatgagcattttttcatatgtctgttggctgcataaatgtcttcttttgagaagagtctgttcatatcctttgcccactttttgatggttttttttccccttgtaaaattgtttaagttctttgtagatcctggatattagccctttgtcagatggatagactgcaaaaattttctcccattctgtaggttgcctgttgattctgatgatattttcttttgctgtgcagaagctcttcagtttaattagatcccatttgtcaattttggcttttgttgccattgcttttggtgttttagacatgaagtctttgctcatgcctatgtcctgaatggtattgcccaggttttcttctaggatttttatggtcctagatcttacgtttaagtatttgatccatcttgagttggtttttgtataaggtgtaaggaaggggtccagtttcagttttctgcatatggctagccagttttcccaataccatttattaaacagggaatcttttctttttgatccttcttttttttttttttttctcttgagacagagtctcaccctgtcacccaggctggagtgcaatggcacaatcttggctcactgccacctctgcctcctgggttcaagcgattctcctgtctcagcctcccgagttgctgggattataggcgtacgccaccatacccggctaattttttgtacctttggtagagatggggttttaccatgttggccaggctggtctcaaactcctgacctcgtgatctgcccgccttggcctcccaaagtgttgggattacaggtgtgagccactgcgcccgactgatcattcatttttaagagaatgaagaaatctccagaaagttgtgtttactaagaagactgcatcatctcaggctttgttttttattttgtaaacaagagcaagtgttcagaaccttcttaaacaactagcaacatgacaagcaatattgaaaactacaggtgtgccttattttatataaaactgctttgtgaaatacagatctttatgtatgaagcaattagaacagcatccccaacctttttggtaccgggaattggtttcgtggaagacagttttttcataggtggtgggtggtggggtggtttcaggatgaaactgttccacctcaaatcatcaggcattagattctcataaggagtatgcaccttaaatcccttgaatgtgcagttcacaagagtccatggtcctacgagaatctaatgccactgatctgatagaaggcagagttcaggtggtaatgttcactcacgcaacgctcacctcctgctgtgaggcctggttcctaacaggccacataccagtactggtctgtgatgggggagctgatgacccctgaattagaaggttatttattgcatgagaaaggcatttttcttttctaaattaaatagcattttaaaatagtgttaaatatatttaaaatagcatttattatataatgtaagcattgatttacttagctgtgacttctctgctgaactgagacctgtagggtcaatagtggagtgatgaaaaattggaggaattgtattccaggtaagggaaatacatacaaaggccttgaggcaaagggagcatggaaaattttagaaagtaaaggaagctctgggtgactagagcatagagagtagggtggggctgagagaaataaagctgaagggggaatgggcctgggatatcatgaagggcatgtcaaattaattaaggacttccaacttcctcactgtttacagggggctttgaagggttttaagcagggaaccgtatgtcaaggccagggccaacttcatcagcatgtgatgaatgcccattgtttagagaggcccaatgtttgatttaatgctgtttccaccattttggaattttaaattttttgaccaagtggctctgcatttttattttgtgctggaccctgccagttacctagctgatcctggccaaggctctaggtcattgtgtgtagtgaattaatacctactgagaggaccatgtttttctgctcactgctttttttcctttaaatagactttattttttagagcagttttcagttcacagcaaaaattgagatgaaagtgcagagttcccatacatcccctgtccacccactgcaacagcttctcccattatcaagaggtttgcaccaaagtgatacctttgttacaactggtaaacctacactgacatatctttatcacccaaagtctatagttaacgttagggttcactcttggtgttgtacattctgtgaatttggaaaaatgtataacacgtgtccaccattatagtatcatacagaatagtttcattaccctaaaaatcctctatactccacctactcatcctccctaaagtctggtaaccaatgatcttttactgtcactatggtttggtcttttccagaatgttgtataactggaatcatatggcatgtagtctacttggataggcttcttttcaccgctttttcccctgctagtatcagataattgtgcaggccactctacgagagccaaaggtcgtatttctccttctcctggaataatcacaagaacaggaggttctgcaggagcaattgactttagaggattaggggacaaataaacactgaagttttattcttcaggatttttgtatttctagaatagttcaaagtatgtacagagttgacagatcttttcaactgactggtcattcgttgcaaattccaaagaaataaactgtttaggaaacaactaactgatgagttacattcaataccctttctttgattccagacactaaagttattttgcatgcccaaattttgtactcagagacattacttctggggtctgtctagaagtaaaggcacaaatatgctgtaatagaatgctgccaggtagtgagggtcatcttctggccagaaatttcaccagaggctcttcaaaccttgcttttcccaaatgcagcccctaccaccaacaggttcctctgagctaacaaacaactccttgtcttctgtgacattttggattttaattctcatttcttcgaagaaaagggcaagcacatcttctcttttgggcttttctacaaattgtatatactgtctcagaagtagtgtccaacctttattattatgtacatgtggattttatcactagtatatactaaatatattactagatataaccactaataactataatactatataatgatataataccatatttttgtatatattatataccagcaatatacttttttcctattttgtcttctcctgcctatataataaaaacatgcttgttgaagatgctgccagagcttcatctgtattctcatgcctccttgtaccatttattgtgcacatcagttcctgggtactttcactcccaatagccaagtacttgtatctctttcttgaaggatcaaccttaggctgtggcacacaaagaaccacaacaagtttctgtgaatttactattccaggcaggggtggaggtaggggtgtcagccaatggctgattggtgttgtgtgttgtatgtttgtatgggtggtattataaatactccagcttcctgagcagatgactttgagtgggacccacactgtgtcatcaacttccccttcccccatcttcctcctctgcaggatggagccatagttaaccctctcaggctctttgtctgatgtcacatgtttgcttgccattcttacctacttagtctccctttctcatgctcctattttttcctgggactacttcttacaaatcactttcacacagttcttcatctcaggactacttttggggaacctactgtaagaatttgttgaggtagaaaagttgcagatcattgtgaagtgtaaaaaaagaacaggaaatgaatcatactatttccctacccccaagaaacctgttgtcagtctttttctatgaatttttagaagctttattgaggtatactttgcatatcatttaatttattctttcaagtatacatttcaatgatatatgtagtaaatttactaatcagtcattttcatcatcccaagaagacccatcatgtccatttaaatgacattaatcttcattttcctccaccctagcccctggcaaccgccaatatactttctgcctctatggatttgcccattatggtcaatttgtataaatggtatcataaaatatgtgatcttttgtatgtgccttaatttagcacccgtgttgtagtatgtatcagttcttcatttctttttatggctagcatttcattgtatggattgagcactttttatccattcattccttgatgtacatttgggttgtttctactttttggaatattaataattattgattaataatagaggctttaaattaataattatataattaaataattatttaattaaataattaaaattaataaaagttttaaaacatattttaaatttaaggctgttgttaaaaagtaatcctgtattctattgtttgtctgtaattctattgtcagtatctgtatgtgggataacaatatacatttgactgctacgctggaatttatttatttatatatttattttatttatttttatttttttttgagacgagtcttgctctgtcacccaggctggagtgcagtggtgcgatctcggctcactgcaacctctgccttccaggttcaagtgattctcctgcctcagcctccggagtagctgggactacaggcgcccgccaccacgcccggctaatttttgtatttttagtagagacggggtttcaccatcttggctaggattacaggcgtgagccactgagcctggccccctgaatcttttaaatcaaatgattcaacttaacttatcttttcttttcttttctttctttctttctttctttctttctttctttctttctttctttccttcttttcttttcttttcttttcttttcttttcttttcttttcttttcttttcttttcttttcttttcttttcttttcttttcttttcttttcgagatggagtctcactctgtcacccaggctggagtgcattggtgctcactgcaacctccacctgctgggttcaagcgattctcatgcctcagtcttccaagtggctgggactacaggcgtgcaccaccacgcctggctaatttttgtgtttttagtagaaatggggtttcaccatgttggccaggctggtcttgactactaacctcaagtgactcagccacctcggccttccaaagtgctgggattacaggcgtgagctactgcactcagctgattccattttctttaagttatttgtattcattcattttttttttgtttaataattcaacaatttttaaaagtattatgccaggcattgtgtttgatactggaaatacatggttatatttttgaaaccaaatttcaaggcatgatttgacaactgcatatgtattattggagatgataaaacagagctttggaaatcaagattggtgagaaataatttagataaaaaagggagatacaaagaattataatatagtaattaacctctgggacactctacctttgtagagttatgatctaaatctttctcaaatctgagtagatttttaaaaatctccatatacacgccattgctgtgtatttttaagatatcagattccgattcaggaccataagaaatctcagaacacagagagccagtataagttgtgttttcccttattctccctctcttcaccctgcccttctcataatcacttctgtctcaagttctctgtgtcttcatctatagggctggtacttaaaggcatgcctcattagtcttaactgtttctttcccatcaaaggctgtataattaccttgtaaattccaatgggagcatgagtgagtttgtctcatcgctgagcttcagggttctcataagctagcgataaagtaacagttcacacagatgaagggggactggggaagtgtgggtagaagtttttgcaatgaggtaaattttcttctgcaaggctcgtaatgagacatcaccacatgagtgggctggtctggattttgtcactctcctgtatcagcctttcccctccaaaccagcctatcaggctccctattagataattttgtttggactcagcatttcagcagatagtaactaaacaccttttttccttcactcagaaaagtaccctgtttttatagaaaacaagaagagcttgccgaaatccttctcagaggcaagctctccaagtaagtatattttctcaggctttttatagtttaatctacttacaaacttccataagcatagtatgtgtctttccatgcagtcttctgcttgatatccatgtatgagaaactgcaaaaaaaaggttatatttgatttataaaagttcttcattatttaaaagtgtactagaacaagccagtataaattccagtgcaggctggtgcggtggctcgtgcctgtaatcctagcactttgggaggccgaggcgggaggattacttgaggtcaggagttagagaccagcctggccaagatggtgaaaccccgtctccactaaaaatacaaaaattagccgggcgtggtggcatgcgcctgtagtaccagctactcaggaagctgaggcaggagaaccacttgaacccagaaggcagaggttgcagtgagccaagactgcactactgcactccagcccgggtgacagagcaagactcgtctcaaaaaaaaaaaaaaaattccaatgcagcagtcaaatgtatattgttatcccacatacagatactgacaatagaattacagacaaacaatagaatacaggattactttttaacaacaccgtttttgaagatataatccacatagcacaaaattcacccttttaaagcatgcaattcaggggatttgagtatattcacgaggttgtccaactatcatcattatctaattttagaatattttcatcatctcaaaaggaaatcctgtgtcctttagcagccacccctcattccgttctcctcctcagccctaagaaaccaaaaatctactttttgtctctatggattgatctgttctggacattttatagaagtgcagtcatacaatatgtggtcttttgtgactgacttctttcatttaaaatggtgttttcaagattcattcacgttgtagcatgtatcagtacttaatttccttttgttgctgaataatttattgtatggatagatcacattttgtttattcatttttcaggtgatggatagttgggttgtttctaccttttggatagtgtgaataatgctgctatgaacatttatgtataagtttttgggtaggcagatgttttcagttatcttgggtatatacctaggaatggaattgctgtgtcatgcagtaatattatgtttctaagctttggaggaattggcaaaccattttgcaaagctgccacaccctcctaaactgacagcaatcatggagggtgattatctacatttgtagaccagaaagtggtggtccagagagcttaaaaaagttgcctaagtcaataagataaacctgtattacttttcaaaatgttgcatcagccctgaaatgaagccctctcagattcctttaagaatgtctaatgacagagatggaagccaggagattgggacctgagtaatggatgtgtctgcctcaaattctgaacatctcaagggcagttccataaatggcaaacacatctgtaaaaagcatatttctctttttaacagcagaaaattttaattcttattaaaataaacacatatcactgtgttcatggagaacgcagaggggttaaatatatagaaaagatcatgccactgaaaccatcatactctaagaatttattctgtcataagattaactcttctccctttgctttctttatgtgaaggtgaagaatcctatggcccatagatttttacagtgttctccatcttgcagcacattaaggagttaattcctttcaggaaatccatttctgctgaaaggctcacttttccagcccctgaacagcatatgtgacctgcagtggttattcttagcaaacttcttcccagggatgacccaatgggagcagcacagctcaatcttttcgtgaagagagaaaacatctcagattcttttcctgttttaaattattgggaaccaatggctcagaactataccagttacccttataactaactgcattaccatcttccatccttctataccagtctcgctagtcttccttgctggctgtagttcttggaactctttaaccaatcttgacttagggtcttctttcagattgctctctatgcctgtgatgatctcccaaattcttatctagaaagaatcttttccttccttggcatgcaatgtattcctcatatgtattaccaaacacattgctttaaaaattatatagatacctcaaaataataacagccacctatgacaaacacacagccaacttcatactaaatgggcaaaagttgaaagcattcctcttgaaaaccagcacaagacaaggacgccctctctcaccactcctattcaacatagtattgcaagtcctggccagagcaatcaggcaagagaaagaaataaaggggatccaaacagagagagaggaagtccaactatccctgtttgtagacagcatgatcctatatctagaaaaccccatagtcccagcctcaaagctccttaatatgataaacaatgtcagcaaagtctcaagatacaaaatcaacgtataaaaatcactagcattcctatacaccaacaaccgtcaagtcaagagccaaatcagtaacgaactcccattcacaattgccacaaaaagattaaaattacctagaaatacaactaactaaggaggtgaaagatctctgcaaggagaactataaaccagtgatccaagaaatcagagatgatacaaacaaatgtaaaaacattctatgctcatggatatgaagaatcaatatcgtgaaaatggccatattacccaagcaatttatagagtcagtgctattcctatcaaactaccaatggcattcttcacagaccagaaaaaaactgttttaacattcatatggagctgaaaaaaagcctgaatagccaagaaaatcctaagcaaaaagaacaaaactggaggcatcacattacccaacttcaaactatactatggggctacagtaaccaaaacagcatggtactggtacaaaaacagacacacagaccaatgggacagaatagagagccaagaaataagactgcacacctacaatcatctgatctttgacaaacctgacaaaaacaagcaatggggaaaggactccctattcaataaatggtgctaggataactggctagccatatgcagagattgaaactgtacctcttcctatcaccatatacaaaaatcaactcaagatgaatgaaagacccaaatgtaaaacttaaaactataaaagtcctggaagacaacctaggcaataccattctggaaataggaatgggcaaatatttcatgacaaagacaccaaaagcaatcacaacaaaagcaaaaattgacaaactaatgagcttctgcacagcaaaagaaactatcaacagagtaaacagacaacctacagaatgagtgacatggtttggatctgtgaccctgcccaaatctcatgttgaattttaatccccaatgttggaggtggtgcctggtgggaggtgattggatcatgggggcggtttctcatggtttaccacgacctcccttggagctgtcatcataatagtgagttctcacacaatctggttgtataaaagtgtgtagtaccttattcccacttcctgttgctctggacatataggctctgacaatataggcagaaggcttcacccttcgccttctgccatgattataggttccctgaggcctcctcagctatgcttcctgtacagcctgtggaaatgtgagccaactaagcctgttttctttataaactacccagtctcaggtatttctttatagaaatgtgagaatggactaatacaatgggagaaaatatttgcaaactatgcatttgacaaaggtctaatatccaacatctataaggaacttaaatttccaagaaaaaacaaaacaccattaaaaagtgggcaaaggacatgaacagaaacctttcaaaagaacacatacatgtggccaacaagcatatgaagaaaaagctcaacatcactgatctttagagaaatgcaaatcaaaaccacaattagatactatctcacaccagtcagaatggctattactaaaaagtcaaaaaataacaagcactgtcgaggttgtggagaaaaagaaacacttatacactgctggtgagaatgtacattagttcaactactgcagaaaacatggcacttcctcaaagacataaaaacagaactaccatttgatgtagcaatcccagtactggctatatacccaaaggaatacagattgttttattataaagacacacacacacatatgttcattgcagcactattcacaatagcaaagatgtggagtcaacctaaatgaccataaatgatagactggataaagaaaatgtggtacatatacactatggaatactatgtggccataaaagagagggagattatgtcctttgcaggaacgtggatggagctggaggccattatccttagcaaactaatgcaagagcagaaaaccaaatactgtatgttctcagttacaagtggaagctaaatgatgagaacacatggacacatagaggggaacaacaggcactgaggcctttctgagggtggagggtggagggtggggcttgtacaacaagcctccatgacactgatttccctatataatgaacttgcacatgtaaccttaacttaaaagttaaagaataaaatatttgttgagtttcatgttacacatctgtagttattatagtcataacactttagagctgcacagactcaaatgatcagcactgccagacgttctgacagcaaaattatctgaatagataagagacttaggtgggcttttgctcagtaaatgaggttgtttatattctttgaaacagtacggcaattcataatactccaacacacgactgcctgtgggcagaccctcctgttcaaggtactgtgtggggtatcacagaatgctgttcaggaagatatcactggggccttctactctcaaaggggttgataaacacttgagagcatgaggatgaatacccaagggattaggtatgctttgggctctgaagctggccacatcagtaaaatatcacatacttggcaaattagatctgagtaatcaaacagaataattcagcatctctcccccatagacttttagtggctgacattagttttcatttgatgataattactgatcacagtaatcctcacaactaacagtttttcacttctgtaactttcttatatagatctggcacatttcttagtagtttacagatttacttttcgtttgtttcttggttgtgtttgcttatctgggcgaaatatatttttcctatatgttctcaatttggttatttatgacttataggaaatcgattaacttgtaagtttgtcttgtatctagtgacattattgctttcatattagttccagtaaactttaaattgacaagttggatttgtagacagaaagtcatttatttgtttataataacactttggcatagtccttttccgtatttaaggctttaaagaaatcttttcttatatgttgctgaagacttctggtacaatgtcaattttaggcatctttgccttgctcctgagtttaatgagaccactttttaacttaagcaagataaatcagtttctttccatcttgacttattggtagttatatttttctttcaagctggaaagcctgtgaaattttgtaaaatatatcttagcattacttgagatgatcatgtttttttttcctccatctttaatataaatacatagagaattctgttaatagttttcctaaagttgaacctccttgaattcctgggataaagcctggttgatcatgatttattgttgtggagttttctatttgcttagctttgtaataattctccattaaaaaacacttattggctaagtgaaccaaaatatctaatgaaccatgaagttgtttgaaattatagcaaggaatataaatagactagttggctatgctgttccctttttaaaaataatttcattccatgctgacatgagcaataggatttgatcgtaacagagagatgacttcttggctgtgtaggccatatgtttcctgataaaatatctagtgtctaatatcgaatagcccttgtggcttattttgtgtgtttaaacaatctggtccagttctgctaagtgacaacaagcatcacctactgtcaaaactcttttctgagcctgcagaaattactacaactgtgggatgtacttgatttcaatgtgctgtattaatgtttgcccagtaatttctagttacagaggctatagcttgttcttccaccaaccatcctggagagcagttagtaaggtgtagcagttgagagtgtgaactatctggtttcacttcacagctctgccattaactggctgtgaaaaccttaaattcctcagttttattattttaaaaatgggactatttaaggtaactttgagctattgtgaatatttagtgactaaatataaagcacttaaaatgtatttggtgcatagtgttacatatgtgctagctatgatttattttttgtttcaatgtaattttttcctttttttaaatttaaaacttttatagctctattgaggtataattcacaaataaatattgcatatgtgtatatattgtatacaatgtgatgttttgacacatgtatacactctgaaatgattattacaatcaaactaattatcatgtctattacctcacagttatatttaatattaatatttaagattattctcttagcaattttcaagtatacaatacattattaactacaagctatgactttgaataatcaagttagaatgatcaatttgccaggagtttttgttacagatgtcagagtcctatgatcacacatgaaagatttgctttttttccttatatgtgacccatggaaacatatcccttgtagaatttgactagtcctttactcattcaaggaatttctgaaaataggcagatttgtttgactaatgtttttccaataaaaaagggctggctgtttttctcacaatattttacattttgaaaaattcaaagaaatgaaattgaagctgattatcagaatctgtcggggaaatcattaaacattggccagccctagtaaatagcaatggaagggtaatttacacctctcattgctctataggaggttcttctgttgcccctgtgttgaccggttcacagttagcaaaagtatcttgtagggggactccaaagacagagagattgtgtgcagcttctgctctcagactccctgggtcaaatctgagctttgccactggtcatcagcaagttgaccttgggtgtgtttctagtgctccagtttcctcatttgtaaaaatgtgataataataataattacctctcagggctgtggggagaattacaagagaaaacccctgtgtatgaccaacataggaccctgcacatacgaagtgctcaataagtaatgtgtcatttagtacaaagcatttgttatttggaagtttttttttgttgttctaaggtgtaagtcatcatatctccggctaggcagtatgccatacatgaaagtttgggagagtggggttcatttattttaaaaacagttcagtgtttttagtatagtcacagatatgtgcacccatcaccacaatcaattttagaacattttgatgaccccccaaaggaacctcatacccaataactctcatttcccccttcccccgtccatctagctggctgtaagcaaccactcatctactttctgtctctatagatttgcctattccggacatttcacacaaattaaattgtactatgtttagtcttttgtgactggcttctttcatgtagcttaatttttcaaggtttatccatgttgtaacaagtaccggtacttcatttctttgcatggcagaataatcttccagggtatggatagaccacactttgtttatccatttattcattgatggacatttgagttgtttctacctttcggctatagggaataatgctgcagtgaacattcatgtacacatttttgtatggatgtatgtttttatttttcttaagtatgtatctaaaagtggaattgttaggttatattccatttgaggaactgtcagactgttttccaaagctgctgcaccattttacatccccaccagcagtgtatgtttgaaggttccaatttctccacactttcaccaatacttcttattatgtttttgtttatagccatcctagtaggtatgaagtgatatttcattgtgattttaatttgcatgtccctgacaactagtgatgtagaccatctttttgtgtgtttactggccatttgtacatcttctttgggaaaatatctattcaaatctgttgcccatttttaattgggttgtattttcaattattaagttgtaacactggtaatttttattgagctattaatcgctgttcacacttgaccttgcacacaaatccctggggactttgttaaaaagcagtctctgcttcacttaggtcccttggggaacctaagagtgtacattttccagtagttgcagatggcgtagtccatggaccctacttgaagtaagaaagacactttttaaaatgcttcatgattggctttttatgtattactcagaaaagccatttgaagagagaaacacaaaacctacattttatttattctttcctatattcacttccacaaatggaagtattagagaaatgtaaaatataatatattctcactgttttaaagagagctaacattatattagtgtctgaaaataaagatatagttagaataatttaactttttttctcgaatacttgtattataatttaaagcatttagaagcagtatttgccaagtgactagatttactttcagtttttaaaatagttttggctacagatgtagctgtaagtttggactttctagtacttatttattatctttttcctttaaaaaacagtttgagacacagtctccttctaatgaaagattattcatcatcctctttggtcatgcttcgttgggaggcacttgcattgatgtaggacaggaagaaaggggagggaccctggctgaaccagccagatttgcagaattagtggccaacacgtgtctcatagatttatgtgcctacagtcttggcagcatcccaatataaaggtatattatttccagggacttaattcccctcacagtgtgaaagagcaatgaaaagcacaagtttggaaaagaaactgcaaatgaaaaaatcaatgtaatgaaatcaattgtgaacactagagtttgttcaaattagttttttgtttgtttgtttgtttagttttggtagctatcatcctcatagatacctcacctaccctataggacgtatgatttcactttcaaggggattttctggcctttaatgagtcatggcagcagttaacactagttgcagtggctggtggtataatttggaggcgcattctgttcttttgtgacattaaaatggaaaatatgagcccagaaaatgatttctctagggatgcacatacatggttacagctcattatggacctgtcaacatcttctcctctgcccttccttgggggagattttgtctcctgacgcagttttgaatgagagtttaacaagtgctgagtctcgtaccttttacagtaaaatatttgcccagatgaagtcatctccttcggaatttgaaatttccctctaaaaatatggctaaacccacaagctataaagaatcataataattcatttagagataactttttggcagctggaaccactagaaattttctggagtatagatttggtaagttaggcaggctaaagggctctgcccccagataagtgacccttagggaattttccatatctgaaggtaagaaggactatgggaaattggtttattgatagagttagttaatcaagatgttatttctggcaacttttaataattaacatttattgtacacacattgataaagttagaaaatatctactctgaaataatgggactataatttttaaaatttaacttaaataataaagttatcatttgtaacattatactacactaatactatagtatcaccatgcagataacactatgaggctgatttgttatattctctttacttcttagctcagaaggcaagtagagatgtttcataatctgtcgttaaaattgttttcttttcctcattgggcccatgatcgtccaaacgtttctctaaagaaagtccccttgaataaaagtggctttttaaaattattattattatacttttagttctagggtacatgtacacaatgtacaggtttgttacatatgtatgcatgtgccatgttggtttgctgcacccattaattcgtcatgtacgttaggtatttctcctaatgctatccctcccccatccccccatccccccaccccacgacaggccccggtgtgtgatgttccccaccctgtgtctaagtattctccttgttcaattctcatctatgagtgaaaacatgcgttgtttggtttactgtccttgcgacagtttgctcagaattagggtttccagcttcatccatgtccctacaaaggacatgaactcgtccttttttatagctgcctagtattccatggtgtatatgtgccacattttcttaatccagtctatcattgatggacatttgggttggttccaagtctttcctattgtgaatagtgctgcaataaacatacgtgtgcaaatgtctttatagtagcatgattcataatcctttgggtatatacccagtaatgggatcactgggttaaatagtatttctagttttagatccttgaggaatcaccacactgtcttccacaatggttgaactggtttacagtcccttcaacagtgtaaaagcgttcctatttctccacatcctctccagcacctattgtttcctgactttttaatgatagccattctaactggtatgagatggtatctcattgtggttttgatttgcatttatctgatgaccagtgatgatgagcatttttcatgtgtctattggctgcataaatgtcttcttttgaaaagtgtctgttcatatcctttgcccaaaaagtggtttttttttaaatcatgaaagcaaaagagatcctccctgtgcagagtggaagtgataacccttcattggtgagataatatcccattatttagatgggggaatcttcacattgttaacacactgaacttagagtatagagggtgggggatgcccattcctggctgcaggggccctgggacctcatctcttctgggtgcagcactgctgcctttacatcttttccactctagacctccattttaagccactgcttaaagagtataaaaatatcttctgtttcctttcttcccctttccttccttttctccttttcttccttcttttttttccttcaaaatttaagtagtacactcatgcatgctggtgagtatgctaggtatgaggatagaagtggtccctcaagacgatgactatgatgtggcccctgagacagtcataggctggggaccagaaaggaggcaatataggtatcggccgaaagatgatgactttcattttgactgtgttgagttttaagaactgggagcatgtgtccagctacttgtacagtgcctaacacatagtagcctgagacactgaatggaagccaccatcagtgctcttctttggtcatgtgaccttgggtaattccccctccccaaccaacaccaccattctgggcctctagttgctcttctgaaaaaagatatcattggattagatgaccctagaagtttcttcctttacaagaagctgttggtaccctctatgtatttcctagacacacacctgatggcaagtacctggtaaaaacacctgcaactctctttctagtagtttctttctggtcatgggaacatactctgccatgacagggcaagtttcagaagtgacagagagttaatgatcctaggagcagccctcaactggtgatggatgaagagtaggtgggtaattctaggttaactctttcagggtaactctgaagcatatccactctgtctcgcagagtctccctgcagggctgagtcccagtttccttcgatgataactgtattgtgaactcatgttttattgacttctttctctttcctatctcattgcctctcactcccctaccaactgtttcctggtgttacctcctgtggtcagcagaataataccctgagagatgttcacatgctaatcctgggacttgtgaatctgttctcttagatggccaaagagactttgcagatgcagattaaattaaggatcttgagatggggagattggcctgggttatttgggtgtgcccattgtaatcacaagggctctcataggtgaaggagggaggcaagggagtcagattcagagaaggaggtgtgatgacagcaacagagttagagagaaattggaagatgatacactgctggctttgaagaaggaggaaggtgccacaagcccagaattgcaagtggcttctagaagctggacaatgacaaaaaaagggggatggggggctcctcctctagagtctccagaaggaatgcaactctgcctcttggtttgagcccagtgagatccattttggacttctgacctccagaactgaaagaaaatatgtatctgttgatttaaaccactaaatttgtagtaatttgttacagcagtgacacaaaattaatacccctcctaaataaaccatttgttcaggaattgttgcttcagcatctgcttctgggagaacccaaattaagacacttcctaatctgatattgtatgcttatttttaccttagttaaaatatcaacatttttcagttgttcaataacaattagttattgtgcccttttatatgcttgatgtttctgtaaggcaagtcacaaagatgcaattaactcagcccttccctgcatagagcttacattctaacagtggaaatagaaaatgccacaaaaattgtagcatgtgtcttgtactattgagcacttttttcttcactagtcagataactgtaagtatttataaggcatctaatgtgaaccttgagcaaagcatcaagtatataaatatatgccatacacaatggtgtataaaataatatagtcactgccaacaaaaaaacacattctcaaatctaatttttaataaagtgacagtatcaccctaaaagaggccaatcttattttgtcagtagaagaaaaggaagaagaacaaggagttctcactgtaaacaatgtagggatcccattttagggaaactgaaacactgatttcaccttctagattcccataaaaagcatggaaagtttattttgttcccaaggaaattcactgttgtttagcttctgaaccatcagcacattaaaaaaacgataatttactgcagcattttagctgtgaaatatacggaaagaaagttgaagtcagattcacaagatatgagttcaaatcctggatctgtcacttcataaaatcatgagctctcaggcaataatttaactgttctgaactgcagctgttaaataacaagtcatgggtggaggtcagcacatgctaatgtcccaagctctttctctgttttatatggttgggcatgtagtagagtaagctttttcaacgctttaggctgaaattctggaatccttgttgctttcatttctgctttcaaagttgccaaattctctcccatctctcccccaccctctttccttttaatcccttgtcagacacaggcaagagtagccaacatatgctaacattttaattctaaaggtgctggctttgaaggcatgtggtcgcccttccaggttatcacaggtaaaagatgtagcaagtttttttgctgccacatgatatgagtcacctgtctttctaacctctggtatctagttcctctttgtctgttacctaaggactaagccagttctaaattcattattaggtcttggttatggcagcacctcactttaaggtgctcaaatatctcaagtagaatagtcctgttgctgcatcaagaagctaattgctggaaaaaacaaactgaacatttttgcgacttaacacaaatttagttttcgtttgcattggaattaggcatttggagggcaggctaccatgtggggattcaaggactcaggcttcttctgtcttgtggcatcctcatgttcaatctgtgtactccatggaatggcctagaaaatggcagatcccatgagcctgacctggaagtgacacacatcactcctgcctttgaccagaactcttatcattccattgaccattatttgatcacatggctccatcctacctacaagggaggtgaggaagtgtgaactctggcttagcacaatcccttagtcatcagtgagccatctctgtcttcttgtgcttacttcaaaatgttgctatgcaggtgaaaactgcaaaattgatctgagagttacttttagagtaaaacatatggtacagatgagagggattgattttttcaaagaaacctcattaccctgagactttgctgaagttgcttatcagcttaaggagattttgggctgagacaatggggttttctagatgtacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccggttttcaaagggcatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggatttggtttgccagtattttattgaggatttttgcatcaatgttcatcaaggatatttgtctaaaattctcttttttggttgtgtctctgcctggctttggtatcaggatgctgctggcctcataaaatgagttagggaggattccctctttttgtattgattggaatagtttcagaaggaatggtaccagttcctccttgtacctctggtagaattcggctgtgaatccatctggtcctggactctttttggttggtaagctgttgattattgccacaatttcagatcctgttattggtctattcagagattcaacttcttcctggtttagtcttgggagggtgtatgtgtcgaggaagaaacagagagccaaatcatgagtgaactcccattcacaattgcttcaaagagaataaaatacctaggaattcaacttacaagggacgtgaaggacctcttcaaggagaaccacaaaccactgctctatgaaataaaagaggatacgaagaaatggaagaacattccatgctcatgggtaggaagaatcaatatcgtgaaaatggccatactgcccaaggtaatttatagattcaatgccatccccatcaagctaccaatgcctttcttcacagaattggaaaaaactactttaaagttcatatggaaccaaaaaagagcccacatcgccaagtcaatcctaagccaaaagaacaaagctggaggcatcacgctacctgacttcaaactatactacaagtctacagtaaccaaaacagcatggtactggtaccaaaacagagatatagatcaatggaacagaacagagccctcagaaataacgccgcatatctacaactatctgatctttgacaaacctgacaaaaacaagcaacggggaaaggattccctatttaataaatggtgctgggaaaactggctagccatatgtagaaggctgaaactggatcccttccttacaccttatacaaaaatgaattcaagatggatgaaagacttaaacgttagacctaaaaccataaaaaccctagaagaaaacctaggtagtaccattcaggacataggtatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatggtagaacattttcgcaacctactcatctgacaaagggctaatattcagaatctacaatgaactcaaacaaatttacaagaaaaaaacaaccccatcaaaaagtgggcaaaggacatgaacagacacttctcaaaagaagacatttatgcagccaacagacacatgaaaaaatgcgtatcatcactggccatcagagaaatgcaaatcaaaaccacaatgagataccatctcacaccagttacaatggcaatcattaaaaagtcaggaaacaacaggtgctggagaggatatggagaaataggaacacttttacactgttggtgggactgtaaactagttcaaccattgtggaagtcagtgtggcgattcctcagggatctagaactagaaataccatttgacccagccttcccattactgggtatatacccaaatgactataaatcatgctgttataaagacacatgcacacgtatgtttattgcggcactgttcacaatagcaaagtcttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcattaaactatcgcaagaacaaaaaaccaaacaccttgtgttctcactcataggtggaaattgaacaatgagaacacatggacacaggaaggggaacatcacactctgatgactgttgtggggtgggaggaggggggagggatagcattaggagatatacctaatgctaaatgacgagttaatgggtacggcacaccagcgtggcacatgtatacatatgtaactaacctgcacattgtgcacatgtaccctaaaacttaaagtataataataataaaataaaaaataaaaaaaagaaacctcattacccattatgatttgattatcctgatagtacaaatagtttagcatctaataggtcaatcagtttaatggacttgagccctattcaacaggtgttaacattgctttttgggaaaatgcctgtttccttgctggctgttgacagcaggtctatctcagctttgagaggctgtgagcatttcttgtctcatggtccctcagtcttgaaagccagcaatggtatgtcagatccttgttatgcttccaatccctttgacttcttcctttataattttttatttttgagacagggtctctgtctcccaggctggagtacagtgatgcaatcacggctcactgcagcctcaacctcaaaggctcaagtgatccgctcacctaagcttccagagtagctgggaccacaggcatgcagcactatactcagctaattattattattattattattattattatttaatatacaaggtctccctaagttgcccaggctgatcttgaactctggggtcaaactgtcctgtgttggcctcccaaaatgctgaggttacaagtttacacctgaaaagccaccatgcccagcctttgacttcttccttttaaaggactaatgtgattagagcaggcccacccagattatctccccatgtaagggtaagtgatttgggaccttagttacattttcaaaatcccttcgtagcagtacctagattagtatttaatttagtaaccatgggatgggaatcttgggaggctatccttagaattctacctactatagttaagtgaattgcctgaattcacatgagtagagagtagtgagtgaagcaaggatttaaaccccagcctatctggcatcagagtctgtgccttttctacctatcaggtgacccctctatgaaaatcagtggtggacattaaccccaaaagaattttctagaaggaaagcccaaccctaattcttaacctagaggaatgtcttagttcatttgtgctgccattacaaaataccacagactgagtaatttatagagaacagaattttatttctcactgttctagaggctgggaagtccaagatcaagaccctagcagtgtcattttctggtgagggctgctgtctacataaaaatgatgctgtctgcatcctccagagaggaaggatgctgtgtcctcacatggcagaagggacagaagggcaaaagggggcctaagctggttacctctggcccttttacaaggcacaaatacacttattagggctgagccctcatgatttaaccatttctccaaaaggcccctacctcccaataccaccacaatagggattaactttcatcataaattttggaggggacaaaaatattcaaaccttagcaagccatataatttaaataattattacatttaaaattgtagatttagtgtttaaaaattatgcaccaaagtaatactgaatctttctgaaatgccaccaccaaagagatagtatgattgtgggctatgtaaacagatctggatcaagtctaagagccaccacttacttgccctgattccccatgcctcagtttctgtaccataagtgggggataataatagtggtatcttctggttgtgctgagagattgaaattataacacttaccatagttcctaggacactgtaagcactcaataatttctaaccacccccactactatcattatcatcatcatcacattattattattattgttatctccaaccttcagcctagatggttgatacctattaaacatattatcaaatatttatactttcatatcaataacatataaaataaattatgttcattcttcagatgagcagaagaggtatcatgccatgatctcatttttaacatgcatttgcttctgaaatctcagctgtagattagtaaatgtaatacttagtaattttttgatctgatgttttctctgcccttcctgtaatttagagtttgtacacttggttctaattctgtcagtgacttaaatagatataaatttaatgtcatagctcatgagaattaatgtcactttcaaagtcatcctctcaacctgcccttctcctttttcctcttgatccaagacccattattctaaggtttctaacacatttcttttcacttatactccagacttgagattgctgtaaacatgaaatttatttttagatctttttgctctgcattctactcagagcctttctctttttgcattttcacaacattcctaggcttctgctcagccaacattttaaatatgacaaaaataaatgccatggagggaagactctgtggcagcaacagaaatgcctgttgagtcctctgtggaatgaagcctgagaccccttgggtggtttaagcagaaatatttgagcgaagaagtgtgaaggacagaggtgtcagaaggaattttcaagagtgtttataaacagtatatgctacagagggtgcagggctactgagacctcaattaggatggggggtgtggttaggagaggccactatggtgcagacatccacccatcccaatttctgtagaagtcagcgatggaaatgcgcagtggtccaataatgttcccattggtggtagagtcagagctttggttttttatcaccttacatggattttacacattattaagacataagctagaggagagaaatttcttattaacaaaacctgaaatcctactagcactgataccttctcccagcacctgcactagccacccatgacatcctctacagattagtgtgcctcctttgctttccatgttaaccttttagcatccataccattccccttatttaaaatagggcttctcaactgagacaccattgacatttggggccagacaattctttgtggtgggggctgtcctgtgcattgtgggatatttagtggcatctctgacttctacccactagatgctagaaacccctccccaagttgctacaaccaaaaatgtctccagacactgccacatgacccctagaagtcacgattgtctgcacttaagaacgactagtgtagaaccccctctttcttctgctctactagtccttccttgttttcctgtataactctgctcaaagctcacctgtacaaaacaattcattaattaatcccacctagctctgagctttttcatcactaagtaccttctgtcctgctgggcctagacatagattttaccaattatgtttttgccatagcctccatttgtaataaatcagtttttgttactccttctgtatgtaaggaaagagtaagtttatgacttcattttaaaaatatctccaaagttcctgctagcatattctgcataaaatggactcagtaacactttgatttagtgagcagaactacttttttttttttttttttgagatagtatctcactttgtcgcccaggctggagtgcagtggcgcaatctcagctcactgcaacctctacccttagcgttcaagagattctcgtgtcttggcctcccgagtagctgggattacaggtgcccgccatcatagccagctaatttttgtatttttagtagagacagggttttgccatgttggccaggctggtttcgaactcctgacctcaagtgatctgcccaccgctgggattataggcgtgagccactgcgtttggccagaactacagttttctattactaccagttgcattgcttgacttttatttatttagcaattttaccattgctgaattgcttcaggattgaagagaatgaatctttagaatctctattgaaataaggaattaaataattgtgatttcttttattctgctgagaacttccaatatactcatttggtgatgaatacattttttaagtgaatattcccaacatacttgggaccactgtagctttcagctatatggcatgtacctgggtatgctgacgccacactattttttgttggagattcagcagttattttgtgtgcagttgacagactttttttttccaggtcctccctgggatctaattttgtaatgctctcagtgttttctcatgtccccttagcatttactctatgcatggaaggctgcgtgtttggaacacctaaaactctgccacctgagggcatttcttctaacagtgggaattgcctgggtgttaatggccatgaaagcaattctcccagcatggtgactcatgccacctataattccagtgttttgggaggctgaggcaggataattgcttgggcccaggagctcgagaccagcgtgggcaacatggctagatcctgtatctacaataaaaacaacaacaataataataatctggatgtggtggtacatgcctgtagccccagctactcaggaggctgagaatggagggtcgcctcagtccaggaattcgaggctgcagtgagtcatgattgcagcactgcactccagactccagcctgggcgacagagcaagaccctgtcaaagaaagaaaagaaaagaaaacaagcagctggttggatggggatttggcaaaaaactgccccagcttcctagtccccctgtgaggacaactctgaggcaaatatatatatatattttttttttttttgagatggagtctccctctgtcacccaggctggagtgcagtggcgccatctcggctcactgcaagctccacctcccaggttcatgccattctcctgcctcagcctcccgagtagctgcgactacaggcgcctgacaccacgcccagctaatattttttgtatttttagtagagacggggtttctgaggcatattctgtactgtctctcagtattacctagtaggattgatcaaattgctcacagaagtaacttgtgtgataacacacctcggttggtttctttcccttctctgtctcaccttccaaataaactacttacactcaaatccttgtttcagactccacttgtaggagaacccaaaccaagaatccatgttataaatatgatgatttaacatgtttagagaaatcttgaactaattcacaaaggcttgttcatgaaatgctgttgatcggtgttgtcaccaaatgttctaaggtctacattctgggtgggccagactgcatcagggactgctgtgcactgatgtgtttgtctgtgatgatgtgggcattgttatttttactgggtttgttgtgagtaaagcttttggaaattatgttttcccacaagttccgcaaatgttttcacattttagaaattgtttgagcatgctgtaagccataactttgaaagtcaagcagtttggctggtgatattatttttaaagaaacaaaagtcttgttttgttttcaattttggcttttgttatgctttgcaatccttttttgctctcatggccttaacttactttgtcttgtacatggttttgcataatactcatggagatatttcatatacatttttgtgtggatatgattgcaataaattttttactggtaatacttcacattctaaagctcttttacatatatttcatttaatgctcacaaaccccctaaacaataggattataatcacagtttaatgatagagaaaaccaagttccagaagagtttaagtgagtttctgttcagcacttttattttgtcatgaattaacataaacattttattcatgtgatcagcaattctacaaagacaacaaagagtgagaatgtaatctccaagggaagcagagtgtgtattagcatagctgtagggcaggggaacttggggatgaatggatacagacctcagcaattgtcctaagtctggtcttctttcaggtttgttaattcaccacattctcatgtaatggaaagagtaaacattctctatatgctagcattattttacaaaatgaacaccagtgaaccagacatgaaagcagcattttcccagtgctttctcaccttccaggaaacctccttcactgttgctgtcagcctctggtggattatcagcaccatgaacactatagtccatattttctgcatcaccaaccaggacaccatgagtaccatgtgttggtttacacacaatctctatcgtacttgcactaaattcgtatctggggtgaagaggaagtgcatcactatctcaaatgtcaacactgaattttgaattttagtggatgctgtttctcccaggagctagaatattgcgtttgatagccagctctgaataggtccctccttgacaattgccatcccttatgttggactcagtctgatttcttgaacctttgcttgttatctgctgttggtacctgaactgcttctatggaggccagttaaccccctttggcccttccaccgacagtgcacctgagttatgactaagccattctgcgctggcaaggattcagttgggaaaacataaaacctttagatatttcaagaagaaagatttattacaggagtgagaggctttctaaagaattgaaaaggacttcaactagcattcaagaaattaggaagataataacagcaggcaggcaccattgatggtctcagatacctactgtacctggaagcatctagcaacacctcccatgggccactggcccaaggctgttcatctgcctgccatcaccatattggactttggcttctcttaggccttgtgaatatatctcatttgtgtgagctcaccctgaactgtatcgcaaggtgtctggaaaatgtaattaccaaacttctagctgctgggatccagagaagaacataaaggaatgaatatagttctgagtagcctactggtagttcaggccatattgtgtttctaggattttctgaaactgatctgtgagcctggggtgcccaaagaagaggatgttgttcctccaaaactgaaggtgctgagaaaaacatttctgatctggggcagggcaatagaatcagggagaaatagcaactggagatgtgatgaccctcaaaattaagattcagtgatagttgttgatgtgaaataggaaaagactagtacctatgcttcacacagagctaccaggaaaattgggcaactccctaaccgtatccttactatacatagtagagtagtactctgagatttccctactttctggtaaaatatgttgtgcactttaatcagctggctgagtgtcttctctactcctgtatgccaaggtcagagtctttggataagttttctccttcagagacaaaccttggaaaaagtctccaggaggcaatgagatttgtccaggaggttatccttgcataggaggtgctccatccagccagtcctgtagggcatgagacctggccaggagtagtagaacaacttttgggattgtttttagtggcatattctacttgtcatgtgattcataacatttgcttccagaagcctgtgcttttggcctagatacaagactgaaaggctgaggcatccatgaaattgacctaatgctgtataaaaatgttactacatgttacaagtcataaagtctggtttattcctcgtagaatgctagcaatcagttttcttttcatcatgatgtgaaatagtctttttatattcataattaggttttgttaagaaattttactgtgttcagatgaattaatattaaatatcaaataatgatatattttttccttcaagaatatattataaaaccagaactctattaaaaaaaaaagttctgttggataagtcaaataaaaagtactatacctaagcacttatgggcccttaatttaagcaaactgaggtactaactttgagtttccttaataccttattaatacttttaatctttttttaaggaaatttgtatggaagttgtaatcaatagtgttctgaaggttttaaaaaattctagttggaaaaatacttcacagagactatacctaatactgaaattttgtttcttttataatgattaacatgcaaagagaaaggcataataagctccagttaattaattggaagttgaattatttaacctgtatatattggaaatcttcctagttgcactgaacactgatttatctattcttgctatctatcattttattgtttttcattggaataaaagcactttttagaccttatgtgaatttttttgttgacaatgataagctaacatgtcaacaaaatgttttataaatgagtagttttagaggctgcctctctttgtgacctttaacacacaatgctttagatctctagactaaaaaaagtgacaagtcaaaactaagaatactcggagacatgttactgaaaataaggcctgcaagaaattattttaagttaaccaacagtaacttatcaaagagtattatgtttcacattgcaggcgaaactaagaataccagcatttgttatggtgaagtttaacttcaaagtgaagtttaacttcactttgattttaagtataaacataagtgtgaatttctgccagttccttctagacttaggttatgatgtgaaattaggaacttgattgtagctgcaatcaagttcttaattgttatgaatgatgaatgtttgcaaagtttccaatctttgcagagatgtgctattctggcttacaggagtatctttctaattagtaggtggatatgtacttatatgcatgtgcacgcatatgagagagaaatacttttctcagttaatgtgcttctgattatatacatcttgtgagatttcatacaattgaaaattagctagaaagaacaataatactgagttttcttcataacacatttccataatgcctgttccattacttttgttatttacatatttgaacttattattattaaattggattatcttatgatttttttaataagtggatattccaactcttggctcacaaaattacagttggtaaataatttcttcaaggaattttaatattgataaattacttatttcaaatgaattcacttaatatcatttttattttcttatgaattttctaataaaaacatatttttcatttcttcctctcttttttcaactcaatgtcttttttaaaaatgacagtaatgtgtggttataattatgcattttttccaggtgctcaatggcccttatgtctcttttaaaaaaacttttatttattgtgggttttctccccaaagcagaagttagtccaatacacatggcatagaaatttcacaattaggcaattaaactagaagtataacagctgacatgtgttcaaagtaataaagttccaaaattagaaggtgaatcaaattaacataaaggcattattaactttttctaggaggcgtgagtttgcaaaagtcttgggtaatttgatttgcttattctcaaaatagccactgaaccttgagtgacattgcgtttcaaaggtgggagccagagggaaggtcactgttagtgttggagtggcaaagaggaggtttaactttcaaatcatctagggtaatgcctgctactctattttgagacttttagctagatggcaagaagtttttttttttttgatgggaatcagaaagttaaataattcctgaatttggaacttcaggtggtttttaaaccttctccttgttttatagtttcctctgttgtttataccttcctaacattcaaatgataaagttattttcatttttaaaagaaacaaatccaaataataatcccattatgtgggattgttgactctaagcattgtgttttcttaatataccaattacatgctaatgggctttttaaaaatctatacaggaacattttaagattgaatgaatgagcatgccatttccattacaagctgctagactgcagtttcacagactactgatgtggatctgagggcagttcctcaaattaatatggtagatccacagttttgaaaggcaattttcattttatataacttctggcatgttcttaaaaagaattacacacacaccttttaagtggttcccccagtgtggctgctattcattttgttgtcatccttggtattcaggtctggcctagtcccttcataatgtattacccctgtcgcttttgctttcttgcccttcctatgagctcctgctctcttttctggtgcttaggtggggcagcacttttcttgttgcatatggatagagtcagccctgcctctggcccctcccaaaggacatgctgtatcacctgccccagcagcttctgtggtaggcccacagtgcttccattttgtgattgttgccactggcctccgtctgaatttgtttcactgccctagccatgtgtggacatccagatgttgcatccttggtgttcatgtggaacaaccaatgcttcctgataccaaggaagccagggctttctgcagcttcccttctttgacatgaaaaacagaggtggatagggaaacttgaaatcactagtccatttttgtccagagctggcagaaaatttgggttggccagatataactttatttcctttggggtcatagccaaacttgattttctttaatacatcaattttcaaaacatgttattttatttttatatacttattaatgttgaatagttcatgtatacatacagataaaaaattcaaatggtcttaaacaatatgtgcttttattaaaggtctcattctcatctctagtcctgagtctaccattttacttacccagagacaagtgatagcaatgtcttgcatacatttccattcttcctgcgttattgtatgcatttataagcatgcacgtttctgaatctatatgtataccacttttgtacaaattatactgcataatttgtatacaatttcttatacttaacataccttggagatagttttatatctctgggtgtacatatgcttcctttgttttagcttttgtttttaagggttttatagtgttccattatatggagattaattataaaatagtgatcccttaatttgtttaacctgtcctctactgatggctatttctgttgcttaggatcctttactttggatcaagggctggcaaacatcttctgtaagggataaatagtgaatattttagactttgcaggccttgtggtctctgttgaaactgcttcactctgtattacaataacagccataaactatacgtagctatgttccaattaaactttgtttataaaaacaggctgcagtccaggtgtggcccctgccctagatgttcagttttgagagactgtcatgcaaaaagtgtttgtgactggcctgcagaaagtgcttaacagatagctgttatttgattgatgggtaatttgtctggaaatttgtcattagaataaggagaatgctaaacagtaaaagatttgaaaaatacatttgtatcaaaaaagaggtatggaaaatagaaaatgcatgactttaggagcatttgactttctggtgtttaaaaaattgtttaagatgacgctttgacttcttttcaaagtgtagtaagcaggaataagaaaattggaggaaggattatctacctctttgtagcactaccaacctttgaaattttgcttcctgctccagtctgactagtaaactcagattcacccacaaaactgggtatggtaacatagctcatggttattaaagccgtttggttttgcatgatgagtgtattttgttgaaaatgtgtgtcaaccttatgatgtccacatacaaatgtcctacataggcttttccctccttctggggttctagagaacacatgaaagtacttctcctttcattaaacactaaacttgatgcttttaaattctttgacgttctgtattagagatgagtaaactaaggcctgcaggccaaattcaacctgctgcttatttttggaaataaggttttattggaacacagtcatatgcatttgtttacacattacctgtggcttccttcatgttacaacagacaacttgggtaactgaaatagagaatatagaactcatgataatgaacatttactgaccctttatggaaaaaaatcttttcaacccgtctttttgattgcactatttttccctcaactttgagaatcgggtgctctcttctctgaagttgtagggaatctattattatttttttagcatggagaacttgcaatcagcatgtttcttagcttttaaagaacaggcatggttgttcggttgatttatcttttcaatatagtgaattcctactttattattattattattattattattattattattttgagaccgagtctcactctgtcgcccaggctggagtgcagtggcgcgatctcggctcactgcaagctccgcctcctgggttcacaccattctcctgcctcagcctcccgagtagctgggattacaggcacccaccaccatgcctggctactttttttgtatttttagtagagatggggtttcaccgtgttagccgggatggtcttgatctcctgacctcgtgatccaccctcctcggcctcccaaagtgctgggattacaggcgtgagccaccgcgcccggccctcctactttatttgttgaacagacagttattaaactgcctcttaaatagttattaaacctgttatgttcaagcctgggaatacaaaggcaaattatattgatttcctgtttgggaaaaaacttgggggccaatgattgacatagataaataaatcagtgattataagggtaacagagatatgaaggaactgttatgggaggaggaaccctccatattatcccggaggacaacaaaggcttgctggtgcagaaaggtgacattttgaaggataacaaggaattggacaaacaaggaagaacacattccaggcaggcagaaggtacactaagcatgtacaaagatgctgagatcttaaacagctttaaacagcttgaggtagtggaagaagcagtgacagtaaaaaaatgggcctcatcatgaaagaccaagtgcatcgatgatgtaagaggtgaaagtggcattgcttctcccttccataccaccacccagccaccagggggccatgacctagagattgctggaacatgaaggactctgatgttctggaggaggtgttgccatctctgatccctttaaaggaaggactaataaagatctgtcgctatagctgaaaaatagctgtggacagggcagacaagtggacaagcagaagcggaacaaaagttcccgataaattcccaaagcagttaactgtagtagagggaatttacgtgacttaactgtagaattctccataaggggagctgcttcatgcaactgcgtaaaatttgtccttttttttttttttttttttttttttttttttttgagatggaatcttgctcttgtcgcccaggctggagtgccttggcatgatctcggctcactgcgaactccgcctcccggattcaagagattctcctgcctcagcctctcaagtatctgagattacaagcgtccaccactactcccagctaatttttgtatttttagtagagacagggtttcaccatgttggccaggctggtctcgaactcctgacctcgtgatccgcccacctcggcctcccaaagtgctgggattacaggcatgagccaccacacctggcaaaatttctcctttttaaactgtacctacagctctttatcttagtgcaactaaagttgataaagtcttcatgatcctttgcagcctagttcaagttaaaaccaagagagaagaaaacaaaagcaaattaagcccattcctttgccaagaagaagtgttacttgatttttatttgcatcctcaatgttccttggaaaataacatgatgtttggcgatgttcaaatgcctgttgacaatcctccgacatcattttctgtttccattgcctcactcagcacaagggctctcataagctttccagtcaacgatgaagcccagatgttatggataagccacagacttttgggggaaactaagcaaacaccaataataaataatgccttgaggacatactacagctcctctctaagtatcgtgatggtcaggcttcatcatttcccaagcagattgcttggattttaattttggcagcaaataacatggagcgtgtgggtttgtaaatggtagctctgtcccaataattccagatgatggggccattccagctttctttaacttagagatttgagcatgcattgtggtaggtctactcaccgtatctgtctagaatgattcagagaggccactcctgggctgagttacttctcatacatatatataattggaggccacattagcctgcagtataactttggaattaagatttgctcaaaaccaaggctgagtttgattaataggttgtaagttagaaacttcctttcttgtgttctgatcccaaattcctactttatattgtggcacctataaaattgtcctagctaaggatgacttgatggtacctaacgtgagactggtttatggatgaagttctttgtgcttacagggttttttcctgataattaacactgggatgaatcgcaagacccatctttgcaaaaggcagtttcttttcttatttttagaggattgttcctgaaatgattttgttcatgttttggctcctgtaatatctctattcatttttttcatggaattttttctttgggtctttttcttcataattttttttttttgcctttcagaaaacacaacacaaaacaaaaaaaaagaaacaaatggttaaaattcaagggattgttgtagctctgagggtaaaacgtgcagcctgttggtgtcatttgttactcatacaaactcttagtattttatttctgttgcagcattggggttgctatctttctcatcatgagtaatctagcattcatgctgcattctattcatagctgtcatactgtctctgacagggtgttttcaaaactttgatctgcttccagaaaagacttttacatgggtgataggatttatggaggaaattttcaactgaataccaggtattaccttcttggaaagagcaaagcatcaaacgtgaatatctcctttttcttcttcctctcctcttcttcctcttcattttaattttatcgaagctcagtttttagtaactttatgtttcctttttattactgtatctttgtactcttcaatagcagtgtccaaggggtagaaatttgattgttgtggtaggggaagaagcaggaaaaactacatatttcaacaaaggtttgtctgactctgagcaagttattggggtacagacatggataagacatagtctctgtccttggaaatttcagaacctagtagggagacagttacataaacagaaaatataacataggaaggaatgaacaggatattctagaaataccaaaggctctgaaagtagggtgatttctacttttaaagaggtaatttaggttctgaaattaaattcctgaaaataagggccaccctagaaccttaccataacaaaattagctacagttagttatgctaatagtaacctctttcctgtctcgaggaactccttttctttattccacaaagagcctcaccttcatggaagatccaaaacaagaaactgtaagtctggttttgactgttggtcttttaaagaaactctgtaatcggcaaagaatgggtccattgcaggaagttgtccaactggatgttaactagtcagatagcagccttgctggggtatagcacaagttggccaattcgcactggcacatagcctggcctcttgggtcttccttgtaactcaaatcactttgcaagccctggtagtttcacgaaagtcagatgtacccttaactcttaccccatacactcatctatcctggaaagaaaaagttgttggatcttggcccactactcaggaaagtgtattgaccacaggttgtatagttaagtaacagcattttgaggaggatgataatgatagtgatgatggtgatgatgatgataacaacattgatggtgctgctgttgctggtgtgcttaatgataaggatatgtgattataatagggtaggaactatatcttatccttttatacctagtatttggcgcagagtagggatttcagaaagtttgtttgttgtggatggagtgagcagttagagtttcccacttaaaacctgacacagagcatgccatcccacttactcaacaccctccagtgaacttccgtttcatcagcatcaccctgtgttgacctatgtattctggctctcctctgatgttactctggtctcatctcttatcactccccagagactggcttctttgtttttcttcaaacacatgcacgttcccatgtggaggtctctgcgtacgctcttccctctgcctggaatgctttcccccaaatatcactgtggctcatttttgttgttgttgtttttgagatggagtcttgctctgttgcccaggctggagtgcagtggcatgatcttggctcactgcaacctccacctcccaggttcaagagattctcccacctcagcctccccagtagctgggggcccaccaccactcctggctaatttttttgtatttttagtagaaacggggtttcaccatattggccggctggtctcaaactcctgaattcaagtgatctgcccaccttggcctctcaaagtgctgggattacaggtgtgagccacgacgccctgtcccaatgtggctcactttttagctttctcagttctctgcttaaatgtccgcttctcagagaggcctcccctgaccactgtgcacccctctctccctcccatgtccctttatccagctttatttttctttgcaatatttacgtattaagcattatttgtgtatttgtggcctatctctgctcactccatctcgactgaatctaagctacatgaggactacctcctttgttttcatcataggcatttccctagaacctagaacagtgcatggcatataggcatacctctgtaaatattgttgaattaatttgaaatgagttaatgaattgcttataccatcagaagacacatttcatgaactggcatgtatttcaggtatctttctaggtttgtctttcttatcaccctcttggttgtgtgagccccttcagaacagagatcctatcagatgtgttttgttgtcccaaaaggagcccagcacaaccccattcacacagtagttgttcagtaaatgcttattcattggtagattgtctcaaaggttcccacttaggagtattgcttttcttttttgctctgcttcaccacatttttcagtcactctgttttccttcctgcgttttgacactttatcaaactgtactttttcactgtagacatctatggggggagagattatacaagagtatttttatttccactctcaaatacatgtggtggattcaggtttaattttgtattattcataccactgcaccaaagaccaactaccaagaaaactgtaaaaaccagagaatatattttctattcttgatgaaataaaggttctgtatgagaaaccaaatttctaacttcaaaagatttaataggttgattcttttttaaaattgacacataatatttgttcatatttaggaggtacatgtcatattttgttacatgcatagagtgagcaatgatttagtcagggtatttagggtatccatcacctcgagcatttatgatctctatgtgttgggaatatttcaaatcttttcttctagcagttttgaaatatacaatacattgtggttaactatggtcaccgtactctgctatcgaaccttagaacttattctctctatctaactgtatgtttgcacacatgaaccaacctctcttcatctcacctccacccacacttcctaggctctggttactattattctactctctgcctccataaaatacactttctaagctcccacatgtgagtgagaacatgtggtatttctctttccgtgcgtggcatatttcacttaacactatgacctccagttatatccatgttactgcaaatgatgggatttcattctttttttatggtggaatggtattccattgtgtatattatacagcacattttctttatccattcattgaacaggatgattcttaaaagcaacttccagctgattacatttaggcaaatacatttaaacatttgctgtggtttttagcatgttagtagcttttgaatatagtacattctgcctactcaatgcccttgaaatgtctttctgaaatagttaaattcatgttggtattcacactggactctgtatcactgcctcccttacccaaaggagtttgactagttacttgctagttgaaaccagcttggtacaagctgacacatttttcaagaaatagttgtgtaatacatgttgatattctttgttcttcctttccttattcatccatttggctcctttcttctttccctgactctattccttcccccttgactttttggaagccattatcgctttagtaaacttaatggtgaattgcttcaagagtaaaaatgctctgcttttcaaattagaaaaggactatttcctgtattcttggggatctcattctctcatagctcttatttaaaacgttctggccaggtgcaagcactcatgcctgtaatcccagcaatttgggaggccgaggcaggcagattgcttgagtccagaagttcgagaaaagcctgggcaacatggtgagacctcctgtctaaaaaaaaatacaaaaattagctgggcatggtggcgcacgcctgtagttccagctgctcaggaggctgaggtcagaggatcgcttgagcccaggaggttgaggctacagtgagacatgattgcagcactgcattccagcctgggtgatagagtgacaccctgtctcaaaaaaaaaaaaaaaatgttctaagcaacgattttgtttatttgttcaagattggattttctacacatttaagcctgatttatcacaaataaagcactttctcacaaaatatattctcagctaattattattttcattagtagcactgtcctaactttataacacataaagttcccctggtcttgtttttaacgtcttgacatatgtatacatttttgaatgactaaatcaagctaattaacatatgcattacctcacatacttatcttgttttgtggtaagaacacttaatatctactctcttagctattttcaagtgtacaatacactgttattaactgtggtcaccatgttgtaccatagagctcttgaacttattcctcctaactgaaattttgtatcctttgaccaacatcttccaatcctccctctccatctccagcccctatcaaccaccattctactctctgcttctatgagtttgccttttttagatttcacatataaattgatatcatatggcatttgtcgttctgtgcctggtttgtttcactaaacataatgaattccaggttcatctgtgttgttgcaaatggtaggatttctttcttttttaaggctgaacagtatgccattgtgtgtgtgtgtgtgtgtgtgtctatatatatatatatatatatatatatatatatatatatatatatggcacattttctttatcagttcatccactgatggaactttaggttgattccatatcttggctctcgtgaatactaccacagtgaacatgggagtgcagatatttgacatgctgatttcatttcctttggatatatactcagtagtgggattgctggattatatggtagttctatttctaatttattgaggaacttccatactgttttccatattggctgttcaaagttacattctcaccaatagtgtaccaggcttcctttgtctccacatcctctccagcacttcttatgtttcatatttttgataaccattctaacaggtgtgaggtgatgtctcattgtagttttgatttgcatttctctgatgactagttatattgagtatgtttttcatatattgaaaaaaatattgaccatttgatgttttcttttgagaaatgccaattcaggtattttgcccatgttttaaatgggttgtttattttcttactattgagttgttttagttccttataccttttctaggtttttgtttcatctatgctgtcttctcgtacagctcattgtatttgtttgctaaggctgctgtaatgaagcagcacaaactgagtggcttaaacaaatgtattgatccacagttctggaggttagaagtcttagatcaaggtgtcagcaaggttggttccttctgaaggctgtgggggagaatctattctaagtctctctcctagttttaatggtttgctggcaatctttggcatcatttagcttgtagatgcatcaccctaatctctaccttcatcttcacatggcattctttctatgtgtgtatctctctgtctgtccaaacttccctatttcacaaggacaccagacatattggattaggacccactctaatgacatcattttaacttgattacttctgtttattccctatctccacataaggtcacatttcaaagtagtgggggtaaggactccaacatatcttttttttggagacacaattcatcccataacactcatcttctgaaatgtcaaactctggagttagtaaaaccaacaaaagtgttcattgcagcattattaacatgggttaataatgggttctctggtttatcaaatgtttaactttgactctttagatatagtaaaactttaactgagtagggtgagaggttctaacagatggaattttctaatttgctggcaattagcctgtagatgactatgcgagatgtcagctctggttccttcagtagaatatacataatagaaattttgatgattaacaatccttctatttagtattcatcctaacctcagactcttcatttcatttcatgagcctgcctacccattatggcaaagtgaagacactgtgatgttgtccatgacatttatgttgttcccaagtcacccttgtgttgtccatgacttttatctcactcctttcttccttgttctaaccactcctccagttcccgaatcttgcttctctcccctacttttgtacatttgtatttgttctgtagatttttttactcaatgccccctaaagaatttatcttagatatgctctactggctgttcctgattcaaatcaaactgatgaatgggccatcctaactagtccttttgacatcagtcaccacaccaatgagtccactcaccagcacacaaactgggcccccttagtttatccacaaagtggagaatttgacaagataatatactgtcctctcatgatatgtattgtgagatgccctcttaagagactttccaagtggctagtctctacctcatctgattacattaacatgcagttattccaatgatcttcctaatgtgtaattctgaaaagcaacttgcattcaaaatccatcaaggcccctccctccattgcccattcaatgaatgcattcttcagactgacatcttaccttcacatacctacctactagagctccaaacaagtagttctcagccttggttgacattgaattacctcaggagatttagaaactaaagatgcctgagccacacccaagataatctaatttaattggtctggagtgtggtctatgcatcaggatttttaaaagttccaatattcagtcagggttgagaactacttgtttagagcaacatgtctccaatcttaatgtgtgcagtaattgtcttattcaaatacacattcttattcagcaggtctggggccagccaaggttcctgtattttttataaccagtgatttttttggtccacactttgcataacagggtgataaacggagctctgtcaggtccgggaccacatttttctcatctttctgtctctaaagtatagtgtagaagctcttagcaaatgtttgaaatcaaattaaattacagcctttccccaactttccaacctttttctctgcatattgaagtccatataagcataggcttatctctttttgaagcctatccctagccacaaccagaaggccaatgttttttactcattcattcaaccaacattttctaagtgccctttatggcctgttaccaagcattctgtagataataaaatgtaatttccacctcaaatttgcatgccctaacaggggattatcctcttggtgtgtgcttcacagattaccagtgctacacaaccaggtgttttgttttaatatgctttaccttcgtaaaatacaaagttcaacacttgggtgtctctgcaatgtcaagttgctataaacgtttctaaacagtgctctcaaattctctccttgtaaaatggcagtaagtaattttcagatcatgttggttcatggactacactttgagtactgctttttcagggcctttccagacaaagtggagtctgtagaccagcagcatcagcatccttgaaagcttctgagaaatgcagaagcttggatctcatcacaggcctactgaatcagaatctgcatttctaggtgatttgtgtgcacattacagactgagaagcacagctccagggcagtggctctaaaccttggctgcatattagattcacccctggggcttctaaaaattctgctttccttcttttgagaattgtctattcagatcctatttgtttttgttgttgttgagttgagctctttttatatcgtggatgttagtccttcattggatgaatagtttgcaagtattttatcccattctacaggttgtctcttcactctgttgattgtttcccttgctgtgaagaggctttttagtttattatagttcccttagcctgtttttgtttctgttgcctctgtttttgatgtcttagccatacaatttttatggaattacttaaggctaatagaattagctgaaagtagtttccaaatgtgcatctctaccccttgctttgcaaccttctgaaaaccagacaatactctgatgtaatttgggaaagaagatatattagtttaggcctaacgtcttaatgtcctgaagaacttccctgtgttttcttctagtagttttatggttttggatcttatgtttaactattcaatgcattttgagtttatttttgtatatggtgataaataggggtctagttttattcttctacatatatagtacatatacacaataaaatgcttttcagccggctgggcacagtggctcatgcccgtaattccagcactttgggaggctgaggcaggtggatcacctgaggtcaggagtttgagaccagcctggtcaacatggtgaaaccccgtctccactaaaaatacaaaaattagctgggtgtggtggtgcatgcctgtaatcccagctactcgggaggctgaggcaggagaatcacttgaacccgggaggcagaggttgcagtgagctgagatcacgtcgctgcactacagcctagagtgagactctatctcaataaaaaaaaaaaagaaatacttttcagccataagaaagtgaaattctgtctttcttggcaatacggatgagcctggctgacattatgttaagcaagataagtcagacacaacaagataaatactggatgttctcactcagatgtggcagctaaaaaaattttgagccaaaggaagtaaagagtagaattgtgggtattagaggtagagaaggtcagaagggaggggaggatggggagagactggttaatgaatacaaacttacatctagataggaggaattagttctggtgttctagcactgtagggtgaatatggttgactataacttattgtatatgtcaaaaaactaggagagaggattttgaatgttcacaacacaaacgataaatgtttgaggcaggagatatgctaattaccttgatttgatcattacacattgtatatattataaaaatactctgtatcccataaatatgtagaattgttacatgtcaactaaacacaaaaggaaaaataattctgctgcacaagctatgtcccaatgaattaaactaaaaatctctgggggtggtccccagtcatcagtatttttttttttacagctctccaggtgactctagcatgcagcccagagtgggaaccagcactaagtcagcccagtgtccatagagtcccagaaagtggccagccattgctctaaccttcaaatcagctcaggttctcagatactcatttattactccattcccttcacttaggaaactcaggaccacagctaaggtattccttagggggtatttaaagaggactgcttagatcagtggttcctcaccttttgttccacagcagttcctgaaattggatgggtgcatctttaaagtgcagttgcagggcctgtgccttttttattgaggtggagcaattattgtgaccctgttctgctcagtaagacataaagaaaatatgctgggtggctttctccctgagagaggagcacagaaatagaaatattattagaaacagaattagaaatagatagaggtccacttcatgactgctcaactggactttttagggtctcaatttctacttgtgtaagctcagattgctcagtgggccaattagtgaatcccagagaagggactagagaacagacctcgtttggaaatactctattatcgtatttcaaatgtgggccatggactagcaacatcagcaccatctaggagataattagaaatgcagaatctcaggccccaaccagatctgtgaaatcaacaatgttcccaagtgatcgctatgcacattcaaatttaagaagtggtggtctctaagaggcagaatatattttttctcaaactacttttcagttcccctgttttccttctgctgtcatggaagatgagcttgccacaaagggaagctatgaagaatctagcacattcttcccttggaaattcaaacacccatttccacactgcagtggaagtgttgtgacatgttctattggaaaaccactacctacatgccatcatatggagccataaactatttttaggttttctggacaggccaaagattctgctgcccaaatgattccaaagaacgtgaggctgatgtgtctcagattttcttgtaattcttgcatttctaaaaatatcttgggtgtttgatgttgagttcagccctgttttactaacaagcgaagcctttgtatttactgtctcatttggtaggttattttctccctttttatttccagtgacatgtcatgtttcctgatactgatttatcagagaagtagaacaagaaattgattcaacatgcataatattttattgaatgaccatctccatgtaaaatttttcttggagtttgaagtggggaagaatgttggatatagacctggaaaagagaaggtatggtggaagttcaagtttcctcatttttgttagaggagtttgaaagctgccagcaagtgtttaacaaataagaaggcagccacctgagatagtctattgagataggaagagtgattgtagaagacaaacagcaacccatggtccttcaaagaaaaaaaatggcatgggcaggaattacttaagtctaatagaattagctgaaagtagtttccaaatgtacatctttaccccttgctttgcaaccttctgaaaaccagagaacactctgatggaatttgggaaagaagatatgtgagtttaggcttaatactttcctagtctttattattatattttacaggaatttcataatatatattttaaagattcttactaccatgattaaattctgcccagtatgatgatcaaaaagggcttactgaatggagaaagacatttgtgtaacacctagcagtcatttattgcaaagccaataagcgccaggcattagggatataggtataaataatgtcccagcataaaaggcaaatatatatttatttgccaaatatatatatatatatgttttactttatacatatttttcaggagttcacagaaaacaatgaaataacccttaaatcatagttcatttcttaattttcccagtaggagaaggctcatttttcatgtttttctttattattttgaaggcaggacttcaaaaaggaataaaaacagaaggtcaattgcagggcaaatcacagcggctccgttcttgcatatccagatgggcatcaccctcgtttaccttcctaaattgggaagctttacatcctttcacaaaaacatgatccataattattttgttgcagttcacttttttaaactggtagaaagcatgctgttaatgtgatagtaagtacttactctgtgaataataaaattattaacatttcaagcctgcattttggggagttaccttgagcccacattgtgccactcttaaacacatcagtgcatgcagtctttggggcagctccctgaactaactctcttgttgtcattttagagatgttgagattaaggtttagggtatagttttctccaaatctcagctataaataaaggatagagtgaggatgtctgcctgacttctatgcttaagcttctaaatgttgccttgcatgctgtctgttttgtgatctgagagtcatagtttatctgctattttgaagcacaaattattttttttaagaaagcctgatagctttatctgagaggattagctcctactatgcaaaaccttgaagggaataaattatgggaataaactagacagctacctgaatgtttgtattttagatttcaaggttattgaaagtactagagatatacctcagtctaatgtttgcaaataagaagcacaatatctccttgaagtcaagatttttgaaaggcgttattacttggtaaattaaacattagcttgccaaatagattttttcttattctggagaattacataatagaatcatgggtattttgtacttgccaagaatcacttcttgtaccatgtagaacactcctgactccctgcccctcatcattgtatagctgaaaaaatcagagaaggaaaggcacatgccccaggtcacacaacttgctggtgtctgaaatgagtgaaacctgagaggttgtctagtccacactgcaatggatctccagctgaacgttaaacataattatgaactatctacatattttttgtaggaagtttcagagtgatgagatcatttcttcaaaggttttgtttgtttgtttgagataatgttttaatttctgacaaatagcgttggccctattagaagacttgcgttatgtaagtctagcataaaatatttatcatatccttcatttgctaaaatgtttgatcttcttaccactgcatcaaaacaggctgggttctgaaaggctgatggagagtcaatttattcgcaagaaagaaatcacacgattcaagtgacccaagatgtcagtgtgaaattaaattccaccagagaactgatgatactgagattgacccttgcttgaaacaaataagatgaaccatgaagtgaacctcattccaaacatggcatcaacaaacataaatgaagacctaaaaagtgacttgttttgggtgccagatttttcaacctcaaaactgaagtggttgtgaagccaatttcaaaatgacaggcataacccaacctttagggtttattggaaacttgattatgttcttaaggcctctcagatttttggcatggtttaaacatttgcctctctgtcctacatatgataaatctgtggcttttggctaaagtctggcctgtggaactttacccatgtgtgaatctcaagctttcaaacatgttgcattcttctaaataaacattgggccactaggcatctgctgttaatgtagatcctgtagtcatgcattgttttttatcatttcattcattatttctcttcatcttttactgagcattatccattacatgggcaacatacctttcacatgttctgtgtttcgctttccgtgtgtcatgattatcccaaatgcctaaaaacaattgaaccagcctagatataagaaagggggccatagggagccttaagagtgaagataccttctaaataatcaaaagttgaattacacttgatatggctttagcattaagtcaatttccttgtacacttgttcttacaaaattgggtaatcaatctataacaagtatctgttcttaatgccttgctgtgttactcagagaatcttgactttaacagaatattttaaaaattcagcaaattaacaaaataagcactagaatgtaaaactctttctgtccctctttctacacacacatacatacacatttgcagttgtttacaaggtgtctgggctatgcacatcgcatgctgtttaggagtataggctttagagtcagacagtctcgggtccaaactcagctttgtctagtggcaatgtcacttgttgccactggcaggttcccatcctcatgaaagcaaccaagaggggaggataatacttaccttttggagtttttatggtctcagtgagctaatttcagcaaaatacctttgcattgtctaaactggggtctctcaacttcagcactattgacattaggaactggataattctttgtggtggtggtggtggctgttgcatgcattgaagatgtttagcagcatccatggcctccaaccactagatgccagtagcatgctcctcccctctgaattgtgacaactaaaaatgtcccatgacattgccgaatgtcccctgttgggcaaaattgcccctggttgagaactattgttctaaaattatacaaaataacctctttttgctaaagcaaaataattgttagacattctaagactcagaagagaaggaaacttgaaatgaatcaagccactaaggacatttgaactgagaggttacatagaacagaagctctaaggggaccccaagcatccccatctaaatttccttctctcctaaagttccattggtatctgcaataaatcaacattttttgtaaaatccacttgctccatttctcaaatcattgcttcatctctcatttgtgaagctattgtgtttgattactcccaaatacaattttttttcctacccaaaggagacccttcccactctgcatcctaaagtgtctgggtgtcgactcatggtcagtaaggtggttgctatgtagattaatgtgcgctagctgatattttggtttgctctcctggcctattttgtcaagcttggagggttttctaactttgcaacttggactcacagactcctagcctcaaagaaatattttcacaccagccttaagttcacatccaagatgtgacagattgtgtgttcttggggtggaagtgagagggaaggggaataaataaacccatttttaggaagtatagtcagcacttacgcccttccatcatgcctttctgaaggcattgcctcaaacccagacttgaagttgagcatactgcttaaattaggggattggggcaggggcatgggcatgatctacccataaaccatagatggtttcttccacccccgcattctccctcttctgactctattgaccactccctctccccaccaattctctctttttattttcttggcaccagaaaatcttttttttttctttttatcgaggtggtgtctcactttgtcacccaggctggagtgcagtggcgcgatctcggctcactgccaacctctgccacccgagttcaagcaattctcctgcctcagcctccggagtagctgggattacaggcacccaccaccacacctggctaattgttttgaattttttgtagagatggggtttcaccatgttggtcaggctgttttcaaacccctgacctcaggtgatctgcccacctcagctggcctcccaaagtgctgggattacaggtgtgagccactgcacccagctggaaatcttaagatttaattgtcttccagtgaatgagctgagagaaataggatttatttaaccagagttgtcttctcctcttgggagtgagaaaaaaaaaaaaaaaaagtagggctttgcctaaccattatttacagctgtagaaaaccaaatgcacagtctaaatctaagtaaggaaaaacacaaacacaaccttagaagatagaaatcattcacaaaaagctctgcatttgtatttcagtatgtgatgttatatgctttcagtccagttcaactgacattttgaaaccaaacgcttatacagtgtttgcagtgattttaaaaatattaatcaatgttatcctcatatcaatcctatgtagttgttattattactattatccccatttcacagataaggaaattgaggcatagataagtaacttgcctaaggtatgcagctagtagtggtggctctaggatttcacatttattgagcaatcagtaaatgtgctcagtcttgggcaacaaagacaagtaagaagccaagcagttttgtggggaagacctctgaatggttaatcctgtgatggagtggtgagtgctatgttaactgctggattaattaagcctttttaatttctatatttctgatcatttgatatccagagccttgctgatcctgaagggactgcccctcccctgggagagctagctaattcctagggatggtaaacaactcacttggaattatacctttcctatgtggaccaaccaatccagagcccataccccaaccacctcatttattgggctctcacagggctctcaaacccttgccctaatcaccccaggccaggtaccagacactagagatggaccctacaccccagagtccacttaaattattcaagctagccaatcctaagcctgctagccctgcctcacccattcctttccacacaaaccacaataaaggctcttgcccatgttttctccttgcttcctctttcccctgaccagccctggtgcttccccatgtggccctatgtggtgtggcatgcctctcctcttgggaactgtgtgtaacaagctgttttcccaaaggcaattgtctactgatctgttagccccactatacctgaataataacaaaacttacatttagaaacatttgcgtgcctgtggagccccatgcaggcactcaggagacaagtacagctggacgctgttttcaagctgctcacagctgtgctgtactgggccacaaaatgcaattcttctgccatggttggtgcacagcagctgtttggctccccactggcctggtctgtgtaagtgtaacagatgacttccatgccgttcttaaattacagcccagagaaatcagttggtttaaatagtctcacttatggactacttccaacgccctatgattgctttgtcccttctttatttgaaggttcaccatgttcttctttacagaagtacactatgttcttctatagaattttctgcatattctctcaagccttcttggtgccaataagccatcttcaacaatgaaagccactggtggctgctgggtaggagttggtcacctttggagatcccaaagagggatctaagactctctcaagctggggggacatcaaaatgaccagctatttggccaaggaaagacagttatctgtcctatgggtaattttgcttgtggaactctgctctctaccccaaaggtgaccatttgccatgattattgaaaagaggattccagatctgggcgaacaaatgaaatttgaggtttcttatagcatgggaccccctcctcctcctattagctgctctgtaaagctgaagtattgctcctcatggtaacttttcttatttaaaccttttcaatattgcacttgttgaggtttttttttttttttcttttcctttttttcttttttgacagagtcttgctctgtcacccaggctagagtgcagtggcgtgatctcggctcactgcaacctccaccttctgagttcaagtgattctcctgcctcagcctcctgagtagctgggattacaggtgcctgccaccatgcctggctaatttttgtatttttagtacagacggggtttcaccatcttggccaggctggtcttgaactcctgacctcatgatccgcctacctcggcctccctaagtgctgagattacaggcatgagccaccgtacccagcctgaggtttgttttgttttgttttgttttgtttcactttttgtccctggataaccaatgagattaggggcttattaatctcctctggctagttatctccattaagcttattgattttcattctaaataggttcaaaagagctgtttatagacttaactaaaggcttaatggctggcgatttggaggtctgtatcctttgccagagtgaggataaagtcacattcctttttctattcccaacccctcctaaaacagtgggaggccgtagttaggcactccactaacatttattgaatgtgggtattttctgatgttggatcgcttaggctagttcagaagtgggagctgtggtctgggtctctgtgaaacatctcctgagaggatgagaaaaagctgtttactctcgagtgtctgagtttatgcccatgtggatggttagcgggtctgtcattcagcagggtaggcaactctgcagaatgccatggaaattacctttcttgaaatccatggaacaattttaagttgaaatcacagtaatgaaacaaagctgttatggggatggtgtcaagaaagttcagtcatattccaaagtcctctcaatttgcatttgaagggtggtgcattaattgtctcaatggctcatttctcagacagttgaatgataaattgttagaactatagcagtggttctcaaccaagaaagatattgcattgtctggagacatttttgattgtcataacttggggaatgttactatagtaacacctagtgggtagaggccagggatgctgttgaacattttaaaaggcacacagtgggccaggcacagtggctcatgcctgtaatcccatcactttgggaggccgaggcgggtggattgcttgaggccaggagttccagaccagcctggccaatatggagaaacaccatctctactaaaaatacaaaaaaattagccacgcgtggtggcacacacctgtagtcccacctacttgggaggctgagacgtgagaatcccttgaacccaggaggcagaggttgcagtgaattgagatcacgccactgcagctgcactccagcctgggtgacagaacgataccctgtctcaaaaaaaaaaaaaaaaaccacacacacacacacacacagtggtccccacaataaaaagttttctggccccaaatgtcaatagtgccaaggttgagaaatcttgatctttattaatctaacatctggattagtttcaattaatctatgctgaaaaaataagtgttcagaatctaagaaatggagaaaatgattaattaaaaatgaagtaccttaatatttttaaaattagaagcatttagacattcagtatttggtttttattgtacacattataggagttaattctttattaaattgagaaaaaaattataaaaatattgagttcttcctgaaatctgcataaagaaaagagccattctgggtcttctctgtgagtaattgaatttttggggtacagcttgtgttagttactcttctcctaaagatacattttatagacaggtgctcagccataaagggccaggaaaatcaaagaaaatataatttaaggtcttaaagtccctttttattatcagatttcactgagtgtgggcacatgaaacatgagtccatgatcttctgatagtttcagatgtctcagattagaagatggaaatgactgattgtttttctcaaatgatctctaagatcaatgagccagtccaatgtacatattcaatatttaaaaagatcaaaagttgctgttatcatgatatagttgatttttgtttctcttgtttgtacactttgggccatagagaagctataagagacaactctgtatcttttagaaatgagcatatatttacaaggagaaaagcctttttatgtcacaaaggatactagtatatttatcaatttctaggcctttaaagtgatgtctttagtcctgcagttttcaaagtatggtctgaggaactattgggtttttttttttattcccaggagttccttgaggtcaaaattattttaataataatatgaagatattgtttgtgttttttaattctcattctctcaagagtgtgccataagagttttccagagaccacatggtgtgcaatgaatatcatgctgatagctaatagaatgtgttcttgtgttttaaaactttctcagttttaattcctaattcaataaatagcaatagataaaactcacataaacacaagcttttggaacttccaataatttatgagtgtaacggggtcctgagaccagaaagttatgagaactactgctttagtgattgacagagaaaatgaatcaagttgaacaaaagttcagaacttgggatatttcaaataccatggctaataacataagccagcatcatcttttattgctttgtagatattagagacacgaaaaacccttggattctgtgccagagcttaaaagaactagaagcaattgtttctgagttcttgtttcaaatccagtgtctgatttggagttgtgtaatctctgtgccgttgacattttgggcagggtaattctttgctgagaggagctgtcctgtgcattgtagaatgttcacaacaaccttggtctctgcccacttgataccagtaggaacctcagttgcaacaactaaaaatgtctcaagacattgccacatgttccctggctggcaagtcacccagttgagaaccactgtctcttaaggcaaagtatctgttgtcgcgacaggacgtttctgattccctctcattgtttagaatttattcacatagccattcctaattgtaaataggctgggttatctaatatttattctagatgggtatatgccagctaaaattggatgttgtattactgtgacagaagaagagaacaagtattgagggacagctcccagttttcatcatgtgtggaaagagaatctatgcttgaaatatttgtgatggtgatagcacattctatcaagtctaggaaaacaagtcactggattttactgaagtatttaggtgtaaaaaattgaaggcccttccgtgaaaaagttctaattggtaatttcattttatgcaaacccctattatgttattatttgagagagttcaagcgtactttttatccttggtaaatattacacagtaaaaaattcaaatatcagagacaatacaaaaataattgtacaggctctttgctttctttagttacgtttttgtccagaaatatgtttttgtgcatattttcataccacaagttaaattatttttcaactttcattaaggttttatcgtctctcttgatggtgattgttcacaaagaaacaaaatatttatctattaaacagagtgtgatttgcatgaggttctcccagaagtagcacctgagtcaaggattcacattcaaggagtttatttggagaataaaagtagaggagcggaggtgtgagacagagaagggaggaatccaataacaggtgtactgttgagcacatttccactttaggagatgggctgcaatcccattagggaaccctataagccagtatagaatacaactcagagttatcccacccaacggacaaggacactgaggtatttatcctccaaatctcagctgctgttggctcagggcaacatccaggggcattaggtccctggcacttctggctttcctttttttccctagtcaagagaaagcttataggcagagagctgcttatgtgtgaagctggatgtcatgggatgtcctgaagcagcgagtgctgagaggacatgatggggtacctacagcatctattccaccctctacactggttggttggcttggctcactcaccagcctctggcccaccagccttgctctatgttatgttgtgggcttactaaggtcagataggcaaaggaaaatgagctgaagctggacctcaaaaggatgctgacaaaaatccttgcatgatgaataaatggtgaatgaacttcatcaatgtgatggtcaggaaaacataaacattaacaaaaatatgaagctagttttcaggagccatagcaatatagttttaaattccaacccaaaggatatctgcagagcaacaatgggaaatggaattttttgctgttgtttgctttgaacatatcacagattcctcttctctaggatgttaatcagggccatcttggatcgtacttactgtcagatgtaagccaggccactgttaatgagagactggaatgcagccccagaatcggtgtctgcttcaacacagatgggcatggggatgagagatgccgggtggttatggaatatggggaaaaaatatggtgacttaaaggagggcagaggcccttaaaacttccttttatagtacatcaaagctgttgatcattgaggagaaaaagcttaaggtgggctactgggacctgccgctttcagcaagaaggctcattattttgaggataagtaaaacaagtagcctcatgtaaggatgaagcgctcttcagtagatgttggttgagtccatatggcttgcagaacatcacattaaagtttgctgactcattccatgcaagatttaagcaattttcccaaggagacaatatggctgtctccatataaatgggaataattctagaaggtaaacattagtcagcacagagaatgatttgatgaagagatagagacttctatgggtaatgggggcagacataacacagatacatgggaagcagggtggctaaatgcaagtgtgttttaagccaacaaaggtagcagtggccatggtggaggaactggagagaggggccacttgttgataatttattcctaccagctcttattgcaataaaaagaaactatgtaataccgtatgtggttaaaaatttgaaactaataagataaaggaggatgatggtgaaatggggggaagaaaataagatggtatcagtatataaaaatgcacgctatgagatactgtctccgcactgttcaatatagtagcccttaaccccatggagctgttgggcacttgtaaggtgctgagtccacattgagatgtgctgttagggttaggtatgcacactggatttcaaagactaatatgaaaaaatgtaaactatatcattgataatttttatgtagattacatgttaaaattatgataccttggctacactgggttaaatagaatatagtttaaaatcagtttcacctgtttcttttcacttttttaatgtggctactagaaagttataaattacatagtggctctcatttgtggttcacattgtatttctgttggacagggctgttcgctaccatggcctgtaccagtggttctcaaagggggatgattttgcccccgagaagacagttggtaatgtctgaaaacatttttggttgccactgctggaggggagggatgcttctagaagccctctagtgggtagaggccagggatgtggtcaaacattctatgatgcacaggaaagcctccgccatcaagtattatccaaatgtcaatattgccaaggctgagaaactccactttacaccatagatatagggtactgggagcccaatatggaggtatagtattaacctaagtgtgagggtgtaagcatcttctctagagtgtagacagtgggacccataataacacccttcactgctcaactgcatgtcaacaggcagtacagcaagcacctgatattgatgttatttaattcccatgagagcactattgcggtaggcagcatctccattttgaatctaagtcagctgattccagcttatgggctttatcgcccacagagataagaactgtaactacttcaagtctcttgagtccatttatttctttccattgtaagggcctactatcctagataaggccacctaactagtctctagtcttgaccacttcagtcctccagttctttctccatgtcacagtgatctttccaaaaatccaaaacctttcaatatttctataattactctcaggatgcagcccacattctttatcatagtctagaaactattacttggtttcaacacatttttgtcaaggatacacaatgtattttggacaaaatatggtaagaatcacaaaatgactgcaagatgatgcatgttaatggctgtcactactagagatgcatcttgaagacaggattggtgacctttctctctgtaaacaaagacttttagggcagtattttgcttatgtgggacctgtgaacatttgggtaaaacatgtttatgcaatttaaatgattatcaaaccaacaataagtttattgaaatgagaagattttaatttgggaatttgataggaagatacatgttgtttgttatactataaatctacaaatgatcaattctttggagggagaggttctgatttgtatctttttctgtctccagcaataacgagtataaagtaggttttgatagttccaccttaattaaattacaaactttgtgatgatcctgaaatgtgtattttgaataagggatcttaagtgccacctagtggcaatgaggggatatattacacattacattacaaaatgtattagttttgaaattataaaggatcttaagtgccacctagtgggagtaaaggattatattacacaacatactacaaaatagagccgttttgaaaatgtaaatggtcttaagtgccacctagtggaaatgaggggatatattacacttattttaaaatatgttactgaaaagttgtccccttctcggtggtagccccagtatgacttaaacgctgtgaatacaaaaatggtatctccttaaaattatgcattctcatcttctttattcagtttacctgtctgtcacactgccctctggacatctaattttttaaaaaagaaattttttgtatgagttgaaacagatgaatcctgaaatctgagtgaaattttgaaactgcaagtttgtttctctcttatgtaagagtccaatgaggatatttggtggacagccttccttgtagtgacttggggatccatgctcctcccatcttgtagttcagccagactttagggcagagatcagcaaactgtttctgttaatggccagatgggaaatattttaggctttgtggactttctggtctgtgtcaaaactactcagctttgcctttgtagtgtgaaagcagctgtatacaatatgtaaatgaatgagtgtggctgtattccaataaaagtttatctttaatgctgagattggaatttgataggtttttcatgaaatagtcttctttttaatttttcttcaaccataaaaatgtaaaaaacatgattagctcacaggcagtgcaaaaccagtttgttaacacttgccctagggctttggaatccttacttccagccagaggctggagaaaggatcttgcatgggaagtttttttctaggccagcctgtaatcagtcaagcaccatcccattggccagaacacagtcacatgatcacagacagggtggagagggaataggttttggtgaacacatagcagtgtacccacagtctctaacacagtccaccctgttactttaaaaataaaattttgttattcattcatttattctttatcagttgatgccatttcttagccatgttcccttggtatttatcattacacgcacatgttcgtgaacatatccactttaagaccttgtctttaaactcggtacgtatgtataaagtgattatgatgaacataagaaatggcatcagttaataatgaatgaatggaattgtatttttaaagaaataccatgaactgtattagagattgtggctacagtgttgtgtgttcaacaaatctttctctaacctccacccacatggttgaaaacaaaggagacttcgaaccccagctcagtgtagcaccaatgcctcaatagcatccttggagcagagctcctcaaatgagaatgtgcatgtaattgtctggtaaatattaccagcacaatggggcctgagcttcagaatttttaatactggttatgctgatgttgctggactgtggaacacactttgagttgtaagaataagtgtactgagctaataagagaaaccacgtttcttcatctctgtaatcaccgatagttttgactgtaatagctgggaccccaggcagctgtctggattttggagaaaatgaggatataaagggaatgtgaactgaagctcaaagcttgggatagctatggattataataaattttaaagcaacaacttgcaaacaaatgggtattatgtatctgatgcagttcaggttttaaaaataaatcttacagccaaaaaaaaaaagaaccccctgtcattaatctaggttgacaaacatgaaagaaaagtttaggaaagaaaggaaacagagagatggggaagaggggtaaggtgagtgggtgggtggaggaatgtcttagattgactagagaaatgggttttgcttcatgggattttttcatatttccaggagagggcagccagtccccactctaaaaacaatgtaaacttttacatttgcatctaccattttcagaaagtattgtgatatacagtgattttttaaaaaacttacttctgtccattctattaaccataattggaagctcaatatatacgaagggcattaaactaagagtcaaacatctgaatttggaaggtcctttttcctagatcttagcaattctgtacctgcaggcaagttgatgaacatcctagattttttatatgtaaattagatgcagtaagactagatccgcctcctggaaggatggcagataattaatgaatattgtttgtgaaagccctgtatgaatatattaattcattcatctatccattcacttgttcagtcacacatttaagccttaacgtgttgcagtgctggatgtcgaaatacaaaatgaccgtcacacagattctgccttcaaacaacctattgctaactgaagaaaaatagtatgattatgctataattgaactgcaaagtgacagtctaataaggcttggtaggagcaccctctactgacaaccctgacctgctgtccttttctcccagtacttggcacttcactcattccattccagttacataggcctcccccagctgttcctcagactcaacaagttctctatgttttggggaatttgaatttcgttttcttgcctgaagtgtttttcccttagttatccacatggctcatgctcaaggatttttaaaaaaagatctctgctcccttgtacaattcttacagaggccactcagagtacattatctaaaatagcacctcagttactctctatttcaccctctctcagtctgcaaattaagatgtcattccctaaggcatccattgtatgcaatgaattaacttctctcgtatgtatcgagaatggtaatagctgtgcatcatccttgggaaaattgagaatatagtctgtcaaagtactttctgtgttctgtggtttagatgaagatagcaagttgagtccgtgttttactttgctttataacagttttcacttaccaaacacaatattatgaatatatttaatttgtttttctctcctttctcaccattagaacacaaactctaaaaaggtaggaaccatggtttgttcaatgttgtatctgtagcacctacaccaccatgtgccatctccagcttggcatattgtagggtaggcaatacacttttgttggatggatgagtgtgaatgacgaatgaatggatgaatgaatgttgagaatgcactcaagaggtaactcttgatctgggtcttgtaagatcagcagaattttccttggtagatggggatgggaaaggtattcagacacagtatggtttaatgccacagtcttgtaaacttgagagagccatatccaggtaaggcagtggctttctgaagtggcaaatccatacctattgtagttttcctgatttttgtccttctttggagagtattatacactgcatatacattgtattattcacaatatatttttgacagaaataagttgtatttcctgagcagacacctccacttgttgatggcctgtgtactaaggaaaatacagattttaacattagcctaaataccacataattagaaatttaatctactggggaaaatatcattaaattttcatactgcatatattactttgacttatcagagttattcttctcttattaataaaagaacaaggtgtcagtttactcactgattaaaataatcatattattccatttcaagagcctatgttttcaatagtgaaatgcatgtttaatgatctttagatccatgctactcaaagtatggtccccggaccagtgccaattcttagatagtccttgcaggtctgtaaggatatatgcaaatcaagcaagagtaaacatttagaaacttttatagaaatttggcaccataattttatatctattgaacctaatttttaaaactgggcttgtgtttcatgtgcttccctccacccctttttagtaatttattttatttttattacattttacaaaagtatgattctgcaatggattggaaacaaacaagcaaaccttgtctttcaatacaggtcatttgagaaacactgctctagagcatgattcgtgcactgcctttagtcccacaaagcctaaactatagggaacactgagaatttagcttggagtcgaactgaccttaaaccaggtgacagtgcctgttaatagtgctgatagctggcatttatcaagcacttactatgttccagacattacactaaagactcgagagatttcccttgcagcaagggcctgagaaaagtaaaagtagatgggggagagggagattgtgtgtgtgacatcagaagcacacacagatgtttcttgctctatccaacttctttcagggatagaaagtctagaatgacaaccactccactgacagttacactgatttgacatccattttcttttatttctgggttggttttagtaatgttttggtaatataagccattaagcttacacatgggtacaggaaaggctgagtttcgggttgtttgtttatgcatgcatggatgccttggagacctggtggagaacccaaaagcttaatagcggcctttgcttaaggaaacctggcctacttcacccaggggcaaagctattagtgtccagaatctgggccctgttgcataaagatcttgttgtaactggttcaattctaggagggctggggaaatatgttttttagaagccttgaaatttacaacctcattgtccattgtggtcttttcaaagcattcaaagaatctgcattgataacagtctgtggattaaaaggacaagcaacctttgctatagtttcctgcatttggaaaccctgtggaccctgctaggcaacccttttggtaaaaggtaggcagcgaaatgcaagaatcggtagaatctacacagcatctgggctaaatcagaagtatgccagaataaaaggggaatatataacatatgcccttggtaagctggacttcactagcagggcttcatctccctctgtgctgaaaggttagcaaatattttatctaaacgtgccacagaaaagcaccataggtattgtctattggtagaataaatagttcaatcaatagctcagtgtagtttaagttgaatttaataagactttggaagcagatggactaaaagaaacacagacacacacagaatttggggcccttgttctgtagcgattgctcataaaagaatgtgaatctttagactacgtttcctaaaaggaatccagccatacttatcgaaaattttaatggaatttataaaaactgaactgaaacttgtatccacaagtccttaagccttttgaccacctctgtgattaggcatattcagctaatgtaactaattgccagatttagcaaatcactcagttacatttgaatttcagaaaaacaaatatttttacagtatattccatgtggtatttataagtagatcccatgcaatgctttgaaaagaccataatgcaaaataaggttgaaaattccagggtttctaaaatcatgttttccccaacccatctagaaccatgcaatatttgggacatatttatgctaaaaatattcatttattatctgaaagtcaaatttaactgagtgacctgtattctgtctggcaaccctaatctagtgtcattgataaaaagatgtgggaacagataaaaaagatgcagcagacaattggttaattcttttttcttttcttttctttttattttttgagatggaatctcgctctgtcgcccaggctggagtgcagtggcacaatcttggctcactgcaacctccacctcccgggttcaagcaattctcctgcctcagccttccaagtagctggtactataggcgtgtgccaccacacccggctaatttttgtatttttaatagagacaaggtttcgccatgttgcccaggctggtctccaactcctgaccttgtgatccacccatctcagcctcccaaagtgctgggattacaagtgtgagccactgtgcctggcaacaattggttaattcgtatttgaaatctttatacatatatctcacttgaactttacaacactcatagaagaaggatatattaaaaagcttgttttacagatatggaaactcaggcttgaagaagttaagtcatttgtctaggttcaaacagctacttgagtcagagaggtaagattcaagatcaaatttaactctggagcctagacacttaaacatatcagtgtaatcttaagtgacatttaataatactttggaagcagatggactaaaagacacacacacacacacacacacacacacacacacacacacacacacactcctcatattagcaaagcatcattaggactaattctcctttagtgttttccaaccattatatcaatggtttctaaacttttaaattatggacacctctcctccattttaacctctcatagttagaattactaagcatggtaattttagttgtctgatataatataatgacagaaattagcaaattaatttgtcaatcaaaatgaattcatatataattttcacaacacaagtagcatctaacagcatatgaaagacagtaaaacataccttcagataaattatttattctagaaatgatgttgagtgtgcaaatagattggaggattcccttatataatttgaggctctcccactaccacctcaaagcagtcatgtcccacaagttgggaatctataaattagagaaattaaatcttagagatagacccaagatgaatgaaatttctttccctgaatgtagaaatgaacccaaaggaaaacaactactgaagctggggagaaatgcaaggtgaggggaggggagggtcagtgatttaattctcagccacagcaggtgcttctggtgtcctgcctgcttcagcctgaaggctttatactacaaacattggcaacttttgacttgatggctttctctgccacctctccctactcatgtacagctgacagtaggacagcagggaagtctggaagtggttacacctagaaagcaacacttaacacaaccagcttccttgccctttgagtgggatgactcagagtgaagctttacccaatctcccagaggcccccagaaggactaagtcccaggtgcccacagtagtcaccagctcattaatgcatttgaattggtcaccttcccttcctcgtctcactttcatcctttcccagtgcttcctgggatcttctcccaattaaactgcttgcatgcaaattcttatctcactctctgcttctgggagaactcaatgttaagaaatggactaaggaattttatatttttgaaccctgccataggtatcaataccagaaaagattagctctctgttacttttctgatcctcagtgccttgagaattagtccagccttttgaggataagcaggttggtgagcctggttaatatcagttcttcatggaggggcccatgtggttactaacaacatgggtaaatagagcctgacgtaaattaattatgcttacgtagattttttcctctgtaaattttggtcattataaataaagaattgataggtttttgtacacagtacatggtgaataactgctgtccttcagtgctccactcctagcatctttatttgggcattttctttggactgaactataaaatataaattagattaatttattggatgagaaagttgtgcaatgataaagcagaacaatgtattcactcagtcttatgccaggcagtatggggtagtaaaagcagaatttaaatgggagttgggagcctaatttctgcatggtgtgtaacacctctgagtcttattttccttatgaatcaaatgaactctaataatccattcaccaacaagtgtctatgatcttttccaccaataaaagtcccagtgtcaattgcagagttgaaaaggattgtagattatgggcagacttcaacatctcaagatttcctgctcaaccacccctggaaagagatcatgcatgcagtattgtgaatacctctgaagatgagtaagatgagtatatggtaagataggctcttcaggggacacttgacaatgtctggagacatttttggttgccaacaaccggagtcagggaagatgctagtggcattagtagatagggatgcctctaaacatcttacaatgcaggggtccccaatcctctggtcatggaccagtaccggtacatggcctgttaggaatcaggctgtacagcaggaaatgagtgatggacatatgagtgaaacttcatctgcatttacagcagctccccatcacttgtattaccgcttgagctctgcctcccatcaaatcagcagcggcattagattctcttaggagcatgaaccctattgtgaactgtgcatgcaggggagctaggtggcacatgccttatgagactctaatacctgatgatctgtcactgtctcccatcatccccagatgggaccatctacaagctcagggctcctactgattctacattacggtgagttgtataattattttattatatattacaatggaataatagaaataaggtgcacattaaatgtaatgcgcttgaatcatccagaaaccatcctcctcccctccggtccttggaaaaattgtcttctatgaaaccgctccctggtgccaagaaggttggggactgctgctatagtgcacagaacggtcccccaaagaccaagaattatccagtcccaaatgtcattggtgctaaggttagaataagacaacaaatagaccaaagcatccaatggctgaaagcaatagaaatttaatttttgcatccataacaatctagggtagttcaagctagaccagggtggggttgtgggagtgggcaggtagacccagctctgctctgtgagaggatatcaactgatggcatgattgtcactttcagtatattgtttccacagctataccaggctccctccatttcagccagctgaaatagggaaatggtatggaggaacatgtataggaggtttatctgggtaaaatccggcaataacacacacgtcttcctctcatgttccattgactagaaatcagtcaatgcaaggcaggctaggaaatacagtgtggactaatccattactcagaaagaggaggaaagaatattctgcctactagttagcaatctctgccctaatgtgcaactacatcacttcttttattataataataagagagataatagcttcaggttttgagtacttgtattttatgaatttgtatatattttgcgcatgttaactcaattttcccagtaccctaataagctacattctgttattagctccattttacattttaggaaaccaaggcatgaatggttaaataatttctctaaaatacacaataagtgtcagagcctgcttataaacccagactgtatgatgctaaaacctgagttctacccattataccgccattcctgttttctccttgagtaccgtggttgtttctactattgaacccaaatctgcctttccacaccctccccctccacttgctggttctacttttgttattggggagaaacaggacaatcttacttagcgttttcaatatagacaactagaggcataggtggaaatcaaggtaatggccatgggggctggaaagaaacaggcagatgtaagagatgcagactccataggagaattcaatggcctcgaatttttttctaaggtaactggaattctctaactgttaaagaaaattgattctcacattgattttgtatcctgagactttgctgaagttgcttatcagcttaaggagattttgggctgagacgatgggatattctagatatacaatcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcactatgatattggctgtgggtttgtcataaatagctcttattattttgagatatgtcccatcaatacctaatttattgagagtttttagcatgaagggctgttgaattttgtcaaaggccttttctgcatctattgaaataatgatgtggtttttgtctttggttctgtttatatgctggattatatttattgatttgtgtatgttgaaccagccttgcatcccagggatgaagcccacttgatcatggtggagaagcttcttgatgtgctgctggattctgtttgccagtattttattgaggatttttgcatcgatgttcatcagggatattggtctaaaattctgttttttgttgtgtctctgcccggctttggtttcaggatgatgctggcctcataaaatgagttagggaggattccctgtttttctattgattggaatagtttcagaaggaatggtaccagctcctccttgtacctctggtagaattcggctgtgaatccatcttgtcctggactttttttggttggtaagctattaattattgcctcaatttcagagcctgttattggtctattcagagattcaacttctcatggattagtcttaggagggtgtatgtgcccaggaatttatccatttcttccagattttctagtttatttgcatagaggtgtttatagtattctctgatggtagtttgtatttctgtgggatcggtggtgatatcccctttatcattttttattgcgtctatttgattcttctctcttttcttctttattagtcttgctagcggtctatcgattttgttgatcttttcaaaaaaccagctcctggattcgttgattttttgaagggttttttgtgtctctatctccttcagttctgctctgatcttagttatttcttgccttctgctagcttttgaatgtgtttgctcttgcttctctagttcttttaattgtgacgttagggtgtcaattttagatctttcctgctttctcttgtgggcatttagtgctataaatttccctctacacactgctttaaatgtgtcccagagattccgctatgttgtgtctttgttctcgttggtttcaaagaacatctttatttctgccttcatttcgttatgtacccagtagtcattaaggagcagattgttcagtttccatgtagttgggcggttttgagtgagtttcttaatcctgagttctagtttgattgcaccttcagctgataagcaacttcagcaaagtctcaggatacaaaatcgacgtgcaaaaatcacaagcattcttatacaccaataacagagaaacagagagccaaatcatgagtgaactcccattcagaattgcttcaaagagaataaaatacctaggaatccaacttacaagggacgtgaaggacctcttcaaggagaaccacaaaccactgctcaatgaaataaaagaggatacaaagaaatggaagaacattccatgctcatgggtaggaagaatcaatatcatgaaaatggccatactgcccaaggtaatttatagatacagtgccatccccatcaagctaccaatgcctttcttcacagaattggaaaaaactactttaaagttcatatggaaccaaaaaagagcccacatcgctaagtcaatcctaagccaaaagaacaaagctggaggcatcacgctacctgacttcaaactacactataaggctacagtaaccaaaacagcatggtactgataccaaaacagagatacagaccaatggaacagaacagagccctcagaaataataccacacatctacaactatctgatctttgactaacctgacaaaaacaggaaatggggaaaggattcactattcaacaaatggtgctgggaaaactggctagccatttgtagaaagctgaaactgggtcccttccttacaccttataaaaaatcaattcaagatggatgaaagacttaaatgttagacctaaaaccataaaaaccctagaagaaaacctaggtaataccattcaggacataggcatgggcaaggacttcatgtctaaaacaccaaaagcaatggcaacagaagccaaaattgacaaatgggatctaattaaactaaagaacttctgcccagcaaaagaaaatactatcagagtgaacaggcaacctacagaatgggagaaaatttttgcaatctactcatctgacaaagggctaatatccagaatctacaaagaactcaaacaaatttacaagaaaaaaacaaccccatcaacaagtgggtgaaggatatgaacagacacttctcaaaagaagacatttatgcagtcaacagacacatgacaaaatgctcatcatcactggccatcagagaaatgcaaatcaaaactgcaatgagataccatctcacaccagttagaatggcgatcattcaaaagtcaggaaacaacaggtgctggagaggatgtggagaaataggaacacttttacaccgttgttgggactgtaaactagttcaaccactgtggaagtcagtgtggcgattcctcagggatctagaagtagaaataccatttaacccagccattgcattactgggtatatacccagaggattataaatcatgctgctataaagacacatgcatacgtatgtttattgtggcgctattctcaataggaaagacttggaaccaacccaaatgtccaacaatgatagactggattaagaaaatgtggcacatatacaccatggaatactatgcagtcataaaaactgatgagttcatgtcctttgtagggacatggatgaagctggaaaccatcattctcagcaaactatcgcaaggacaaaaaaccaaacactgcgtgttctcactcataggtcgaaattgaacaatgagaacacttggacacaggaaggggaacatcacacactggggcctgttgtggggtgggggaagggggagggatagcattaggagatatacctaatgttaaatgacaagttactgggtgcagcacaccaacatggcacatgtatacatatgtaacaaacctgcacattgtgcacatgtaccctagaacttaaagtaatatatatatatatatatatatatatatatatatatatatatatataaaatcaattctctaactgttaaagaacattggccctttgtcagatgagaaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtgtaaggtgtaaggaaggggtccagtttcagctttctacatatggctagccagttttcccagcaccatttattaaatagggaatcctttccccattgcttgtttttctcaggtttgtcaaagatcagatagttgtaggtaagcagtgttatttctgagggctctgttctgttccattgatctatatctctgttttggtaccagtaccatgctgttttggttactgtagccttgtagtatagtttgaagttaggtagtgtgatgcctccagctttgttcttttggcttaggattgacttggccagaatctacaatgaactcaatcaaatttacaagaaaaaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccactatgagatatcatctcacaccagttagaatggcagtcattaaaaagtcaggaaacaacaggtgctggggaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaacaatgatagactggattaagaaaatgtggcacatatacaccatggtatactatgcagccataaaaaatgatgagttcatgtcctttgtagggacatggatgaaattggaaatcatcattctcagtaaactatcgcaagaacaaaaaaccaaacactgcatattctcactcataggtgggaattgaacaatgagatcacatggacacaggaaggggaatatcacactctggggactgtggtggggtcgggggaggggggagggatagcattaggagatatacctaatgctagatgaaaagttagtgggtgcagcgcaccagcatggcacatgtatacatatgtaactaacctgcacaatgtgcacatgtaccctaaaacttaaagtataatttaaaaaaaaaaaaaagtgcactgttgcaagggaggccttgaggaagagatttttttgaggggagaaagcaaagaaacatcccttagttggaaggcactgttactctgatggagtagacatgtgcctttccaatacttaaattctgaccaagaaagacagtaggtcaaaaaaaaaaaaaaaaaagaaaaaaaaaagaaaattgggccaggcacagtggctcatgcctgtaattccagtactttgggaggccaaggcaggaaaatcgcttgaagccaggagtttgagaccagcctgggcaacatagaagaccccatctctacgaaaaacaattgaaaataatagccaagtgtggtggtatgcatctgtagtcacagctactcgagaggctgaggcgggaagatcatgtgatcccaggagttcaaggctgcagtgagctataatcataccactgcactccagcctgggtgatagaccaagaccctgtcaaggaaaagaaaagaaagaaaagaaaattgaagacaggaggacaaactgattttggttgtggatgagtgcgtgggtaaggaagatactgataatttcaggttttaaaatgttaggttaaggtatttggggctgggatgttgcatgattattttatttttaattttttaaagtttttatttttattttaaattccggggtacatgtgcggatgtgcaggtttgttacataggtaaacgtgtgccatggtggtttgctgtacctatcaacccatcatctaggtattaagcccaggatgcgttagttatttatcctgatgctctccctcccccaaccccaccacctgacaggccccagtgtgtgttgttcccctccctgtgtccacgtgttctcattgttcagctcctacttataagtgagaacatacagtgtttggttttctgttgctgtgttagtttgctgtggatagtgacttccagctccagttccatccatgtgcctgcaaaggacatgatccatttatcacaaacctacagccaatatcatactgcttgatgattttaaaccaaacacataggattaaagttcaggagagagatgagggctaaagataaccattttaacattctcttaatagacatgacagttgaacctatggaagtggaaaggattcatgatagagaacagtgtgcacgagaagataagattaaaagcagaaattagtaatgccagttgttttattggctctgattcctcacctaccctcgcatccacacccttgtagaatttgaagttccatgcacaaaaaggggagagtacgtaatacgctgccccctgatgtttagatctttgacttgctttggccaatagataaggcagtagtgacagtgtgccagttcctagcctaagcttaagatattttgcatgtgtctgtttgttgtcttgagcctctgccaagaaggtcatgcctgggctaaccaacttgtcttgggtaaaggatgaatgacatgtgaagcagagcccagcctacattagccagcctcagtctacctagacactcatgagctacatcaatgcctcttgtcatattgttatgggcctctgagatttcattatttttgtgattgttattattgttatgcagcatggattttgagttctggagagaggctcgcggatagatatagaagattattttccaagaaacagtagcggaagctgtgaaagtgaataggggccttgaaggagaatacaacctgagaatgcctacatttacagttttggaggaagtgtggagatgacagagaaggaggctggagtctagaaggagaagacagggttagcacagcctttagatttggaaaaatatttgcataatcatatctttaccatttactagcaatgtgaccttgagcaaaatatgttttaaaaacatacaaaatatgtttcaaaagaaatatcaataaaactgaaacattaaactcccaagtcctcagttttttcatctgcaaaatggaggaatgaggacctatgttgagtattgctacaacgagtaagtaaacttatcacggtatgtgttaaatctaatagaatgcacagtaaatgttagctattctctaagaaactcaatagttatgatagctaaaatgttgcatacatacttggtgagatattgaaaatatatttttagaagaaaaaggatgcatctcaaaagagaagaacaaaatgaaaccaaaggctggggagagggaggaattgggagttgtttaatgggaatagagtttcagtttaggaagatgaaaaagttctggagatagacgatgatgatggttgcacaacaatgtggaagtacttaacgctactgaactgtacacttaaaaatggttaaaatggcaaattttatattatgtatatgttaccacaataaaagaaataaaagagaaaacatttgaatgaaaggaaacttacaaaatgtaattttaaaaaatacttagtaactaacttttcgactgacaagtattagatcagagatataataagtgctcaatcgctgtttttgtaaataaaaacatggtagcagagagagttcccccagaaacaaggttaggagtagccacagtagattgacaggagaccttgatggcctatctctactcatagccaattaactttaataggaaaattgttgattttcatttgggatatcacgtttgggggtgaaacacccctggggggtggtctggcaatgcagaggttcatgggggcttttgactccattttagtaatttagtcttcactttttgttttagaaataccaataacatttcataaatcatgtgaggttttgagataaagctcaactaaattttagggaatgttttgtgcaaattgtttactgtttctgaaaaggacatttctttcattactaatttgtatgaatcattttgtaataaacaagatgagtttgtgcccacgacaatgacacatctagttcttttaataaaaaatatgttttagaagaaaaataaataaaaatgaaacattaaggaggcagatgtccaaaaacatattttaaatggtataaatttccatggcctataggtttttagccaagcgcagaaatttggccaagattattgagggaaagctttggttgttaaaaaagggggaggtatagttatgtgctccagtaagtatataatgtatagctgctactcaaactgataattttgatgaaaccaaaataatgttccctaacatgacactgtgattgacacagagcctagggaatgattgcttcaggacgcaacttttccttcttgataaatgtattaggaaaatgtttaggaatgatttcacaaacttatgtgtaccttagtgacttatatacttttactttccaagaaagttcttccttctgcatgaaacacatatcctgcttttaaggaaattatactagaactgggaaaagtcaacagagagcaatgtaagacaatctatcttggatggcatggctaccaccattctacttcaggtccatgacagacattactaattgatcacaacatactgttgctgagcctgtgtacaccctcgctttttcaacgttgtgctccaagcagccattgtcagttatggtttttctgtgagatggaacccatttttcatcccgtattagaccatatggctatgagaatttacagataggagaaaccagtgagggtggaattcaaagcctcatgggaatggatagtaggatcaagcacacagaagtaaaatgtgtggatgagtgtgtgtgtgtgtgtgtgtgtgtgtgtgtgtgtgcaatgcatagacaaaggtgaagagggcaatattagggagattcagttgatttgttgtacagtaattatcaagaactttggaaagtaaaagtgggtcaaatcaagaagatactgaaaatcacatagaggactttaagtttccaattattcaaatagagaattgtttgataactagacgagtgaagcctgtgcataccaaatagatgagaaatgggatatagtaggcataagaggccattgggtctcaaatggaggcaatttgtcttctcaggggacatttggcaacatctgaagagattttggttgtcacagctggcagggtgttgggaacggtggggtggtgcggttctgctgatgccacggccagggatactgctgaacatcctatgttcaggataggatatcccgagaggatattcccccacgacaatgaattatccaggccaaaatatgagtagtggtaaattgagcaattctgctataggctaattgctgtaatctgtaaccccaaatctcagtgatttaatacaacaaaatccatcttgctcatgaaaagacaaaagcaagtattttaggtgaggtagaaattctgggagttctccttcaagaagtcactcaggaattcaggcactttccgttatgtaaaaccactttttttttttttttttttttttttttgagacagggtttcacttcgtcacccaggctagagtacaatggcaaaatcttagctcactgcaacctccacttcctgggctcaagcaattctcctgcctcagcctcctgagtagctgggactacaggcatgtgtcaccacccctggctattttttgtatttttagtagagatggggttttgccatgttgcccaggctggtcttgaactcctgagctcaagtgattcgcccttcttggcctcccaaaatgctgggattatgggtgtaagccatgatgcctggcctaagccactgtctttaatatgtagctaccaaggtaggcatggaaagtgaaggagagtgtgttcatagagaagtcgtccttgctcttacctgccttggaccagaagtgacctatcaatacactcacattcctttggaaagaatttgtcgcatggttccacctagatgcaaggtgcctaggaaatgtggtttatctctgtgcccaaagataaaaagaactgggtctcatacgtttcagtctctcccatactgggagagactggacaaataactcagctagaaaactattacggattcagtgccaagttgtaagcacctgggcaagtgatggcataaggacagagggcttagcaagagactccatttaacaggtaaaacagtgcaagtgtccaaagtaagtcaacaatggcaagtcttggatgttacgccttccaactaactataatctctgtaaacgtggtcttgagtcttgctgctctttgaagtctcaacttgcttgggcacaggtttatgacccacagtccatgcaagaaagtatggatatatagaaataaagtaggaaagaacaaaatcttgtgggtttttttgttggtggtggtttgtttttgctggggggtcctggaggagggaatgattacttaagatttcgaacatgatgagttttcagtaatggtagaatattctaagagctgggccctaaaccattagataagagggcagtattgcagatgtagttttggaggcaatcatcagttgagtggatttcactactatatccctggagtccagttcagagcctgacatggaatatatggttaataacattttgttaaatgcatagatcaacaggtatttgactaacataaataagggaaatgatacttttccctttcattaaaatgaaaataaacctgatgcttatatatctttgtttcagttagctattgatgtgtaacaaaccatcccaaacctcagaggcttcaaacaatagacattgattatttgccatgtatttatgaatcagccagatgatctgtctggtcttggctgggctttcttatgcatgtgcagtcagctgtaggtcatggagaaggctctgctgatcttggctacctctttcatatgtttggaagtcagcaggtctagggtggtcatgcctgagaaaactgggttcttttccatatggtttctaatcttccatcagattctcctgggtttttcttatggtgtggcaaggatctatgagagaaagtggaaacactcaagatctcttaagatctaggctcaaaactgaagtaccatctcttatgccaccagatgttaactaaagcaacacacaaggcctgctcagattcataggtggagaaatagacccaactcttgatgagagtaggtgcaaagtcacatttcaaaggttgtatatatggagaaactgttaataggctccatcagtaagataaactcaccacagtctgggaggaggttgctacatagtgtggaaagagagaacactaagcttgatttattcacttctgagcatcctgatctccatggtaattaatgagatttctaaaataatttccaggttatgtttttattactcttgatcagtgaagaattaatttgaaaggcctaaggtttaccctgcactttaaaagtaaatagctatcacacaaaactaatctccttataggttaaatcctgtcacaacttgccccaaatgtatcctatccattttcatgtcatggtgcataaagaaaacgcgtggtggctcacacctgtaatcccagcactttgggaggccaaggcggacagatcacaaggtcaggagatcaagaccatcctggctaacacggtgaaaccctgtctctactaaaaatacaaaaaattagccaggtgtggtggcaggcacctgtagtcccagctactcaggaggctgaggcaggagaatggtgtgaacccgggaggcagagcttgcagtgagctgagatcatgccactggactccagcctgggtgacagagcgagactctgtctcaaaaaaaaaatcataattttgtggcacgctagagtaaaaggacaaggctgcttgtgattatggggctctgacttccccaggtctgtttcacctggctggttcaagggatgagttgattaccacctccacacacctgtaacccaccagcagagtgagccaggtaggatgttctgcaatggaccaaaatatcaatgggtccagggaatcctatgacttagttgcaggatcaggcatagaggccaggtctctagaccttcagtcccatgccttctttatggaacgatgttgtcttcagagatatgtctttaatcagcacatgtttctcagttatctgctgttagccttgaaatgtgcaagacacctgaggggaatgtatacactgtacaaggcatggccactgtcctcccaggggttaggaaagaaactctcgtacacccattttgatttcctctctgggtgcagtatcaatcggtataaagtctaatgcaaggtaaggaggcaagtgccatttcttctggagtagcaagcattgcaaaaatgtctccttcctctattttaatcactgtatttggatgcaaaataatccagcatagcacaggaaatataatcaatttactcaagaatccctggcaatatgatacaatagcaggcttgtataacccattcaggaaccatagatcctctgattcttctacgtttgtgtcattttaattatgctcatttcctgtaatgcaattactaataattatttgccgctctattgtaggggaaaatcacttacatattgctgcatagtaaaccacttcaaaacttggtggctttaaggagaatcaaaaagctctttttggaaagagctaggtagtaaatattttcaggtttgcaggtcatatgttctctgtcccaactactcaactctgcttgtagggctaaagcagccataagcaatacataaataagaatggctgtgttttaataaaactttatgtatagatgctgtgatttgaatttcataaaattttttaggtgccacaaaatcttcttctgatgtgttttctacccttaaaaaatgtcagatccttgaatggtttgctgatagaagctggatttggctcgaaggccttaattttccatctcctggcttaaaacggccatcactatcactccgtagtcttcagattggttgggagtgcacaatgcaagcttgggcttttttactctgattcaggttctagatccatgtgaccttggattcttaccaaaatgggaataacttttatccttgtgtattcattctgggacccaggatgggtggcagcagcttttttcatagctgtgacacggaaaagagtacaagctcaatcatccaagtgcatctgtggcctcaagctggctaccatgtcattggccattccatactatcgcatggccaaatccaaaatcagcaggcaggaaaatatcctctttagtgatagaaactacatagggtatgaattcagggagccatgaagaattggggccactggtgccgcctatcacactcaccttcccttttctttattgaaaaatataatgatctccttatttttcctccaactttcttctagacagaaaagaagggcatatataatctattttagattatttctggaggggataacttcctatgagtacttctcttagtcatctgcaggaaaatgctgtttataattttgccctgatccgatatctgtcatgcaggaaagtacacattacatatctttggacattccacagcttaatctgatacaccaaaggtcaactgaatgttttccttgagagaattttgaaacaccaactgctatctctgaattttctttgtttggcatctaaaggtatccctgttaccctagaggtcctctcattctgaacacagggaggtgagaggagttattcctggaagtggggcctatgaaaccactggaccttttcctgacaattgctatacccacgtcactgagcgaggactgtttaacctagcttttcttgcctttagccacattccttccactcaccatttgttgatgcaacttttaacacaggacaaagtgtcttatgtttttctaaccatctttgctttctggattttcttttctgataaccttctggattttagacttacgatttcaaattcctgaatggaacatttctcaaaacaaaaaccactttttaaaaatatgtaccctgaatttaaaaagtaatagtgaacagaatgtagcaaaatatcagggaggactgagaatgtgaaggtccacctgataggctaggagggtcacttagcttggcagagcctcagtgtttgcatatgaaaagaaaagtcactcccaacttggaaataatttgattctgaggttccacaaaatgcatatattcagaattctgtgtagaatttgaggtacaacttaaagaagacatctctgtcttctatatataggctgtatattgggccccaaacattatttttcagctccctagctatcccccttcttttctacttccaccccttcctggtcctaggtacagaaatctcaaattttattttgtttagctgaataatattagttgtggagatgctcttaaatatatgatgaatggcaaataaagaatttgggggagtttccccagtatgatgaactctgttaactgtcattgtagggatgagatattttgatcaaaagatcttctcatgggattatgatcaacactgtaagtagatcgatcacttgtttgcagaggtttagaatcaatagcataacttagtacccaaactcagatgggtataatttgaagttttccttaatgattccaatatcaaggttatcactatgttggtgagggatggtaaataaagaaacctaaatgataaaatgccaaatggccaaatggtgactaacttaccatatagatcgcatgtgtgatgcgtgatatgtgtgtgtgtgtgtgtgtgtgtgtgtgtagtatgagttggctcaggcatgaggcacattttggaatttcatcagcatttgaagtagtgaagagacgaggaagctgagattcgaaaggggtggggctgaggaagtgatggttgaagggatatctttgactccagagactatgccaagcacaggaggcatacagtggaagactggagaggtgagcatattgcagaaggactccagtccttgggtgggtccaaaggcagctggagtcagtccttgggagcaatgaaattgtcaggctaggaataccccagccaagttgactggtatgcagcttagaaggaaatggaaagacggacttagtggcatggagttaggagttggggttacagtcggggtcagggcaagcctgcatctctgaaactacagctatttcttttctccctagggttgccaggtaaaatacaggctgctcaggtgaatttgaatttcagataaataatgaataatattgccagtatgaatctgtcccaaatatagcatgggacatacttatgttaaaaattagccaggtgatgtggctcactcctgtaatcccagctacttgggaggctgaggtgggaggatcacttgagcccaggagttcaaggttgcagtgagctatgatcgcaccattgtatcatagcaacagagcaagactccgactcttaaaaaaatactcattttttatgtaaaattcaaatttagctggatgtcctgtaccttatttactaaatctggcaaccatacctacccacatccatgctaggtaaacaccctgtacttttctttccttgtacctttccattatttgggtgatttcttcatttaataattgtctccctcttgagaaaccaagttccacgagggtgttttgactttcagcatactttgtgcaaaaacataggtgaggctcaagaaatatgtgttgaatgagtgcatactactttattagcagtgggactataagtaccactagaagtctctctgaggctgctggccaaagttctactctataataagggctttaggattttgtcagtagaggcaactgcaaggagctgggggcaaagtgggggattgacagtcccataacttcatcattattctcatatttaaatacacatgtctgcctgggggcacaattgcctctgtggaaatccacagccctagatggaaaatcagatggcttgccctgtcattaattggcacaatggctttaggaaggttcctcaacctttagaagcctcagtttctttctacaaaataggagtgaatctcctgactcatgggcactcacaaggattgagaactcatgaggtgaaagtgtgtattggaaataattatgctgtttttttaagaagatacaaatgtacactttatgccgcagaaacagtagaggcccctgagataaatttccctgtcacctgagcaaatatcccttgttttaaagacacggagactgagatgtggaatctttcttattcaagcacaccctcagtcactgttcaaaagctgtgctgccatgtccatcccaagtgtcactggaaggtcacatcctggagagtgtagggaaaggagtccccctgcaaagagccaataaccgcccttatttctgaagggtcacagagtcacaaacctctagatatttcttaggaattcctctccccttcagaatgaggctttaatgactcaactttctctactgaataatcagtaggggttcaagagtatattaatagatcaggctcaattaaacaaacatttctggagtcctacaaggctctgtgcttagggaaaacagtggagaaaataaagatgattaagacactatgtactatgaaaaaatgctcaccatcactggtcattagagaaatgcaaatcaaaaccgcaatgagataccacctcatgccagttagaatggcaatcattaaaaagtcaggaaataacatgctggagaggatgtggagaaatagggacactttcacactgtcggtgggactgtaaactagttcaaccattgtggaagacagtgtggcgattcctcaaggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccatcaatgatagactagataaagaaatgtggcacatatacactatggaatattatgcagccatataaaaggatgagttcatgtcctttgcagggacataggtgaagctggaatccatcattctgagcaaactatcgcaagaacagaaaaccaaacaccacatgttgtcactcataagtgggagttgaacaatgagaacacatggacaaagggaggggaacatcacataccggggcctgtcgtggggtggggggctaggggacggataacattaggagaaatacctaatgtaggtgataggttgatgggtgcggcaaaccaccatggtacgtgtatacctatgtaacaaaactgcacgttctgcacatgtaccctagaacttaaagtatatataaaaaaggagactatgtactgtcttaggaagaaaaagcccccactcagataatgctaatgtaagagcaagacaaaggctgaagagaagaagcaaacgcttctgactgagagttggggagaatcgtgggagacttcagggaggagggtcttgtaggttgcatagaattgatgtaatccccgttcaagctcttctgtgttctttttttaacttttattttaggttcaggggtacatgtgcaggtttgctatataggtaaactcttgttatagcggtttgttgtacagactattccatcacccaggtaataagcatagtacctgctagttatttttttctgctcctataccctccatcctcaagtaggccccaatgtctgttctcttctttgtctccatgagttctcatcatttggctctcacttataagtgagaacatgtggtatttggttttctgttactgcattagtttgctaagaataatggcctccagcttcatccatgtcccggcaaaggacatgacctcattctttttgtgtctgcatagtattccatggtgtatatgtaccacactttctttatccaatatgtcattgatgggcatttaggttgattccatgtctttgttattgtgactagtgctgcagtgaacattcacgtgcatgggtctttatggtagaattatttatattcctctgggtatatacacagtaataggatttctgggttgaacgttggttctgtttttagctcttggaggaattgccacactgctgtccacaatggttgaactaatttacactcctgccaatagtgtataagcattcctttttctccacaacctcaccagcatcttggtattttttgtctttttaatagtagccattctgactgatgtgcgatggtatctcattgtggttttgatttgcgtttctctacttatcagtgatattgaagttcttctgtgttataacactcaataatagtatgaaacctcaagttcacgaatctgtgccatttacatgtttgactaacccaagcataaaacaaggggaacacaacctgcctaggctgccacagagagccaaacgggagctcataggtgaaagcgtaatgcactatactggtgggaggttggtcttatttactggcttgtcatctgcctagtttggactctgttgcgccttccttcattatgttggtctttacggggaaaatttcagggaagctcccaagtttgctcaagaaaagccacccagactttacagtcattttttactttgaaaaaaacaaatccaatcatcttccagatgttttcatttaccaggtctaaggaggagaagtacaaaaaggaagacatgctaacttttgggtttactcttcccattaaaacttctccaatgtgacattgaaatatctttctagcattgttggtggctgttaaccatttttgttcattttctccccatgtgtttacctccaggaaaggcatgaaaccaccattgtccattccctgactttaactgtgtgtctcttcagtctcagtcttctggctcagtaagccagtgggtgtgtatgtgttttcctcattcagctaaagacctgcttatttgcacttaatgtgagtaaagatatagttggggttttaatcaataattttcattgcatcttctttaatagctttttggtgaacaagtttagatatgagggtttaaaagggttctacaatatttatttatatagttaagagacggattcttaacgggggtaattttatccaccagagggcatttggcaagatctggagacatttctgactgttacaactggggagtggtgttggtgacactgctggcacctggggggaagaggtcagggatattgctaaacatgttacaatgtgcagcacagcctgacaacaacaaattatctagtctaaaatgtcaatagtacagaggtggaaaaaccctaatttaagatatgtactctacctgctttccaaggaagcttaacaaattaaacataataacaaaaagtaattacaaataaaagtagaactgaaacagaatagaaggagcagaagcaaggatgtcactggagtcctgaaatgacttaatcattagggttgaatatttgattgagttctgtatttcccaacaaatgagaaaaaaagaaacagttcttgggtagcccccccccaaaaaaaattgatacataactccatcagccaagaccacttttttttcctgccattgattttaaagagaaatatatcttgtagggcattatatgtgggacattgtataagaaaatagataatttttcaaccacggttttgcaaaagacacagatgtgtgtgtgcatgtgtttgtgtgtgtgtatgtgtgtctctttgtgtgtgtgtgtgtgtgtgcaaatggatatttctggtctaaattctctactaaaacggtagcagacagtataacattaggttttgtgagatgaaattcatttctttgagttgcagaactaatacattctgggtattgtctttgcttgtgatcaaatgaataaagagtcgtgtctctgaagatccgagagagagaaagaacgtttccatcgaactttgggaatctctccctggattatcaaatgactgcaacgagtctttggcaagggctaaagagtaatcaattcatggtagcattttccagtgatcatccaaagtgtttgaaatcatttgatagtgtttattcctagtctgctgtggatcagtctatttgttaggctttggggacaaaaagattattaaaatgtagtccctgttttcaagtagcaggagtctaaccctggcaagaacatatataaataatcatgaattaatacacacagtcgaggaatgtgcagtgtgccatgggaacccaatggaagaagcgaagtttcactgaggaaacaggagatttgaactgtgtgggttattgaagaagtcttcacaagtcttatttgtaaatacagctgatccttgaacaatgaggggttaggggttcctaccctctctgcaatataaaatctgcatatggctgggcacggtggctcacacctgtaatctcagcactttgggaggctgaggtgggtagattgcttgaggtcaggcgttcaacaccagcctggccaatatggtgaaaccccgtctctactaaaaatgcaaaaattagccagacgtggtggcgcacgtctgtaatcccagctacttgggaggctgaggcaagagaatcgcttgcaatctggaggtgaaggttgcagtgagtcaagactgcgtcactgcactccagcctgggtgacagagcaagactccatctgaaaagaaaagaaaagaaaaaaaagaaaatctgcatataacttctgactccccaaaaacttaactactaatagcctactgttgaccagaggccttgcagataacataaacagttgattaacatgtattttgtatgttatatgaattataccctgtattcttccaataaagtaagctagagaaaagaaaatgctattaagaaaatcataagaataaaatatatttagtattcattaagtagaagcagatcatcataaaggttatcatcctcatgtcttcttgttgagtgggctgaggaaaaggaggtcgaggaggggttggtcttgctgtctcagaggtggcaaaggcaggagaaaatcagcatataaattgacttgcatatttcaaatgcatgttgttagagtcaactgtattttataaatgtatgaaatgggtgcagaaaagtatacaaatcataatacacacctcactttgttttcacaaagtggactcacccatgtgactatcatcagatcaagaaataaagcatcatgagaaatagaactccagaaacttctcaggcctccttttccaggcattatctgcccctgtctgccaaaggtaatcattatcccaacttgtaactccatagattaattttgcattttatacaaatgtaatcacatgttatatattactttgtgtctggctttaacatttttgtgacgttcagattgtcacatgtagttgtaattaatgtacttttcattgccatgtagtattccattgtatgaatatacaacagtttattccattgatgaacatatgagttatttccaggttttggctattgcaactcatgcattgttgtacatgtttttaaataaacacacttgtgtattgcatgtgtctatacctggaaatgaaattgctgaggcttcatttgtatataaacacacacacatgtgcacacacacacacagttgatctttcaacaacacaagtttgaactgtgtgggtccacttgtatgtagattttcttctgcctctgccaccctcgagacagcaaaacccaaccctcctcttcctgctccttctctacctactcaacataaagatgatgaggatgaagacctttatgactatccactcctacttaatgaatagtaaatatattttctcttccttatgattttcttaataatattacttttttctagcctactttattgtaagaatacggtatataatacatgacatacaaactaagtgttaatcgactgtttatgctgttgataaggcttctggtcaatagcaggccattaaaagtaaagtttttggggagtcaaaaagttatacacagatttttgactgcatgggagtttggcgcccctactcctctcatgttgttcaaatgtcagttgtaatttagttttagttttccaacctgcttgtacaaatttattctaaccaacaatgtattagagcaggaactggcaaactatggctagaagacctgttttgttttgtaagatcacagctcactgtagcctcaaactcctgggttcaagtgatcctcctacctcagcctcccaagtggctaggactaccggtgtgcaccatcacacccaggtaattctgtaactttttgcagagttgggatcttgctatgagagaagggtggtctcaatttcctggtgtgaagcaatcctcccttctcagcttcccaaagtgctgggattacaggggtgagtcactgtgccagcttgtaagtaaagttttattggaacataatctcagtttctttttaatgtattgtctatgtcagttttcctgtggcaagggcagagttgagtagttgtgaaagcaactgtatggcccacaaagccaaacatatttactatctggccctttacagaactaatttgccaacctctatattagagttatgagggtttcaaaaccttgccaacaaccacgctgttgactgtttcatgtcagctcttctagtgtgtgttctggtgggtgtttcatgaatcatgttatggcattaatgtccatgatcctattgaaatcttcatatacattataaatagagcttacaagagagagttgtcattatggttaaatgctgagctccacttgagattctataaccttcccccccaaaagacttgatttattttatatgatttttctaaagtgtatactagtaatttcattttgaaaaaaaggtttctctttgcttcttctttttttttttttttttttttgacagagtctggctctgtttcccggggtacagtgcagtggtgccatctcggctcggctaactaaaacattcacctcctaggttcaagcaattctcctgccttagcctcctgagtagctgggatttcaggcatgcatcaccatgcttgggtaatttttgtatttttagcagagacggggtttcaccatgttggccaggctggtcttgaactcctgacctcaagtgatccacccacctcggcctcacaaagtgctgggattacagcgtgagtcaccgcacctggccttctctttgcttccgaaacttaagttgtgggatttagtgaaaaattattaaaatgtactttggaaaagggtattttattctcagtggagtacagcttagtaggcaagtcaataaggagagggaacccccatggatgaagcaggtagatgaccaagtgacttgggaagtaccttccaaagaaaggaagggtccataaatatttattgatagaatgaaaagaagaaacagtggttcaggtggctcaatgccctttcaagtactttcattttataaaatcacagaaaagtttctacatgtgactaaacaattttctcccttcttcagatatcctcctaaagactctgttagaaaatagtattactcttccagtaagaaaattatgcaaataaaaaaacccacgagacctaggtatctgaatcagtctttgagaagaaagctgatgtgcacactcattaaactgcagaatatggctcagtaagtctttctgtctcaagattgtttccagctgaagtcacacttggcaaatctgaatgcctcagaatgtaaagatggcccttgtccaggggcagacctccatgccgctgcttcctcttcccatttgcatccagcagtgcctgggagaggcaaggatcagagtcccttcaggcagtaaggatgaaatagatgaaaaatgagaacattaacactgggaaccagaagtcagggaacctagagcccaagatagcaaaaagatgtgagaaaacagtcgttatataaacacctaaaagttggagaaacctttgctctttggagaggaattactgcaagaagactattgagaggatctttaagtcctggaggccccagaggggaatggagagggagaatgaggagacaccattttgtttaagaaagcaaaggagtggagaaatacaggactactattttgaagataaacaaattaatagaaaaaaagtcctacagtgtgtttagaaggggaaaaaaaactgcttgcctgaagttgagaaaacatttccataaatgtaaacttcacaaatatcttcacatcaagcacatgactgactaaagatgaatgactcccaattccgcaataaacattagggttcatctacacacacaagtcagcttgactcaatgtattagaaggagaaaaggtcaagtcaatgaaacaaccagtccttagagtgccaagtacctgatttgcctgcatgttttcgttttcacttgttttggcattcttagacatagccagaaaatattacaacagaaacatctcattccaggatgttattttagttagtgggacagggaaggggagaagtgctttcctagatataacttagttgataggtaccctggttcttaaaatctgtattggaagttaccagagaccctgaccaaatgcagcatagtatgttcatgccaaaatgcctcctcataaatatgtacaattatatgtcaaataagcaaaagaaaaaatgaaataaattgcttccagatattgctcttttaccaaatggtttcaaaacatggacaggattattgaggtcacctcttctacctgtgtataattgttttatttcaacaacaacaaaaaagtatttgagaattgggacattattttatttttttttaaattccctttgcccacagatgcttcgatatactcaaactttggtttactttttactatttactctgtgaggtaaatgttaccccactttgattaaaataagaccaaagttcaggaggctgaaatgagtagcctaagatcttatggtagggagggcacagacaggttttcctactctgacacccccactggactgagcacatagtgggccctttatcaatgtcttttgaaggagtgactgactgaatgcacagatggtgagagtggaatgaggtggagctgagtttgtgatatagatactcctccttctttagtcatctggcaacaggcacagataaatttttggagttaacgaaagtgaaagaaaatgagagtatgtatgaagttctcatccattgcatgtaaacatgaaagcctataaattgtaccacctctatggagagcaatatagtggtgtctattaaggtggaagattccaggctcttgaatcatcagcttcacttctaaatacatactctagggaaattctcatatacgtgcatgagactgttcattgcaacattatttgttatgggaaaaaatcagaaagaacatacccttatgagaatagataaattaattatgggataatatttcagtaaaaataagtgaaatgggccaatatgtgtcaacatggataaatctcaaattttggcaaaatataatttatatattgaaattcaatcaaattcaagcttacagcaacaataatgatatgctgacttatattctagtatcctattctgattgcaagataaagaggtggcagccaattgtgcacaactttggggattatacccgcatggaagaatgtcgtgtatgtgagcatcattgtttggtgtgttaaagtgaaaaaaggaaggttgagaaccattactctagagttttgttgttcaagtagtgatcaattaggaagaaaaattttcatgaactctgtcttagctcaggctgctataacaaaataccacggactgggtggcttaaacaatgggaatttatttctcatagttctggagactggaaaatccaaaatcaaggtgctgacagattcagttcctggtgaggcctctttacctggattgcaaatggaccctttcttattgtgtcctcacatggcagagagagagagagagagagagagagagagaaggagggagggggaagggggtgggaggagggaggcacactctggtctttctcttctcataagagtactaatcccatcatggggtcccaccttcaagacctcatctggacctaattatcttccaaagaccttgccttcacattccattacattgggggttagggcttcaacatatgaattttagggggatacattcagtccataacagattcccagtgttgacttactctaattttactgaaatagggctatagttatttatgtaagactatgaataaacttcttatgttcagaaatcttatctatataatccaactaagttatttgtatcacacaaacatggctggatgtattgcattagaaatttatgtttctgatgatcttacttaaaatacaggcttcgtagcatacagtaaattcactttgatggccctcagggaaccacaaaaagttaagtcctcctcctccacagcagttgaagccaaagcagaagaaagaagatctggtgatcactaaaccaataaaagatgtatccatagcagagaaaataaacagaatttcaaatatgggccccaaaagaaagtcaccaaaatagtcaccacaacttgtagggctgatgtgtgatacagcttcccactaagcagctctttggtgctacaaaataaggggcaggaggatttatgtattttatggataatgattctctgggatattcctctattgcattgaaaccacctactactaaatctattaatcaaaacaaatactttatatgtaacaatcagtaagtttcacagtagtaatattaatttaatttgacagatgatttggctttgttaaaatccagtgatggatgtatggttaaaaaaaatgaagacttgggtccaactccatgctttgatttcaataacacaaatgtagaaaatgtctgtctgtataagaatgctttaaaatgttacaaataagcacaataattctttttttttctagttcaaaataatctgaatacatttaactgaaatgaatcactctcaaatgtcaactgtaatgaggaacacttgataattttgtgaatgtccctcatttatttgaatataaagataacacacagctttttttagaatcttatagtagcagatatataagataataaattttgtaataagcagtagctcattcttgtgctaataaaatattacaagcacaaaaagataggatatacacaagaaatcttcctgtgtatcagctaggctacttttggctgcactaacagagtacatgattgaaagttgcttaaatagtaagaacattttttatctcacataagcatggcattagatattactgtgtaacaaattatcactaacttagtggcttaagacaatacatatttattatctcacagtttctgtgggtcaggagttcagacacagtttagctgatttctttgcttcagaagttatatgaggctgcagttaaggtggcagcctgagctggggtcttatctgaaggctcaactggtgaaggaaggccctatttaccagcttaccctagttgtttgcagaatctccttaaaggccatttgactaagggcctcaccttctcattggcagttggctggaggccaccctcctccactccttgcctcatgggtctctccaatatggcagcttactttatgaatgcatgcaagccaagaaggcaacagcagaatcaactgtcaagacaaaagttacaattctggcaatgacgtcccatcacctttgccatattctatttgttagaaggtgctatggagtctatttgttacagcacctttgccatatttgggtagaccagctcacgctcaaagggaagagattgggtaggggcataaataccaggaagggaaagaggagaatccttaggaccaccttagagtcagcatgccacagacataaacctggagcatggttccaggattacctcagggactcagtgactacatttacccagatacagttcatctctcttccctggctcagagatgtctctctccatgtagataggctacagccttaccaggtgctgtgtgaaagagcatactcaggtgaagaaaagagggaatttcaatttttgttattttggaaaaaaacctttcccaaaagtctcctgggagaagtcccgtcaagtctcatttatcaggattgggttgtgtgtccatatccacattgcaaaggagtctagggaagtaagggcaaggatatggcatttttgccctcagtaggaggtaagtctctgccagagagaaaaggaaaggggtgggtgggggcagaggctgggaatgttccaccaactactaaaagacagacttctttaagggctaccttgtgttaacatgataactgaattttctgcctctattctccttacttgagatgttcattcatatagtgcgctatgatgtcattgggtctttacttggctcaaacattattgtacagacaaatgcaaatataggtcctgagactgcctgaggttctctattactgatatgattatttttgttccaatatttcctaaatatgttaagctagttataaaattcttattcttaaatctcttatctgtaaatgtttttctttttgtacttcttcaaacaaaagtgactggctccttaacttccaaccatctagagtcatttatttagatatgcaaaggtaatcatgaaaataaaaatagatggtagaatgagcctttgatctaccctggcttttctgcaaaactccccagataagtacacaaagggtgagttgtttacaaaaatctctctgtaatcagagcaggacctgtgaccttcagcaccttagactatgagggttccagacttcctttcaggttcctcaaagcctggtgaccacctctcagaggtgaacttacttccagtcaacctagctgaccactaggagtatgtgtgaaatgactctgaaagcatctgctcttgcagaacttcttttcaggaaccaaatctctactcttttatcctataatttgctgttgttgatttggattcaagtgaataaacttacatttatccttttcaaatacagtcttatttattaggtccatttgccatgaccttctgaatcttgcttctgtaatctctcttaattaatgtaaggctccatgttgtgttgaccacaagtttttatagcatgtccaggcatgtttaccaactgagccaatgctcagttacgtcccaaaggatctgaccattttgtgtggattttaaaagaaaacatattagaaggaatacactgatttttatttgttcatttaatgcagtggttctcaacctgggttggaggggaggatttgtccttcagaggacatctggctatgctggagatgtgtttgttgtcacagtggaggagggaggcatgttacttgtgtctagtgggtagataccagggacactgataaatattatctaatgcacaggatgccaccatccctgtaacagaaatggtcccaaacatccatactgctgtgttgaggagcccagttttcatttcagaaatggagctgggcatggtggcatgtgactgtagtgccagctacttgggaggctgaggtgggaagatcacttgagcccaggaatttgaggctgcagtgagctatgatcctgctattatactccagcctgggtgacagagcaagacccatctcaaaaaaaaaaaaaaaaaggcattctgttttgtatgggaaatcttacataacctttttctgtcagtttgataggaatttttacgaaatattttgatgcttgaatgtagagcccaggtcttactatatttacgtgcgtctttgttctatttctctgttgagcaactctttttgctcttacatctggactccacagctgaatcctctgcttacttgtctggggcccagataccctcaggaatccgaccctattgtccataccccaaaccactggcagttggtaacacaaacacagtcacaccaatgaatagtaaggtaaggaagtgtcaatggacacctaccaccactcctgctggcttctcaatgctattttggccaccatgaattgtgccatctcattgtcctattgctctgcgtcactctccacgcatttaaagtgctggtcaggagcattcagctggctaagcctagttcccatgatgcagtctgagcttttgggatgggctctggaccagagaattcatgtgcatcactctttgaatctattcaataattactgcccctcattgccatgtttgttgattctccagaaataaccacttgtaacagtttgttgagtgtttttgcaaacattttcagtgcatatacagacacatacatagtatgatatactttttatattataatgtgcatataagttaggattgcttaagctgctataaaaggcctccgtgattcagtggcttaaaaaaaatgagatttgttttttctctgcatcgtggcccaacatgtatagtccaggttgataggaagctgtgctccaggcagtcagctggggacccaagatgacactggctttgccatcttcaacatagtccctcaggtcactctggtggtcaccattttgtctagtggtaaggagtgaaactgagtatgaagaagacgtgcaccttgacttaagagacaaggctgggaaaaagcttacttacatggctatccctaactgttaatggggccgagaattgaagtgtagctgggaggccatatgccaagctacaattctattgtatacaagaaatgaagaacaaattttggtggatagcgacctaatcatctagttcattctttctctctcctctttctctcttaacataaataggactatagtatacaagcacatttcattaccttcaacattgtccatgttagtatatataaatattcctttttccacaactatattaactatattattcgtgactcttatgagaatcgtgtataactttcccctatcaggtttatcaagttggtcttttgagtacctctgtttgtttagctgttcattaaatgctcagcacgtataggacttggtcagtagatagcagtgctctttgaatggctcactagggttttctttttaagccattcttttctagtatagaaatttgcattctgatatagaatgtttggtttctaattatttaaaaccatatattgcctaggttttcttctagggtttttatggttttaggtctaacgtttaagtctttaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcgaaaactgggtgaaggacatgaacagacacttctcaaaagaagacattaatgcagccaaaaaacacatgaaaaaatgcttaccatcactggccatcagagaaatgcaaatcaaaaccacaatgagataccatcttacacctgttagaatggcaatcattaaaaaatcaggaaacaacaggtgctggagaggatgtggagaaataggaacacttttacactgttggtgggactgtaaactagttcaacccttgtggaagtcagtgtggcgattcctcagggatctagaactagaaataccatttgaaccagccatcccattactgggtatacacccaaaggactataaatcatgctgctataaagacacatgcacacatatgtttattgcagctctattcacaatagcaaagacttggaaccaacccaaatgtccaacaatgatagactggattaagaaaatgtggcacatctacaccatggaatactatgcagccacaaaaaatgttgagttcatgtcctttgtagggacatggatgaaattggaaatcatcattctcagtaaactatcgcaagaagaaaaaaccagacaccgcatattctcactcctaggtgggaattgaacaatgagaacacatggaaacaggaaggggaacatcacactctggggactgttgtggggtggggggagtggggagggatagcattaggagatatacctaatgctaaatgacgggttaatgggtgcagcacgccagcatggcacatgtatgcatatgtaacctgcacattgtgtgcatgtaccctaaaacttaaagtataataataataaaataaaataaaccatatattaaagaatttttgatttgttctgtttattattgcactgttaaataacaagggtcattaaaatgatacactgcaaattgcattctgttttccaagtctagagacaaatttgaattcccccaaagcctgttctggcttgcttttacactgttgacattcctcagaagaggcaagaataggcaaataattatgtgatgcccatttcaattccaacctcttgactgcttcattctcacccttcaccattcacatttggcattacaattccaacattaaatattctttttgaaaaatggttaagtttttatctgatgtttcaatgttgatatactatgattgggtcttattgtccaaagtgaagtcaaattcgtgtttaagtaaaataattctagcatggtttcctcctacctcccacccattatttgaaaagtgacaagaaaatgtataaagctggtaataattgaggcatttctaggcttgggatttccaaaaactgtgaatagccataaactggcaaatagaaggagacctggaaacgaattgcagtttgaaatcacagcaccatctgggacaccattttcctaatagtattagttttctattgctgcataacaaattaccacaaacttagaggcttaccatacacctttattatctcacagtttccataggtcaggagtccaagcacagcttaactgggtcgtctgctcaggggtcccacaaggctgcaatcaatgtgtcagctgagctgcatttctctctggggcttcagttcaacttccaactcatgtgattgttagcagaattcatttctttgtggttgtaagatcaaggtccctattttcttgctgactgttggctgggggctacgctcagcttttggagtccaccctcattccttgcctcctgtcccttttccagacctctcaacatggcaactcacttcctcaaagtcagcaagggagagtctcttagcccagcttgctaagatggagtcttatataatggaatataattatgggaatggaatcgtatcacttttgctgtattcggttggtacaaagtaagtcacaggttctgcccacactcaaggggaagggattgtataagggtgtgattcactggaggggggtcatcttaggatatgtctgccacccgtatttctggtttaactcactaccttgtttccatttcaccttcagtgcccttctgatgcctgtctggtgcctggtttcgaattcctacctgtctggtcctcacattctcatggttctcacatgcttcctgattaccttttaccttacatttccaacaccttcacagaatgcatcctgctacctgtctctatggccttcttttctctatggtcaagtcaccaatcccttggctctgctagccctctccttttagtgttcaagcacagcatgggtaaatgaaactgatgctgttatgttgaatacctcctcctcctggcttttctactcatttcagtggtgtgatcattcttcaagtcaccctaagtcaaaaccatacagttattcatatcttggacttccctaaaccaggggttggcaaattatgacctgtgagccaaatttgatccacatgcctgttattgtaaataaagttttattggtgcaaagccatacctatttgtttaagtatggtttatgcctgctcttgcactacagtggcagagttgagttgttgctacagaaactggcctaaaagctgaaaatatttcatatctggctttttgcagaaagcatttgccaacctgtgctctaagctgaagaagacagattgtttcttttgcatttaaaattccaatagcgttctttccttaccttcttttccttctgctattgttcaccttggttagtgcttttgttgtcatacacctgaattgactcagccatctcctaattgggcctcagcagctattcagagcttctcttctctgaagcccttggttcattgctgttgtttgagcatctgaagatcttccttgtctagttctaaattctttctctttatttttctatgctttttacagaaactcatcttccctgggtgggctgagagcaaacactggctcaaatactttacccagttttgcatgtatgattcattaggaacttctcataaactatctggatttaacagttatgtcttactctacataagacctagatcctctatagattattataaaatcattgcacacaagaattatgtcttacacgttacatctgataaaatgcttaacgttgagttgagctggacagagaggtatagaaggtgtagaccagcggtccccaacctttttggcaccaggaacctgttttgtggaagacaattttcctacagaccagggttgtgggggggatggtttcaggatggaagtgttgttccacctcagatcatcaggcactagttagattcttataaggagtatgcaacctagatcacttgcatacacagttaacaatagggttcacactcctttgagaatatcatgcagccgctgatctgacaggaggtggagctcaggtggtaatgctcgctggtctgctgcttacctcctgctgtgtggcccggttcctaaccataccagtaccaggccatggactggtactggtctgcagcccaggagttgggtacccttggtatagactgttgataggtctttgtgacaagctgctttactatttaaaaatgaaatagagctttgtttcattttatatcgtttttaatggtggtgattaaagatactttaaataaatttaaacttacaaaaaggtcgaagtaatggtataaggaactttttctctaaatcatttgagagtaagtttccaacctgatgccctatccctcctaataatttattgtgtaattcctacaaaaaataaccaaaatactaccatcaaaatcagtaaatgagcatggttcctgatagccatttagtccctatgctctaacaagtttaactaattgtctaagtaatctcctttgtatcaaaaagatctagtccaggatcataagttgtacttggttgtcatatctctttactctctttatatttggaacagttcttcagtattttttgacttgcatgactttggcattttttgaagagtattggagagctgctttgtagaatgtaaaattgtatttgtctgatgattccttataattaacttcaagttatatgtttttgatatgaatatcacatttgaagaggtataaatatcccattcgtcatcaaactttcactcactagttttagtggtgtttcttggctaaattaattattactgtgttagttgacatttgataattttctatttccatcactcctataattattatttggcattccattacagggaaaacaattcatctcttcctatttgttcatttatatcaccatggactcatggattcctattctattcagtgggttagaatcctttactttcatttattttgatgctcaaagggtcccacatttagcagtgggataaggttgcctgataagatatagaacacccagctaaatttgcatctcagataaacaattaataattgttttagtaaaatatgtctaaaatcttgcatatacatgcttaatattgcatggacatacttaaattattagttgtttaactgaaattcaagtttaactgggcatcttctatttttatttgctgaatctgaagccctgaagtgggagccccttcaagatgcttactgtgttctttcaatatgtccccatcattctttgaatacttccttgatttctggcccaacaaaatgctgtagcctcacctcgtacctttcttgctccagctctcaagccacttccccaaagaaacctggctctgtttagtgtaaaatggtatttagaaaccaagatctgtacacagagtatactcattactgttgaatgtcacaactcttagaccttctcagtggagagatccagggcaatctatgtatttatctatttacacatatgcatatatgtacatacatctacatatgtatttacttctgtatctatctctatgtattgaaaaatcatgacttcacaccaatgcttctaattccaatctagtaccacatgaacatttctcattttccttttctacttctctaacagtgagaaatgtggtcctcccaccctccatataaccataattgatcaattacccccatatgtacccaatctcccattgccaccaccagcctccacatccctacacggatgctttgctcacctttcttgggctctgacaccccaccctgtgcttcctctcactgcctcaggctccaaaatcccataccaagccactgccagtaccacttctgccaacgtggcacatgggcaccttattcacctgattcaggcttcaacatcccatgccaggccagcatcatcattcccctgtgtggatgccctcttcatgccacttgggcttgatccccagcaacagaccaccctgagtgaatgccctcctcatgatacttgatacactgtgctgagtcaccactcctgccccacctgatgcagatacctgtcctgcaaggcctgatgtcatgggtcttggattgaattgttcaggaaaggaaggagggaaaggaggaaggcatttctcaccatgtaacattataactgatttattattttttataattgatttatgttttcattctgttttcccctcaacctggctcattcactggcagattaccttattacaagaacaatgcttgctttatcataagcactcagagattatccatcgaatgaaaaagtgagtgacttaatgaacaaatgaatatgtagagagctaaagtttctacatatgcagaaaataaattttaattctcctaaaaaattattttctcttggctcttgaacttacttaacatctgatttaggattcacccatggtaacccaatgattgtttggggttttctacctcacctagcatgacatctgggcaagtttattttcaggtcactataacccagagttttcttgcaagagtatggtcaaaacatcatttttccttattaggaggtggcttgtgtgtgttgagctcacatttcttttctcacaggcttctcttgctctcatcccctgtgcagacttaatcatatgcctaccggtgatttctatatactgagatcaaaatcagcttctgtttcttatgctatcaaataaaatatctgctctgtaaaactgcttctacatataaaagaaagaatcggggaccagctcttcaattggtatgaatgagttggagagaaaaggcagtaaggcacccacccataggcccccaggggtcaggaagcaatgttcgatgttttccttctctcaccagctagctaaattcttgtggaaaaaatcccttcctcacgaacctgcaaattgaagagatgtagcaactgggctcactgatcctacccaccccaatcctgccccaagtcatcacagggaaaatgagcagtgcatgtgtgaatgggtatggcatataaaattatattttcatttagcatttattagagctgattcaaaaaatcacatgaaactattataaattgctgaacagtttcaaagtttattttgcttatgtgtgtggaagagagacaaaagtagatgagaactttaaaaataatgtttattgcatgactaaaaacttgggagctgagaagggagaccaacattatgtaagctcagaatatttttggaagttaaatggcatttcctacaattttacttccaatgcattcagctgatcacctctctgaaaacaccttgtgccttgcataccttttttggaagcttacttctccctccctcttctcttctaatactctttccgtgataaatcctcattcatcctggaagactaggcattaaaaacattttctgtatgaaacttgcagtggctttcaagtgagttcattagaacagtggtcatgcattagaactacgtatttacactttgtctccactattggctgtgaacttccagacaggggaatgttacatctcattttgttttcttttacttaatgttaaggatctcatatatacataattgggtaattacactggctagctcatgacacctgagtgatatgttttttttttgttgttgttgtttgtttgttttccattctcagtgaatgtcttcagtggcattgagcacaagagtggctaagaatggggctaaggacttaggcacacctggtctgaatccctgctcacccacttaactgtgtgacttggggcaatttatgtaactttttgagcttctgttttctcaaatgtaaagttagaaaaataaagcccctatttaatagtttttcttttttatttctgagtgttaaatgtaatattgcaaactaaatgctaaacatgatttatatgacaagaagcagccagtaaattttagctttttaattttttaatggagtggggctcaacagatacttaatgaatgatacagccattaagctttttagaatcccaattatgtatccaatttgttttatttattttctttttctcttttcttttcttcctcttctttcttttccttttcttcttctcctttctcctctttttcctctttttccttctcttcttcctcctcctcctctgcctccttcttccttttttctcttcctccttctcctctgctctcatttttcttcctcttcatcttcctccttgtcctcctcttcctctttcttctttttcttcctcttcattatcatcttccttctctttttcttcttcctcctccttcgattctccttcctcttcttcctcctcctcctcctacttaatcttctctaaaattctcctctctctctcctttctttcccctttcccctcccctgccctcctctcttttttggacatctctgagcacagctgctgcacataccagggcaaagctgcatcagatgccaaagtcttttcaagggaagccagttttcaagctcgggcacactgacttttaggatacaacccaaatactattaaataacaaaacattaagcttctttgcagataagcctggaataccttattctctaggtttttaaatttaagagaagtggaaccaggcactttacaatttgaaatgttatttcaaattattctcatagcagccctgcataataggaattattattcccactttacagataagagagttgaagacggtgtcactataagaattaacattagtataagagcagtctctcagctctgtttccctccctgctggctttaacttcttccactaaatatgtctttctccctatagtcataaaagataatcacaatccaacagagacatccatccctacagctcatgatcccaaaggaagtgagaccatttctattacaacatccaatttattaaccagtttcatgggagggctatgattgcctttcatctcaggatattttcattggtaagcagaagagtaatcagcagtggcttaagtgaaaagaaaagaaaaaaaaaaaacatttgattatctcacagagctagaagtttggaggtaaggggctcttgggttgagtcagtgactcagtgatagcaggagctgagcagtgtcttgtaaccctcttgagttcatgctcatgattgcagctccaagcatcacttcttcacctcagcatcataaggaggaagaaaggatagaaaagaggtcattcctctgacaacactcttattttgggggatagaagatctctactctaaaacccccagtggacttctctttatatcccattggccagaagtggggcacgtgtccactccaagaccaattattggcaagaagcgacggagttaacatgagtggtttacaacaatcatggctcggcatctgaggctaagtgaagggacagcttttcctgaaaccaaaggttcctgcctcttgaacacattgcaagttctgtgtgcatggcaggagagggtgtgtgtacagatggttgttggtaaggcagtggtcaatatctgctgcagcccattttgggtcatatgtctatccctcatatctgctgagggcagcacgaagagttctgccttcgactgtgttcctctggtgcagtctctgagagtaggattaacaggaaaaggattggtcaggaaatattcttgggaaaaaatggtagaggaagtgggatgaagaagagagggaggctccacagagttcaaggtctcataaaattcaccccccagaggataacttaagtgcaactccacagagaagtactggggacagtgtagaccccactcagtgctgtgttccccatcgggattaccccaccaacactgtggggaggggatataaatttctgggcactcctggttcttcacatgtgcaggcaaaagagattctggaagtctgtgggtagttctctaaccaggagacacaaggctggccgtttggagtaagagcctgttagagccactaagcataacactggggacttggaggggatatgagctgagccccaaggacatctgccacagggtccatgacagtccagaccagcatcaagtctgcaccccagagccacggtgtgggtgggcattgcttgatggttgccaagtgaaccaggacagtatgagcacaaggaaggtggccccctatggaaagaaaaatgctgagaggtcaacatctcaggacaccaactcatcagccctctgcacattccccaaactcattagggtgcctccaggagaggtcttacgtgagaacgggaattttggctgcccaggtactgtgtggaatctgctggattctctttatctgcagctgctgggggtacgccagctgtcagtgatgacttctagtgccattcctcttttccccatttaggcttttcttactttttagctgagagtagagtttctcctccccaagtactattgatatttgaggctgaattattcctcactgtgggggactatcctgcgcactgtagaatatttagtagcatctctggcccctctccacttgaagccaattccaccagcattcccccaccaaagttgtgacagatatcccctagaccttgttaaaaccactcctggtggagaaccaccggcttagaacactgggctcctgcaactgtagcttccaggtttcacctgctaaattgggggaaatgccctctaagctgtggaactctatgaacttcatgggagtttgccagatttagtgtgactcttattcttagtgagttaatttgtcatttgtgtcttgtttcctctgtgctaggggaataaagaatactggacctgtattcagaatttcctctcccttctcacatttacctgccattagtgagctgaggctttctttccttagaattagggttgccagattaagcaaataaaaatacaggacatccagttaaattggaatctcagaaaacaaacaatgttttagtaaaatatatcctttgcaatatttggaatatagttatactacaaaagtatgtgttctttatccaaaaccaggtttaactgggtgtcttgtagtttatttggccactgtacttggcacacattctttctctaaggactccactaggaaatgcctgcattactgtattctggtgcactcatcgtatccttcaatcatggagtccccactctgcctgttggttagcttgtactccactcaccgtggcaccacaacttgggctgtttctatcacagcactttcagcattgctgctactttccatagtgccctgtcccttcttttagcttttgtgtctttctgcaaattgattatatggagttggattaaggcctgcagtcattatatgtgggtgtgcgtgcatgtgaaaaaaaattactcttagcttccctaagagaagctcatgggaatcgaatcattgagtaatacagccacggaggatcctggggaaggaattctccagcattccacagtagcccctattctgaaagcctctagttagtatcaccatgaaaatattagagggagaggaaaaaaaatcctctgtaaatagtagcactccaggggagatcctagtaatttgcatttttaagaccagatgcagttaacctttcatatattgtacatattttaggatgatttttttctaaaagatttattaatactatcattgcctaaaagatcagctgatttgtgagttatttgaataaaacaaactaaaaaataagggaaataaatgttgcttgtcatcttccttacattcattgtggcagaaagggcagcaatgagctcttgctagataagagaactacagcagaggtacaggatgcagcatcatgggaaccagaattcatctgagagactcaataactctgatgattgtttatttagtaacccaggggaaatttggcttgagttacagtgtgtgtattgctgagttctttctgtgtgtcttggttatttcaactaaaaaagactggggggaggaaaagcagctaacatgctaaaactgtaatgattacttaacattacattttggaaaaatggctttactgaaatgtaattcacttatacaattcacgcatttgaactgcataattaaatggcttttagtatatttacagaggtgtacaaccataaccacaatcaattagaacatttttatcacaccacaaagaaactccatatccattagccagccatcactccccatttctcccactccatacctactcatcctcagcccctggcaaccactaatctacttgctgtctctgtggacttgcctattctgcatatttcatataaatggaattatacagtatgtgattttttttggtttctggcttttttcatttagcataatgtttttaaggttcatccatgtcgtatcatatatctatactttattctttttgttgccgaataacataccattgtgtatatcacattttacattcatcagttgaaagtcatttgtgttttcagttttgggctattatgaatactgctgctatgaagattcacacacaagtttttgtgtggataggcaaaacgggcagggaaacaaactagagaaagaataaactgcagaaatccaagtgagaacaattaagagctcaactgtcgtacatttccctttcctttccttcccttcattattaccctgacttaatccttgcccagccttcctttcattttcacagtatcctgctcccaccctaagcatgtgtatttcaaggtaaggctttttgtggagccaaattgaagggggatcacctggccagatttgcaaatgtaaaggcagactggtacatagattctccctccacggtatacccccgacccccagtgaatttaagaaccaaatttaatatatagattagctcttgattaagagcagtggggccaaggttcacttttagtctcaaggtccaggagagatgagcttctgtagcatcagctgggactggctacataattggcagaacccagtacaaaatgaaaacacgaggctccttttgaaaaaattattagaatttcaagatggcgagagatgagccttaaaccaagtgcagagcccttctgagcatggggctgtgtgcacaggtcatgaacccatgaagccagccctgaaaagagttctaagtttgaaaatatctagattccatctgccatagagtaccagcctgtaatcagaatgtcacatttgcagatacttcctaagcagctgaatgtatacaatgacctgttgatcagagggatgctaccctccagaaatgaatgtgttactaggtgtctccaacattaaatctctttggagctgtgttctgatgagctgaaccgggatgttgcccttgctggttgtacagtcataccacttcacatttcatgatagcaacaataaaacaccatgaaagatgtgttgcttcttgtgcggcaggcactgtttgtctcatggcctgtgagaaaccttccaagacacagcccttcaaactcaggaccctgtaagtcagattaactgtgaccacagactacatgagttgttatgagtaactctgggagaaagccgcctttcgttaaagtggagactgagtggattcaaatgcattttaaaacatctgtcatggccagattgccatttcaatagccccattgcctgcctggagcttttgcatgcatgagtatttctgctaggaaacagaaaatgtttggattcccaatttagaatcccttctatgagttcaaagagtttgggcttacactgctcagcagtctcctggttttgtttctttgtgccctcatgaaactagagctctgtgtcactttgctctaggaagaattttgttgttggtgaagaatattcttgatagttagcatctttgaaatctctatgaaaatgagaaattaagcacaaatgaacacaagctctgctgaactctcaaccccccaatctttctggcttcaaattttatttttatgggttttttttcatgctttgcaaggcacaatttagtaaaacacagcaatattaaagtgtacgtcttgaagaaatttgagaaatgcacatggccattacccagattaagatataaaacatctccatcaccccaggaagtttccttatgcctcttccagttagttcccctgctcagaggcaactgccatcctaatttctatccacatagattagtgctgcctgtttttgaaatccatataaatggaataatactgtatgagttaatgtgtctttcactgtacgcaatgcttttgagactataagttgttgtggacatcattagtttgttcctttattgccaggtagttttccattgtatgaacacaccacaatttgtttatctactctcctgttgatagatatttggggagtttccagcctttggctattacaaataaagcttctgtgaacattcttttacaagcctttttgtggacatacatactcatttctcttgggtataaagctaggagtggaattgctggttcatagggaagctgtttatttaactttaactgccaaagaagttttccatcaatgtacaggagttctaattatttatatctttgccaacacttggtcttgcagtctttataattttagtcatactgaagggtatgcatttatatctctttttaaaaaaaatcacttttattgaagtatgattagcatacaataaaatatgccatcttaagtgtgtaggttgactaagtttggcaggtatatatatccatgtaaccaccacatcaagatatcaaatatttccatcaccataaaagaaactcttcatgccccttcccagtcagtgcctggtagcaggcaaccactgatctattttctgaccctacagattagttttgtttgtctagaatttcttagcattggaatcatattgtatgtgtattttttggtctagcttctttatctcaacatatttttgagattcatgcatgtccttgtgtatttcagtaatttctttttattgttgactcatattccactgtacagacatatcacaatatgtttacttgttcatctgtggatgaatatttgagttgttttctgttttgtgctattatgaaaacagctgcaataagcatttgtgtacaattcttttggggacatatgttttcctttctcttgagtaaatacctagaagtaaaatggccgggatatatggtaagcgtatgtttaactttataagaaattaccatacagttctctaaagggttgtcacattttatgcttccatcagcaaggcatgagagttccaattgttccatattcttaccaacatttgtcattcatacagtaatcatacagtatagttttaaattctagcaagtttagtggtatctcttgttttaattcacattttcttgatgaatagtgctgataaatatcatatcttatgtgcctatcagccatttattatcttattttgttaagtttccaaatcttttaccagcttgaaaaattgtttttttttttttatcatatttgaagttctcataactgaaaaattgtcaatttttgagttgtaagatctctctgtatactctggaaacaagtcacttgtctgatataagtattgtggatatttttttcctagtctatgtcttgccttttcattttttaatgatatctttcaaagagcatgaattttaaattttgatggagtccaatttttaatattttcatctgttcttgttgggtttttcttgtatcttaagaaatctttgtataccacaagattgcagaggttttcttctatattatcttgaaaacattttatagttttaataattacatttaggtctatgattcattttgaattcatttttatatatggtgtgaagtagagggacagtttaattttttaagaaaacattgttataccatcattttttgaaactctctcctttccccattaaattacttttgacacctttgttgaaatcagttgactatattatgagtctgtttgtggattctctattctgtcccattgttctatatgtctttcttcatgcaattatcatcctgtctttcactgtacacaatgtcttgatttttgtagctttatagtaaatcttgaaaccagacactgtaagtcctataatttggttattcctattcaaaatgtattggctaatctgggttcttggtatttcaatacaattttataatgtctgcaagaactgatgatgggattttgattgagattacactgaaattatggtttgatttatttgtcttttttctttcctcagtaatatttttaaattttcagtttttaggttgttgtgtatatctggctaaatttattcctgagtggtttgtgtgctttgattaaattatacgttgtattgtttttctggtttcatctttcaatccttcattgattacaaatagaaattcagttggttttggatattaaccttgcatcctgaggccatgctcaatctacttatagctctagtggctttttaaagtagatttctggattttcttcctacataattaatacatgattgtcttttctgggaaaaaaaaaagcttagtatttctcctttgttttcaatgtgtatgtcctttatatcttttgattgccttgtaacactgtctcagatatcttattcaatctctctgtggctttaatatgcatctccttgctgagcaccttttcatatttattgacagtttgagtattttgagaatttctcgatcacgtcttttttcccattcctattgttttgtttatttgcattatttgtaggaattttaaaaatctaaatacaagtccttcattagacatgtgtttttaaaaatttctcctagtctgtggtgctttttttttttttacttcagcaatgatgtcttttcatgagcaagagttgtttttgtttttaatttgatgaagtgtatcaaattttatattctaggaaatgttttcctacctcaaagtcgaaaagatattctcctgtgtttttgtctggaagcttttaagtttttagatcaatgattattttcttgaaagctctgtgtgtgtgtgtttgtgtgtgtgtgtgtgtgtgtgtgtgtgtgtgtgtgtagtttctttaatattacactcaaatgctttttaccatttttatgggtaactttggcaaagatgaaaattgtataatatataatgctggtaattggattgggaaagaaacactcaagatatgctgctggaggtgcaaatgcatacaacttttttggcatgggtaggaaaaaattcagtaataagaatcaaaagctgtaggaaccaaaagccttaaagatgttaattcctgaaactctataggttcatatcaagacatttatcctgtagaaataaccctgggtgtgtgctaaaatttagcttcaaggatgtgttatcacagtattttttaaaaatagggcacaagaagaatggaaacagtctataatagtggattgattaaatgatcatatagcgctattatggaatactgttaaaccactgaagataatactgcagaatattgaatgcctgtctttgtctgttttgtgttgtgataaaggaatatgtgatgctatgtaatttacaaagaaaagagatttatttagattatggttcttcaggctataaaagtactatggtactggcatctgcttggcttgtggtatgggcttctgtgctgtgtcaaaacatggcagaaaaggtcaaaagggaagtgggcacatgcaaagagggaccaaacccaggagtatcctggatttataacaactcatttttgggaaaaataattcattcccttgagaactaattccatttcacaagagctagaactcactactgcaaaaatggcaccaagtccttcatgagggatctgcccctatgactcaaacatttcccactaagccccacctcccaacaccaccacactgaggatcagagatcaacatgagatttagtgagggcaaacaaactgtatccaaaccatagccatgccatagaatgccacactttaaaatgaaaggcaaattattattgccatttgttcactgctttataattttaatttgtccctttgattgcatatttttattcttctgtatgactaagaaaaagggcttcttgtcccctgccaaagagttgaaagcatgccagagaagtgccaccatccaaaacatttctcttgctgtctagcattccatcttctgagttacaatgccttggtccacttataatttggtgagatttatacatccatttaaattttcattagctggatatggaggtggatgtaaacaagaagcattgattagatctagaaaaggtggtatgtggacccaaagaagcaccaatagataacgctgtagacagacttggggatgaaactgttgtgtactccctggaattttgctgactcagctgtggtgtggtgtgagggtgacacctttagaagactgtccaggtctctttggagtagtgtgtgcttgtcaagtttacagcttgtgggaaagggtaatcagaacatgcaaaggctcaatcaacctttactgaggctccctcaggcatggtactcaggcttcagggcccagagggtacatattgaatttcactttgcaaagaacccagcattagagcctggaccccaggagcttgggtctagtggagcagttgagcagccaaaaggagtgttgagaaggcagctttaacagggcatatgtgttcaatatcaactgaattcagaaggtcaagctgctggagttcttcatctgattaaccttcatcattcaaatattctgtgctatagcttttcaacaggaaattcacatgtacttaaaatgtactttttttggcccaaactgtctaaatgtgcattgtgttagtttcctagggctgccaaaacaaatgactacaaactgggtgttttaaaacaagagaaatgtattctctctgtcagttctggaggccagaagtccaaaatcaaagtgtcagcagtgccatgatccctgtgaaggtgctaggggagattccttccttgcctcttcctagtttccagtggctcctggcaatccttgatgttccttaacatgcagttacatgactccagtctctgcctccattgtcacatggacttctttcctgtgtgtgcttgtgtctgtatgtgtcccctcctttttctgtaaggacacccttacaaatttagggccctcccgaatccaatgtgaccatcttaactaattacatctgcgaagatcccatttctaaataaggtcacatacacaggtaacatggggttaggacttgaccatatctttttgggagacacaattcaacccgtgatttcaatcactgtttaaatatcccttttggggttactatgttgtactgtacattcctctttcttgcatttttgacccctgtatgtaccatgtcttttgttcataagatgactctgagaaaccccctaggctcttctctggaattcatgatgaagataattcttgggtttctataatcatagaaacagaatgttcagctttagctcccgagagacttcaagtgctggcaatgtttggagggaaaccggatgtgagaaaatggtagggaggctaagggaagatgaggtttctggccatggagctgactagggcagcggtcaggggtgacctattagaagatgagggtacagagtggggccaagaattagagattgagcccaaacaggaatgcagcacatctggcctagttggaggcaggggtggatctccagcagaatatagacaatgggacccatcttggcagacacctaaaggagaaggggaacttgttgtccatgtccagtctattagcaaggcctcttacctccacatcaccatgtgacagatctgttcagtgactcccatttccttcactaaaaccctatttctgctcccacagtctttctcctagactaccaatttccccttctattcaggctacctcaaattgttctccaaagagcaactgaatcatcttttcaagcataaaccctaagttgctgtatgatctggcccctgctcacgcattctgtgtcatcacacctcagtcactctgttttctttatgttcctttaacacaccaagctccttaccacctcaggaacttttcacccgctgttcccactgcctagaactctctgccctcatatgtcaatgcctgattcttggccttctccccttgaaacaaccttctgtgaccctccagtctaaagtggtgcctctccatctctgtccatcatccaattttattttcttcatattgcttaccactatgtgaaattattgaattcatttatgtcagtggttcttaacatggagggattttgtctccccagggcaaatttggcgatctggagatttttttgttcttacaactggggtggagggtgctaccggcatctagtgggtggagaccagggatgctgctaacatcctacaatgcacagaaccaccctcacaacagggaatcattcttcccccagtgtcagtagtgccaaggtggagaaacctatttatttgttgcttttgtattctcaaatctgtgcttaacccttttgaatgtatatcccaagaaagcaggaaagcaaactggtatgtgtcttgttcgttgctctgtctctcccccagaacaatgccctggtcagagttggtgatcaaaaaataattgatggattaatgaatgcgttaatgactgaatgaatggtctcaagccctggatctgtcctttcctagctttttgagcctggggacatgtttttaagtgaattaagccattgctgacctggttcagcctcagtttgaggtaggccctgtatccctgggtctcaggatcagactattacattgtccttcccccaaggatgattccctgcatcccccaggggtacagagatttttcattatctttttcagattacagaaagaattttaaaaatgtattactttagacaagtctgatatttttatgaaattaattatttccatccagcaataggatatgattcatttacttcagtcttctttagtatcatttagcaaaattttataatttattcacatacacaaacacatgcacatatcgttaatgcacatttctgaataaagggattttcatttttcctattgttgtggtccaaaagtagactgttgagttttaaacatattttttgctatatttaaacaattctaattaaatcctttaatggttatgaaaataatagtaatatatttccaagtttacaatttccatttttaattttctttgatcaagtgattttttaagaagaatactgttgtttcttttttatttttaactttcaagtgtgaaaggcttttgttactgttgttgtttctggttattttacaattgtctctttataattactacattctttttaaattgatgatgagctggtctttatattttagaataattttagatttacagaaaagttgcaaagattgtacagataattcctgtataccctgtacccagtttccatttcttctaatgttatcattttactttactgttctctcatcctgttttttatccttgtggtgggccaaacctttcagagactcagctactaaaagatacattttatatttaatatgaatagagaaacctgtatatgcaaacaagaaggaaagttgtctaggaaggaggtagaagtaaagccacattgctgtttccaggtttgcaaggcccagttcaaaatgagaatgcagagccccttgttcaagaaatattaagaatttcaagatggcagcagcagagcatttaactcagcacagagccctttgtactgtgaagccctgagccactgcctggtttcatgcctgtgaagctacccctgctgttcctacagttgaaagtaatctttcaacttcttccatgatacaaatacctcagtaagttaagggaaagtgtcctgcacgaccaagctaaatctactcatatttgagtttttctagaacactcaaagtcacaagctttgcagcttgcctgccttctaaatctaagttcaaaaggctttgagttgaggacaatagtattagctaccctgaaatggcagtgaagctaattctaaaataacatccacattagctcacacaggctgatattttctttgctgaagatcaggcaaatggagtgtttgttttgagtgccttccaataatacttacaagtagccaagaatgcttgggctcttggaaactgtacctatgcccagaggctcttggtgaatatatttttttaaccaggtttactcatttaacttgtccaaatggggcactttcacaagggaacccatcagccagtcatttctgatgaaataccaaaaggacctgtgaggaaatgaaatacgagaggtcttggtaaactgacattttgaaagtatctgggaaatacattgctggaaattggtttagcttcatcatttatttatcaatgttcaacaacattgtatcttgaaatttgagggtacaatgtccacttacagtatttggttaactgtgctagccagatagcaacatacctacaacttacaacatacacaccatatgtactacataattccagttaggcccatcttcccttctgcatcccttctgcactgatgttctattcatcatggtgaaaaaaaggtatcctggatctgaggctgcttcctcctgtttatgcaacatgggcactggctctactgtggaaccgaatcccattagatagaacagatgtacccacctctctctcctgcctcttttgactcacaagtgtgcccccctagtttctgggaattaactcccactgagagcaaatggacaggtgacctatgagaatgacattgggataggcttttcttctgctattattcccttccttgtatgtaggcattgtgtgcaattagcgtgaaaatctaatactttacatcctcccacccttggaccttggaccttagttcctgggttgcaaagaggtcccaggttggaccttagttcctggggtgcaaagaggtaattgtcacttatagttttgggctgtattttagtggattagagttgttagaagtctgcaagagatttcaagtaaaagactcctcaggagactatgtcagcattctatgggcatatatgcatgcacatatctatgtaggtatgcacacatttgagtatagtatggtacttgtgtttttaaaaaatcaaatttgtttaaaacagtacagaatacgtcagttcaaagagcaaaatagaaaagtaactaattaagtttctagaattagaaatagaattgccttaaagattgctttgaatcatttatttttaataacatcatcacatttgttttctaagaaaggcctgatttatgtgcagattatcttcctagaattctgacatagtttcttaaaaagcattatcatattctaaaagacttaatttttgttgtgtcttagccagttcaggctgctctagcaaatgccatagactgggtggtttgaacagtaaacatttatttctcacagttctggaggctgggaagtccaagatcagggtgctggcagattctgtgtctactaaggaccttcttcctgatttgcagatgcctgccttcactcatatcatcatgatcatctctctcatgtttcttctacattagtgtctttataagacatgaattccattcatgaaggctccaccctcatacctaattacttctcaaaggttccaccctcaaatactgtcacattaggtattaggccttcaatatatccacttcaaagggatacaaacattcattgcatagtaccttgacataactacatttttgtggctttccctttttgtcatttagaaattgccacttagcatcaattctgtgtttcggactttgttggaagaaattttctcaaactggaaagcaaaaaacagattagaaaatgttttctagaagtcatttcagatattttaagtacttctgctactaaacagataccacttgattaatatttttgccaacaatgtccatctcagataaatgttctttacattttaaaaatattacttttcattaactattgagtagattcaaaataaaatttgtggttaagaaaagaaggacgtgatggctagaacactagaaggtaccaggatttaaggaacagaggtggaagagaaaaagccgatgaaagagagaaggcagaaggctttagaaagattactgtgaaatgaaggggcaggggctgagctgcattcagcataatttcttcaaatgtatcatccaggttactgattcagctatgcttaatctacctttgaaactgttcgttgagtttcatttttgtttcatttcttattatattgaaatgtatacacacaaaagtatacaaattataaatgtacagcttcatgaatttgcaccaagtaataacagtcatataactagcaccctgatcaagaaatagaacatcattggaatcctacaaacctcccttgtgcccaatcatgatctccaacccaccatctccaaaggttgctaatattctgacctctaccaccatcagttagctttggccatttatttatttatttatttatttatttatttatttatttatttattcattcattcatttaagacagagtcttgttctgttgcccaggctggagtgcagtggcacaatcttagctcactgcaacctctgcctctcgggctcaagtgattctcctgcctcagcctcctgagtagctggaactacaggtgcatgctaccaagcctggcgaatttttgtatttttagtagagatggggttttgccatgttggccaggctggtctcaaattcctgggctcaagcgattcacccatcttggcttcccaaattgcttggattacaggcatgagccactgtgtctcaccagctttggccatttttgtactttatataaatggatatctacagtgtacccttttgtgtctgattctttgcttatcgttatatttgtgagtttcagcctcagtgttgcattcatctgtagtccattgctccttgttgctttgtggcatttcattctatgtatataccataatatatccattctactgtgatttgtgttaagagttgttttcacttgcaaagtttaaggtaggaaattttcctgcctttggttgagagagggctgttctcccttaccataaagatacatcctttttagagacccagagtgtttttttttgtttgtttgttttgagacagggtcttgctctgttgcccaggctggagtgcagtgagccatgattgtggtgagtgctaccacatccagctaatttttaaatatttcgtggaaatggggtctcatcatgttgcccaggctggtctcgaactcctgggatcaagcaatcctcccgcctaggcctcccaaagtgttggggttagaggcatgagccaccatgcctggctgagtcccagctttatgggaaggactgtcccattcaacttgttaccatgggcaagcctagaattcgcattttgtccactgaatcctgtgaggtcaggaaaacagaatttagattcaccacattcaacaaatgacttcaaggcaagcactggctgtagggctgcaatgttcttcctgattattttgagacataagtgttctttacttttttgtccactcatgcatattttaaatagggctttaaaatacattatccaacatccctagttgttttctgtggaaggctggtgtgggtattcattctgccttactgtaagaaacatatatagacatgtactttaaaaatgccccttgtgtttgggtgtggtggctcatgcctgtaatatcagaactgggggaggttgtggcaggaggattgcttgaggccagggattcaagatcagtgtgggcaacatagagagacctcgtctctacaagaaacaaaaaattagcctggtgtggtggtatgtgcccatagtcccagctactcaggaggctgaggtgggaggacagcttgagtccaggagtttggggttacaatgagctataattgtgccactgcactccagcctgggtgacagaacaagactttgtgtctatagagagaaacaaaaaggcccctggatttgtgaaaccaatgtatctattataaaatttaaaacaagtgaggtgtggtaatagtttttttttttttcatattctttctcaacctatataaggataccaaagaggttataattttttaccgaagttgtcctcttctggttttgtttgtggagagtaaatagtttatttcaaaggcttagacttgtgtcattttaatatttccctcacaaatcattttgagtgattcatgcacaaaatatttttaggagctactttttacattgttttgaggtaagcctttatgggtttccaaagatggtagtacaggagtcaggagtgaaaggaaatgtgtactctacaaagagaaatatgatcattgacattcaagaggcccagaaaaagtgctctgcaagttcaaaggagaagtttacttccttttgagtggatcaggaaagtctctgtgtaggaaaagacatctgaactgggcctcggaagatgggcagggttaactgttctcatggaggaggaggaagaggaagaggaggaggagaaggaagaggaggaggaggaagaggaggaggaggaggagacatactcgtctgcatgagttcaggtaggaaaatatagttgagtttgtctggaagaatgcattcatagatttagaactgtgctatccaacgtggtagccactgactaccatgtggcttttgagcacctgacatatggctcatgtgactgatgaattcattttaatttaatataatttgcaatgaagtgaaatttaaacttttaaaaaagtgatgctgtgttcagtttttggaaaagttttaagtacgtttggaacaacttgggtatgtgaatctattcttgcaatcatatattttatgaagtctaagtccagatcaagtatttctaatgaaaatccactgtccaaattgagatgtgctgtaacaatgtaaaatatcttattaataattatttatttacatcaattccatgttgaaatacgatttgggatatttgggttaaatgaaatatatagttaaaaagtcagtttcaactacttatttttacattttttatctgactaccagaacattttaaactacatatatggcttgtatcacatttctattggacagtgctactctacagagaaggttgaagcataaaatgagagtgtcttgggaactttagcaagttacttatcttctctgagcctaagtttccttatctcctgtggtttttgcttcatacaagtattgagagggcaaaattagagttgcacgcaaagcccatgttaacacagtaacaacgggctcaataattgggtatcattattcttttatttaaagggataaaaaggtagacaagtaagttctgtagaaaagggaagggacagtgagagtatctgatttataaagtatgtaatggcatgggcagttataaggatcatagacccgaagatcagtgagtaatgagtgatgcgtggcgacctggcaaacaagattaagaaagctgaaagataacagatgaaccgtgagggatgaaggtggtgcagtcagaagattgttctaggcttggaagccggttctgactttgccgtggatagatggggaagccagctcacttactatgtctctttgtagcatctgaagaatgacatggccagaccaggtggccacccagattactttagggccaggtatttaacttggtagaagaaatggaagacaaatttttcataaatgttggtgttgctccttacatgaagctcattatagttaaggaaacagaagcattttatctaaaggtaggtctaaggaacttgtgatgacgtattgaagaaaatgagcagtgaaaacaaagaggaataaagtcttgaaagaagagattggcacattctttagctttgcagttgaacttgcttggcaattactggagataaggaaaagaagaagggtttggccaaggtttgttaatctttataaacaggcaggaacatcctgtgccttttcccctgtaattacagtttatgaatatttgtttgagtgttaggatacttttttctttgccttttgatacatccttgtgtgtactccttgtttatctgtgacttagtttcagttttcatgtctatgtgcttcagaaagtcagaaaaattaatcatatgagcttaaaatgccgatcaagaaaagctcagcaagatacattgtattgaatgcagtgatttcttttaaaataaaatattaaataatttctgcttacctggaggtaagggaatagctttgtaaatattccttttttggagaaagttccactgtggtttatattcagccacaaagagggcatgcttcttatattatatctcaaggtggaattcattttgcatgtaaacaatgtgtagatgaggatgaggtttagccgcatctatccaaaaactcaaagtaaccatagctgaaaaagataggaagttattattttctgatttagatgagactggaatagtgacttcacatttacctgggacccaggtttcttcaagctccctcctccatcttcctagcacatgtctttcttctgaagggcatttcatggtttaagatggctgttgctttggcagccaactacgaagcagttgacttataattgaaggccatgttgtatttaaagaatgtatgacttcgaacactaaatgcggttcatagtttagcttagtgaggtgctgtctgtgggaagcacgcaaagacagacaccgactgaacaggcagttgtgatgactttaatggaatcacattttcaaagttatgtgcactcccagggggacacactcatgagtgcaatgtagcatgtaatcaaatgtttgaattacaggctgggttcagtggctcacacctgtaatcccagcactttgagaggccaaggcaaagggatttcttgagtccaggagttcatgacaccagcctgggtaagataatgagaccccatctctacaaaaaatcaaaaagttagccaggtatggtggttagtgcctgtagtcccagctacttggaaggctgaggcaggaggatcacttgagcccagaagtttgaggctacagtgagccatgatcgtgccactgcactccagcctgggtgacagagtgagaccctgtatcaacaaacaaacaaatgaaagaacaacaacaacaacagaaaaccacaatagttgaattatgttttttcataggcattctcccatttttccctccatcctccctctccacacgccccacccacaccttttccagaacacccatagttgaattcaaggtagatatatttgcacgttacgtaacttcactgtatagtgaggtctccctactcctccaacaccaccttccactctgctcaggtgatctttggatcctgcagttctgtactggatgcagaaagagagaaatccaccaatgctaatgggagacacctaaaaggaatcataaagtaaaaagatggatacccagatttctggctgggacagactgcatttctcagccatggggcagactgcaagaggagagatacaagaatacactcaagtactttcaagggtctcgccactaccttttaaaagccatttcagtcagccatgcagttagtggaaacgcctgtgacagtctagcaaagtgctggcagaggtccagtttttgctcacactttttagctttgatggtgtcaccataggtatttgagtttaaaagttggaagcaaatgcatcatagaatccttaccacacaacattataaatttgaatcccatgcaggtaaagcctttatattggatttgagggatgaaatggctgctttctaagatttggagaatcagaatgttatcccaaatctcattataaaaatcaaattaatcgatttggagtgaattgtcaaacacagcacgatggtaatgttttctttcttgattgagtcattaaactacaaaatcgctgctatgtttctattctgttattccttaaccacagctgaaataaatttggaaagtgttttcagacagttgggatggaggaaacacaaggacgccattactacactgtacaaacaatgcaaaggtcgctttcccacatcatcccaaggcttgctgttaatctgggacaaacacagttagatattttttgatggagagggcattgtcgtgggtggagaagagatgaggcagttcccttcgacccagctgtgactcagctcaggtcacaacttgtggccttaaatctcaaagagaattagatgtgtgtgatttcacaagttggactttcttttattgaacctatttctaaagcacaagaaggaaatgtgcagcctaccgtgcattaaaaggccagtagacactcttactatctgtatcccctggttccttttgtgtctcataaataaaatatctctacaaaaatatggaaaatatcctcgctctaaattaggaaagcagccttgctttaatttccttctctgcaagttggcagctgggtaaaagaaaatattttgacttccagagatgctattgtccctccttcagcctccctcctagccctgggcttcaggcagtctgcagggtgttctttctggccagtctctggtcagatctgatatgcttcttcttgagagaggcccctgtttctcagccagcagaggctgcagtggggaagagttgctgcctgcaggaagtctaaagtccagtcacatctttcagctccatccttagcctacaagataggaatgtggtttccttgataatgttctgctgaactgtcttgtacacaagataatgtttgcttcatcatccctgaaatatgtttccaaagcttcgttgtgatggtcaagaagcagtccgtaccttggagagaggcccggggaatgaaattcagagagacaagtatgtcaaccccaccacctcattcatgtattcattcagtaaacaaagtgtctgaggttctactgagtgtccagcaagtgtgttaggcacttgggggatagaagtgacaaacacagatagctcccccctttgtgtggctacgagtctaagaggtgacccagacagcactttctgtctctctcactctcttgcttttgctcactctgtgtgatcttgcccctccctatctctccaatgatttcttctataactcttgtccttagtcaccacacaactgtcacactgagcttcttactctttcgtgaacatgtcagtaattccttccccacagcctgtatactggctcttctctgtatatgaaaagatttccacagggtgggctccttctttgtttgtctcttcccaaccagcttgagttacgtgagatcacttgactggttttgcagcatggactgtgaatggaagtagcatgtattactttctggccaagaaagtaaatgaccctccagctctgtctaagcaatctgttaagatggtggcatctcagtttggaggaccctcgctcagctggagtccattagtaactacaagaagtagagcccccgaaaacccacagcatcactgaaaaatatgtttccattgcattaagccagtgaggctccatggttaatttgttaccccagcataaccttacctgactaataaataagctcatttgagtggagtagacaccattattattctcactttacaaatgaggaaacaggcacacagaagtaataatctacctgtagtcacacagctagtaaacagtagaactgggatttgaacccaggtagtctagctcctaggactgtggtaaactgcacaaacaatgcaggaggaggcacttaaatataattaggtccaaccaagggaagtacggtggaaaattccagcctgaggaagctattctggagtggtacacacagcaggatctcaataaatgttaaatgaatgactggatctttttaaggagcagtatattcaattgttttggctgcataagagagtaccacctagtggcttaaaatagcacacatacattatcccacagtttctgtgggtcaggaggccaggaacacctaactggatcctgcactcaggatcatacagggtcatacaagggtcctatgaccctaagtgaacgtatcagccagggctgctgtctcatcttcagctcaggatcctcttccaagctcatgttgatggcaaaatctagcttcttaccattgcagaaataagatacccttttcttgccagctgtcagccaggggttgcactgtgctcctagagtccccttgaagttccttgccatgtgaccatctcacaggccctctcacaatctggcaacttacttctcaaaggccagcaggagcatctctctcctgtaggctactatggagtcttacacactgtaatataatcataggagcaacatcccatcacctttgccacagaaggtaacctaatcaaggggcagactgttccatcatattcccaggtcctgcctacactcacatgggaaggggttataccaggtgtatataccaggggatgggaatcttgcaggccatcttttaattctgcctatcaaaagcagtgaacaaggatcaactataacactttttttttaacactaattcattggctactcactattaaatgcacaacctagggctgaagtctgtgaatggtcacatattaaatagaccatgtaagtcacacctcaaggaaaagtaagggagttaagacaaaatacagaactcacacttggcccatgaattagaaacttgagtaattaaagacagatgttctgtagggtaattggggtgaatgaaactggtgatttcagtatatgcaagctaatctttccagaaccccttttcaaagttcattttattgagcaatagtttaataaactgcatccatttcaagtgtacaaatggatgaattttgataattgttgtgaaacgaccaccacaaaacaatagctaaacatttccatcaccccaaaaatatatctgatgccccttgatagtccagatatttctctacaaccccaactcccaccaggtagcctttccagccccctttaactgtccttttaattaaataaaggcagtatggtacagtggtttggcactcaatacttgagtcagaatgtgttgtttggatcttcctttccctactttcttgctgtgtgaccttaagcaatttactaatttctgcctgcttcagttttatctaaaaaataagatagtgcttctctgaaagatagtcatatctcgaagaattcctatgagaatcgatgtagttgatagatgagaagcctaagtagttcttggcacatcatgagcactaaataaatgtttaccgtgttttttattgttattgtcaatattgttcagttcaattaaaaagccactataaagatggctagtagaagttaatgttcattaaaatatatttatgtcttttcctggagcactcttcccccagatataagtactccaactccctcctcttctttgaatattttctctaatctcaaactctgattgaagcctaccctgaccacattatctaatactgcaagcttcctcaccccaccccatcccacctcctctttcctgatgtttccctaccctgctatagtttttacttctccttagaatttatcaccattaacatcctaaataatttacttatatattatatttactttttattactatctctccttattagaatgtaagctccatgaggacagaaatctctgcctgttttgtttgctgatgtaccccaggctcttagaacaatgcctagcacatgatcagcgctcaggaaatacatgctaaataaaagaaattggaacctgtggcctaagctttatttatattatcacatataactcttaaaacaaaaccatgagatgtagatattatcactaccttttgataaatgaagaaaataaatcttggagagatgtagcttgtcacaatatacacagtttagttggtgctactccaagacatactctttttggctgtagtataccatatggaggagcttggaggaaccctagggtggatgtgacgagtcagacattgttgcccagctctagtaacccacaagcaatttgtgtgtttacatgcactggattttggatccactggcttatgccaagccaattccttattcctgccctgctgcttttgaaagtactggagtggcaagaggccgaggcatatttttgaaggatgagctcattccctggcccgcagccttactaaagtcttcagtaaatctattgaatctatggcaggaggttcagctgcatcaaatttaggattatcttgctttaatacagctaagactgcagaataatgaagatttggaccatcatataactctgaatcagggaccatcttaatacaggaaagatctttaaagtatgactcccttccatttttttaggctgtgtctacacatcacaaagtaaagatgtcagttatggacactaactgatgtgggtttatttctttgctctatctgtcttggtatggattttccagaactagaccctgggaccaggaattgagttcaggtagtttatttgggaggtaactgcaggaacacagtgagaaagtaaggaagacaaggaaaggaggaaagctaatagaagctatgttaatgagttggttactgctgtgggaaagtggggctaaatgcagctgagggcctgtgtagaacacaattcagaaatgtcccagtgaggggtgatgatgcaggggtattatgccatcatctgtaaccttttctgggcccttacctcccctgcacttccagcctgaccagtgcaggtgacctagtagacttccattgccggagatcgccctggagcagtttgaatttaggggagctgtctgcagctgacctctattgaaaggcagttctccatgtgtcgctggcatttctaacatcttgtgaacagaggcactcacacttttggaatatcttttcaaaaatatttgtttagtgaacagtctcaagagggatagaggtcatgtctccctctagagagaagggcaggtttgttttctgtccctaaggaagagaatgtcttccttagggacaaaggttaggcaaacttaccatccatcacaaaagatttcggttctctaagctcagagatgatgtcctgtaatgcagtccattatgtgagcaggtgtcacctgactcccataagtcaccttgtagggactggggcttggagggactggagcaaatggtgatgctctggctattactattgttgtgaataatatattgtccttgatcttggactcaggtgtctcatgtcttctaacagcatccatgaaactggcagaatgactcattcgcttgaaagtagagtaaaatttcagacctatcacagtttttggggacctccatggtggatctaggggatatgcacagggttccagctgtgactaccaaatgctatgcttcgctctattgatagcagtattaacaggatagtacaaaatctctgttatgtcctgcatgtttgattgagcctcagacctaagcattgtgttcctctaagtagaccagccctcttttaaggataaaaataatattaggggcaaaacctatgagtgtgtagaagtatattgcctattgaatactcactatatatttcattttttcaaggcaagacacgttttctattttgtaatatttggaatagaatagattcactgattagtgaacattgtaattattcttttctgaattaattatgttgaacacattagaaaattgctaggattgtcttttgtaatggaggtttcatgttgtttccattttcaaggagttctctcacgtactgtggtatgcagagaagggttgtcttctgctgggcccaaggaggcatcagtgggcttgccccacctccaccccttgccactggttaagttgggtaattgaagttctttattctatgaggccaggtctgtcatatatcacaatttcaccaatatgatctggatctgtagctaaattctgtcccatttcaaagttttctttgttctttcacccttgtcacattcttttaatgacattgggcagggcaggtctctctacctgttttttgttttcctcgaagaaaatcttggacacttggaccctttccttagcaacttcaaaggaaaataattagtttggattttgattgaaattgtaaaaaatctgtaaaaaatggggaagaattaacatcattattgatattttgtcttcatattcatgaacatgttatttctctcattttacttcaggcttctttagtggcttacgatagttaaaatgtgtaattttctacataaaatattgcatattttgattttgtatggtatattatatattattttgcaattataaatggcacagtttttaatattacagtttacaactgctggctgaaagtttatagaaatgcactttgcttttgtatattgaaattattgcagccaccttactgaactcttgttaattctaataatttatctgtggattctcttgagttatctatgcaggaagttatatcatctgcagattataacaacaggttagaaattttaaaacactttcacatacattatgccatctgattttcccagagcaagtattatcatctccattatagaagtgagaaaatagatcaaaagattttaagtgacctgccataggtaccaggtaccaagttattgaggtagaagaatctagtctcatgtcatcttatttcaatccaacactgtgcctcctaaaatcactcaccttgaaaaggagatgaaaactacaattggagagaagccacggatagtgggggtagatggaaaagaggaaaataatttcacttaccatgtgaacatcaaaatatcatgaattggctaagtcttgatttattggccatagggacttacagactcctttttattttttcccgtttgcaaggtttaatattattggtatgtctataaaagtaaatatttcagttttgtcccaatgctactgaagtaatgaagtccttggctgcaattacacaactgtggcaagatccagctactgcagttgtaatggtggcctcataagtggtaggaactagtatcagtaactattctgcctctcataatgctttgtagaatgacaaagatgtcaccaaagagtctatgtttatgtcatcagaaccattattgcaaaaagaaggtcaccatttcttcttttgtcttcactctgcaaaatctgcaaaagtactttagagtttggattcagtaagagtatatcccatttcttcctgtggttattttcaaaagaggcctggaaagcaaatagaggaatttccatttagtaaatataggaatttcttccactgccttggagaatatgttttctctccaatgtcaagtagatatattggaatctacccattggataataaggaaatagagtctaggaaaactcaagagcaattaagtgttggtttccatgtttataataaagatctggcatctccccaagttgtgcttgaaaaaaatatgttttgttataaagccaaacagctcctattcccaggtagttcaatattggttcatagtctgcagtgattccaattatgaaaccaaactggattgaggtgtatatactgaataacaaatattttacaccatacatgtcctatgacatgagatccgtctcatcccaaatgctatctaaaatgcccagtgcacaccaagaacctcttaaattcccttgttgaaccatttgtttcatatggaagtgggaattacggattttcaagcaggacttctggttgtcactcacatgaggcagagctagactggctgtccaatcagtaaatgaaatgatataaacctaatcacctccaagacctgaaaaccacactccttgattcttgccaatacaactccatatggaaacttactatacaaaatactccaatgaattcaagtgccagattgttggaaaccttccttaagaaaaaagaaatctcttttattcaggtaattattttctttaacaaagacaccctcagttttatttaaggggcttaaaattaggtgtcctttctctttttctttactctgaatgcttcaaggaaagtattttagagcttatattttagagtgtgattttatagaaaaggagcttcatcgtggaaggttccatgcaaacccactaatgtttgaaatgatcctttaagaaacagcttttggctgggtgccctggctcccgcctgtaatcccagcactttgggaggccgaggcgggcgtgtcatgaggtcaggagatcgagaccatcccggctaacacggtgaaaccctgtctctactaaaaatacaaaaaaaaaaaaaaaaaaaaaaattagccgtgcgtggtggcaggagcctatagtcccagctactcgggaagctaaggcaagagaatggcatgaacccgggaggtggagcttgcagtgagccgagatcgtgccactgcactccagcctgggcaacagagcgagactccatctcaaaaaagaaacagctttttttggtttctgggacagcatgagacaaagccaaggaaagaagatgagaaaacagctgaagtgcaaaaccacaagagatttctcaggaagatacattattaatgcatcttaaaatgttatcattaccaagactgagagttgacatgtatgtttgcaggctactttgcttactcttcttttggaaatactaaacaaaacaaaagcaagtggattgataggcttttttacgaaccttgctgagcaacaatataccttcagagggctggggatgtatcatgtaactcatgtgtggcttagttttagaagagtcaagagaatactattggtacaaccagaagtaattttaaaacaagtcatttacttgaacttcttggaaacaactaaatatttaatacccagaaatattgcttacaatgtcttctttcctctcccatcaccatccttaaacactataaccagatttgtacctctttcaagtgctcaaaaatctcaagtacaagttttgcaagggtccccgttggaggccagggcaggtacatgctgaagctggacaagccagaagatctttaacattctggagaagggagtatttaggaacattcctaagaattatatatatatatgctatatatatactatatatatatattatgtatatatatagtatatatatgctatatatactatatatatattatgtatatatattatgtatatatatagcatatatatatattatgtatatatatagagagagagagagccaattccacataaaactgcagaaaataaatgtaataaatcccaaatcaaattttagcttgaccacttctaagttctgagttgacaaagtgtagctaattatttctgggttttccaaatctacactagtgtttccttattttgaataggggcttttaataaatgcctttaataaatgcttttaataaatgcccatgtaaggatgcctctaagtcagtcttgcagcatatattagtgaggagtagatttggaaaacttgactttccacaactctgcaagactgagaaaaattgtagaattcatttagcttctgtttggcttccctttgctatttatcttaataactaagtgagctttctgcccttggacaaagcccaggggaccagtcacacagagagattcttgtgtgcaaatgcctgcttctatgaaaaaatctctgtagagtaaaattcattagctgtcatggtatgtgagcagaatattgaagttttgaaggttgaaaaattcaattatttgcttgttgagaagcatgcaattcttcagaggtatcattctgaatggaagtttttgtaaaaagaacagtaagcatagcatcggtcagaagagccagatttctcacttttgtatgatcttaggaaatgcaaccactcaatgtgtttccggatattcctctgattaggttctgtggatgaaactgttacatggactgtaaaacattgtagaaatataaaacatggcctggtgcggtggctcatgcctgtaatcctagaactttgggaggctgaggtgggcggatcacctgaggtcaggagtttgagaccagcctggccaacatggtgaaaccccgtctctactaaaaatacaaaaagtagctgggcatgatggtgcatgcctgtaatctcagctactcaggaggctgaggcaggagaatcacttgaacctgggaggcggagcttgcagtaagccgagatcgtgccactgcactccatactgggcgacagggtgagactcagtctcaaaaaaataaattaaaaaaattattattctcatttatcatgtacctagtccataatagacatctaatagatattccttgaatgatttaatgaatgaatgaacaatgtggttactctgaacccattgatggaatatttaggatttcagattgcatccatactaatattatatctcctgccagaagtctggggtcaggggttgatacgtaattgtggtttttcttgttttcctaatttttgcatgagtttcttttgttatctgttgattttcatcttaagtgtcaaacataaagagtcatttcaattcaacagacatttattaaacccttattaaatgccagggaagacatcatctctaccttcaaggagtttccagtctagcagtaatttcaaacatgtaaaggagtggtattacagtggggcagattgttaccaaggtgctatgcatcatggagaaagggcattgtcttactctggggagcaggggagtgacacctgtgcggggtgcagaaggtactgtagacagagtgagcagcaaaagcaaagctgaaagtatagatgagtgggggttgtgagtctccagaatgttgttcttcagaactgttacttgtattgctagattcgctttcatataaaccctctttcaacttgaggaaccacgtttgaatatttatcatcagttgtaactaaggttttacttcttgaactgtaatgcttgagtggactgattgttctgtgaaagcaattagcaaatcaagtcagatggcaccagaaagctgcactgtgaactcaaggggtacagaaaatatactccggctttgttgctatggtaacaagtggttctcctgcgttttagttccattataggccatggtgataacagtttctctttgggtaattatgaaaaataaaggagagagaaagaaaagccacatcttggtgtttgcccctgcgtctaacagctgcattttattcctgcaactgttaagggtattggaatgaattcttgtaaggggcagctattgtgataactcttccctgaggatccatgtgacattggctttatgaacacttccaatgtgtgcaggttacagggaggctaagcatccctgggcaagctatgctgcacagccagatccacgaatgggaatgctggggtctctcacctgcactcatattaacagccctcttggtaattctccagcaagatgccatcctttggaccagtggtttgcaacggaggtcagcggtggggaaatgggggaggattttgccacccaggggacatttgataatgcctggagacattttgattgtcacaacaatggagggaggtgtgcaaatgacatttagtggacagaggcccagggtactgctaaatgttcttcaatgcacaagacagctagcaccacatggagttatctgcccacaccggttcatagtgctgaagattagaaaccctgctttggaccatgattttcatcttttggaatggctggcattcaggaagtactagcagaaccagtgtatgaatctgatgctgtaaaacggatttcttcggggtgagttttctgtgacttcttagaggatgtcggagatgttcagccttggaagaacgtgcattacaaagggcaggctcaccagagccctgcagtgaagggctcatctcacactagcatgactcagaagcccagcaggctcaggtgctcagttccagaaaaacatttctcttctcctcatattgtattacttgtttagaatttcacgtaggtagctgagcacgttgaaatgacacgtttgttgtatttagtttgaacaccatatgttgacggggctgcaagcccaacaagctgtttttttataggatttcagctatcaccctttcatcaacctgggatcaaacatacaatagatagcaaaagaacacacacacacacacacacacacacacacacacacacacttattatttgttctacaaaggggatttcaagcataaatcacttatcacgctctatgcaaatatcaacgacctgtcagcttacttcttatttttctgggaagctctcccttaaaggagcaagaacaaactgccttgttgttggtatctaggggctgttctggtgacaactgtgagtgtccatggtcgtggaatgtgcccactcatcagccatttctgtcagggtgaatatctcacctgtcacagggaaaggatatcatacctgtgtgtcttagagtgttccccagcagcattgtggagcttcacagcctgacatttttcttcctagccaagatgtttctgacatgtcagtccacgtatgtttactcccagttttgcctaaggcgcctatgatcactgatgccagtcagctacaaatcatccaggaatccttccaaatccctggaccttgatgcatccatctactaaggctttgttagcacatctccagcagtgtgccagcccctgtgctgaaggatgcagatctaaaaatcaggaagttgtggctcatgctttcaggggaacttggtaagggaaagaaggcacatgtagaaaataaatgatgacttttaatccaagagaaggcatgtacaggggcagcgtagcccaaagaggtaggggtgcattggcctgtgggtgtagaggaggctccactagtggaggtgtgactttagagctcgagcctagaagcctagtgagaatgtgcccaggcgggagagaaaagctgggatgcattcctgggagcacaaaccaatgtgaggtcttccagggactcccaaacaacacacaatggctgcctggatgtcagatttctgttgctaatcagatgtaattgaactggcacttgagaaagacagttttggcagtggagagtaagctatatggattggggcttgcgaaggtggggatggcaggccaaagccagggagaccaatgaataaaccattggtggtgaggacacaaaggaaataaaacgtatagattcaagagagaattctgacatggggcccactagccttggtggcttgttgggttaggggccaaaggtggtgtctcagctggcagtgacaaaggaaggctagtgaagaatacgcttctcatagctttcacaacatcttgttcccagctgccccagagaagtatagaaaccaagtcaacaaaacttactcccagcctcccgcaccaaactgtattgctgcatataaaaccctggaggcatcactggcccctggcttagaaaattggatgaaggtgagacatttcaatgaaacatactttatggtaggagagaagtgtggataatgtttggtatttcacatgataaatttgagatgcctgtggaatgtacatgcaggggtgtccagggagctttttggtaggagctcagagaaagagctaagatgaacgcactcatttgggaggaattaaagactaggccagtggttcccagccctgagtgcatcatctatggggcctttcagaatcccaatgtccaggcccacccccagaccaattatatcacaactatacagcagcatattttaagggatggaggaatagttcccagaaatcgtgctggttctctgtgagagaagaggtaactttaagtggtgccagttcatgcaggggcttgagaaaagaagtggagtgagtacaggctaaaagctgcaagtcctggaagaggaaggaatgcaatggactgatggccaaccagtgctctgaaccccatctgggataagaattgtggatctgtgtctagtctgcatatttgtgcactcattttgccccagtgtacttaccatccaacttgaggaaggagggtatggtggtatggtctgagacaacggaagggcaagaagggtttctgcagctgactttggaatccaggctggataaggaaggcacaaaagtcaagagggactgatgatccagaagaaaatcaagtaaggaggaaggattggaggctgtgctcaaagactggaatatttgaggttaagatttccaagtggtacaattatagtggatgcatgacagagagtggctgaatatgctttgaggcgaaagctgttccaattgaggtggaaagcataagtgtggagaagtatttgtttagtcttcttgtactcctttgttctagaagtctgccttggttattcccaacttccttaacataaaggctgtccaatggtgactgcaagtgttttaacacagctgtcttctatagaacgggttattattatatctgttattttaaaacacccacccttgcatcaataaatatacatgtcaaccaaattctttatattaattgacaattatttatgaaaattgcaatgccttaagtgaaaaatttgtggagccagcatcccttagaaacacctttcttgctagaaccatgtgttcttgctttgtgactgtttgcatgttttattgctaagtctgtagataacattctttcttgaagattattaattatgtatacaagtacccctgtgtaaaagtattcacttggaagagacccaggaatctaaggcaggggccagcaaactgttcctgtaaaaagccgagagtaaatattttcagctttgcagactagacaatctctgccacaactactcaactctgcttttgtaaccttaaagcaaacatacaatacatgaatgagttgtggctgtgttccaataaaactttatttacaaaaataggcagtgggctggatttggtctgagagctgtagtttgttgacccctgatctaagataataaaggactctagtggattatttttgtgggaaggtttccaagttcatattttaattgatttgacttttcagttttggcttcaataaaaccatttaaatcatagtttgttatggtgctatagaaatgaagtaacttgtaaatgatgacacatggaaggttctaactacagatgggtttgtggaaaactaataggtcacgatattctgatgtagacagtcatcaggcttgtcatcttaacttactcccttgaagactcaagtacctcctccctcatcttggagaaagtgcgtgtctgacgctacagtgtcatttccttcaaccatgtaatccataggcacaagtgaaatggtgtaattcaatgttgactagaccaatgacggtattctaaactatttccttatggaaattcagtgtcttctgggaaaactaacattagattgcaaatctgttcctagcatttagagactcctcattaataagcactttttttaatagtaaaatatggcctggccaaaaaaaatctctgacaagatgtgagactcaatgtcgttcttatgatttagaagataggctgaagtgagatatacttccctacaaataaaatagatattcctcaaaatgtcaatcgaagttatgtggtttcattgtctctgtaaagtatttacatatttgcaactaaggcctattaaatatttattattaaggttgccaccctctgaggtggtttgatgtttcagtcagggcccagaggtttttttaattttttttcatcagtcattctttggaattaaatgtgtgcacgttggtaggacagaaaaggaacggaatgtcagctttctgccaacaactcttctggctacaagagaatttctcatttttttttcttttcagtgtgagtcacatggagaatttatctgaggagggcatcaaaagaaggagtgaaaagcaattaaggagaaaaaacacagttccttacatccatgttggtccatattggaaaatgaatactgagtatcatggctggttatcaatttcttttctttctaaagcccaattactgaatttttcacttggaacatgcccagataagatggaacttattcaggctccattcttaaaaaaagataccagaagtcatgatctgcctttctcactctggacatggaaattctcatcacagtggtcagttgaggtgatttcaaggaataatacctgaagggatcctttaattcaggttgtagaacaaaagcccaaacaaatcattaacaataattaacctctcagatgtaataaattacttttcaataagttagtttattgagaaatgtaatttgaacatatataataacaacagtctgacactaacttctgtaccctctgcttgaagcaactggggaactctgactgtggtgtgatgggaagttaactttactcaacctgtgagactgggtctttcttctgaaccaaccacagggcataaggttcatgctgatgtgctttggaatgtgcatggcccatcctatctatttctctagcttctgctggctttaattcagagtttctcaacctcagcactgttgatatttgggccacatgtgacaggccatcctgtgcactgtaggatgtttaacagcatccttggcatctacccactagatgccagtagtgcccaacccctgaccctcgtcacgacaaccaaaatgtccccacacattgcccaatgtcctctgggaggcagaatcaccctggttgaaaccactgccctaataagatgttgcaaagttccagatttgatatcattgaactgatattctaaaaagcattggctacatctgcatgctgctgccctaggcttctcttgacatatttgatctcaactttgcattgagtcttggagggaaggggcaatgtgtgtaggatgtccacacatctaggtttgcctaggataatccagtttttgtctgtcatctggatgtaattattaagtagcaccaccttgaaaagtgacacagtaagagtgaaaattatctggcccccatgtggtcttggaaaatggggaagagttttaagagttcttacaatgtcagaaaacttttaccttgcagaggtttttgatgccttcctgtcctattttaagagcctgggaattcaactatttcatgcccatatggaccacatattcaagtcttcagccttaactcttaacagcttcagtttttgtccaagtaggcaaagtgagctcagacaacaaggaaaagaacagtgcttttaaaagaatgttcttctcaataaaaataaattctaaagttctaagtagggagttactgctgagtttataatggctttcatatttgcttttacaatcacagtattgctgggctcaggcttcctgcttggaaaagtgctttgcaatgcttcagacagaagagaatgattttagaacaggctgggctatgaaacaagagagttgaagaagcccgaagtggtttgaaagcagtcattcctttggtgttaaagataggggaaaaaagattgttcccccttattaaatcctgtcacatgtagacaagagtgcttgttaaagcctcgagtggacatttgcattgtgtggttctctggtgtgtacctttgctaaaataagtatgcaaaagtctccaggtagtaatatgcccttgaccctgtaatcagaatcggtctctcacctggaaatgtgaagacaagatgtttggctagtaatgaaggtaagataatcatgtgggaccacaccattcaaaaggttgtctcatgctcacaagatgaatgctatatttccagccatcatgcccatgtatcagacagaaagaataaggaagaggggagctcaaaagggcatccttgctgagacagcttcccaaaattactgaagccctcaacctaacacttgctctccaatatcgatagttttttcagccaggtatttttaccacctccttcagtattatcttaccaatgaatgacaggagaatggatattgggtagacaattagcaagctctggtatatagcccaacttttgctaatgtttaaaagtcaaaaccacacaaatcttctaaaccagtggtcaacattcgctgcctgtggactaaattcagcccgctgactgttttggtaaataaagttttattgggacacaaccacaccccttcatttacatatggtctgtggctgcttttgtgctgtcaaacagaatagttgtgacacagactgtatatatgacctccgaagtctaaaatgtggtctctctggccctttatagggaaatgttgccaacctctgttctaaacagataactcaatgaaaaaaatgggcagaagacatgaacagacactttacaaagaggatatccaaagaccaataagcacatgaacaggtgttccaactcattagtcaccaggaaatatttttttttttttggttttcttttttgttttgttttgtttgagacggagtctcgctctgtcacccaggctggagtgcggtggcacaatctcagctcactgcaagttctgcctcccaggttcatgccattctcctgcctcagcctcccgagtagctgagactgcaggtgcctgccaccatgaccggctaattttttgtatttttagtagagatgaggtttcaccatgttagccaggatggtctcgatctcctgacctcgtgatccacccacttcggcctcccaaagtactgggattacaggcgtgagccaccgcacctggtaggaaatgttaatttaaaccacagtgggatggcactgctttcccatcagaatggctataatcaagaaataaagagagagctgacaatatcaagcattgcattaatatgggacaactggaactcttgtacattgctggtggcactgtgggttggtataaagactttgagaagctgttgggcagtgtctactaaagtagaacatatgtccccctctgtgatggagccattccactctcaggtatacgcccaacagaaatgcctacgtatattcaccaaaagggatggaccagaatgttcacgttggcactatttattaataatccaaagttggtaacaaccaaaatgtctatcaacaatagaaaagggaaaactgtgttttattcatatgatggaatacttttagcgatgaagaggagtctcgctacctgctacaacatataatattgacaagagaaaccagacaaaaaagactgattctgtggccttaaagttcagaaacaggcaaacagatcaatggtgtttgaagtcagaatatggttccttttaggggtagagatcaggagaggactcttcatgatttgggtggtcgttatacagggggttcactttggcaaaatgcagagttgtacacttatgagttcagaatttttctgcttatatattgtatttcaataaagagtttcaaaaacagaaaaaagaatgcacatctctttaatgatagaaatgtatcagcattgctctcagccagttttctattgaaaatgatgcctatgacatgtccctcatgaaacaaccacataattagccctggccctttggattctagtcttattcacaaatggaataaattttctgttttcagatttttgcatttgactacgtctaccctgacagtgtgactgactaggtggtctcagctccacacaccccatggcaaaaataaaaaggttgtgtctaaactgcagtggattaacccactgagcagactgcgtgctcctgggctttcttgccaaaggagagagcaaaggatgcaaagaagctgaatgtggaatttatggaccctaagaaggcaatttggaaggattttttcccccgtttctgtttagtcttaacttcgtgaaattgtaaagaagtgctggagactgggggagctgtttgtatgcaaagtgttgtctgcctcagttgtgctcctgaattttgactggctgcccagtcttatgtgggaagctgaataaaatgtgtatacttctaaaaaaaatcaattttagattttacaaaaggagtcaaatattattactcccaaaggaagaattgaggcagttttttttttttttaagaagagggtcagaagaaacagccaggtcttttttaaaaatcacccatattttttggctgacatattcagttaaatttgtcccctctcattgatgccggtggggagttataaaggaaagaaaaatattaaatgctaaaaatgaatagaagggatgtaataatccaagaattagggcaattgatgacaattttttaaagacactgctgtaaatgaaatttaaataactgtaaagctagatattcaatccaatagttatatacataagatgtactagttattgtttcataattatccagaatctttcatttaaaaatatcattttatgtttcttagactgtatatgtgtatatgttacgtatatgtgtgtatatatatttcaaatacatatgtgtagaaattcatgagatttttttttaagttaccatcctccaaaggaaaaaaaaaaaacctggcaagtgatgagaaggaattggagctgtgtacaagaatcttagaagatttaggtgatctcaatgcagcctcccaggtctcgtgtagcacctaaaaggatcattttttaaaaagaaatccaaatattagtttaggagaaaacacagaaaatctcatgactctcgattttgtgaaaattaaaatctgacagtagaaagcaaagtggcatggcccctgtgcttgggttaccgctgcttcccaaggggctccttagggaaataacttccctgttccttctcttttttacttggcagtcccaggaggacagttgagttgggggactaggggcattggaacaagtgtgtccttgccaggctcctgtggttggctgctagttgggcttctcactttgtgaaccaaaacgtttggagagtcttgtcttaggaaaagcaaattattctgccccgtgatgtcccttcagtgtggaaacatcaaggagatagatctcactgataacagagttgatcaggggagagtatgcaaagacaagacccaattatcaaagcacagcctttttaaagggttttgagtagattgcacttgttttggtgagaaaccaaattagagagttctgcctcctaaactctacatagactaatgtgttcttgggaagcacccctgctctgggagtcgcatttacctcttggtcatactgaattccttcgtaggagggcctttgatatatttattctgtaaccaaaaatggcagccctgagattggagagcatccctttgatttcctgtggactgtccttttctggagatatggtttgttctttcctaagggtcggaattatgattctgaaaagttttgcttttgaaatactacatcacagtgtcctaatgagaatggtgagccatctgcagcattcagcacttgggcatggcaatcaaatctgggcccgatgaatgattatgttatataaatcaccaggttcctccaggcagcagtcattgccattgtaattgattcctgatgagactgtttcttgatttgctggtgctgtaaccactgatgctgattgttctcatctcctgaaattgtatttagtaacagcattcaacaaatattactcaagtggttattgtatatgggaccaggctctggggttaaaaaatgagtatggcagccctgtctttgaggagacaagtgtttcaggaggaaacagacaagatgagcatcctaacagaggtacgaacaggaagctagcaaagctcctattggagggtggtgaggtgaatcggggaatgtccctccagaaaatccagagaggctaatgggagttacacaggcaaaggagaaatggaagggaggtgacagaggaagtagagcattataggtggagggaaatttctccttgaaaacaaaggaatcacattcaatgtgtgacctagaatttcagtgggcatctcctctggcaagaaattgagtagaaggatggctgcattttggaatgttcaaagtgtggagaggatgctatgtgtactgtagtaagtgcaaaacaatgggttggatttttaaaaattttatgtacacacatatttatctatatagtatgacgtgacatagaagttacagcctgttgaaaagtttatgccataaaaataacaattcgagttcacttcctgtgagtggcctagggtttttaagacaaggaagaataataggatgtcaagggccaaatatagacatggatgttttagaatcctttgcttttctgatctcagagcatgtggcatttggtgtaattgaatccaggacagatgggtgcaagccccattcaactttggagggaaaccaattaacaagcatgtgtccaaatgtaggattaaacttgcaaggcaagcgagtggcttccaataacacttaggaaacactaattagtgagagggaaatactttgtcaaatggtttgagaatagtaaatacaaatgcaacaagggaacattgtttttagttacaatttatattgttctagaagaaatggggctgcaggtgctttctacagacaaaatgaatcccaaatacatttacctaaggcttctagaaataatacaaatgtgtctttaaaagctcagatacataaagcagtagcatccaatttggaagtcctcttgatctaagcagtctggtttctctttggtaagttgcctgtttccagactataaatgaaacaaaataatcactatgttaatagagatgaatatatggaagataatttttttttcttttgggcttataaaactccaggagggaaaagatgaaagccaaaagtagaaaaagattcaaaggaaacaaattgcaattttagttttctaaatcaggggtgggtgaacattttctgcaaaaggccagatattttaggtttagtgaacatgcagttggtctctggcaactgctcacctctgctggtgtagtgagaaagcagtcatagacaagtaagtaaacgaatgggtgtgactatgttccaagaagactttatttatggatgttgaaatttgtatttcatgtaattttcatttcataaaatgttattcctttaattttttccaaccacttaaaaatgtaaaaacaattttactcaccctgtgctagatctgagacaattatctccccacaggtttgttctgttagaaagtccttggttgaaaagcaacatgctttccttttaaagttttcataaatttattaaataatgatgttttcccccactggtgttttcctaggtttttctagaatgctctgtgctctcgtaacactttctaacatctgttgtcatcatgcatttattaagcactcaccatgaactgaaatgctgaggacagacgtcagaggaaaagaaaatattagcaatagaaagtggtacagaagctcctctatttatggaatttcaactcgtgcactttcagagatacaaacaaaaccatactctggagcaaagccctctggctctctcttcaccaccaaaatatgcgtcaagaggttctgggacctcttttattttctgccctttttaaaaagaatttctcatttttcagtctatggaatatttgctgtctttctgctaggtgttgaggaattttgccaggaaccccatcttatgtgataacctcagaggacttgaaagaagaaagtgctagtaagaagtagtagaagtaaaggcaagatagaaacaatttctttttaattgaaataggtcagaaaaactgttgtaagccctttggcaggaagaatgattttgaggacaaagatcccatcatacaacctgagagaagctctgtacttgtgtaataatagcaaacattgatacagagcttctatgtgcctggctgtgttttaagtgattacacgatcacatgagtgtgcatgtacactaatttaatcaccaccaaaaaagtgttaatcaactaatgagctcacgaaatgattgatgaaacagtgaaatttgaacgtggctccggaattagcatcgtaggcctatttgtgttaatttaagagaaggaaacaaatctggtaagtgtacccggtcatggatggttccatgggtttgcagcttttggcatctgcccaaccttaaagtaagaggcagaacagcaatgctattttggagtaatattacggatgctaaagctgttgaggaattccctgtggtgcttgtgggcagattacccatttcagaagattttcggtgtatgaaatgaaacagatcgaatgtaggcaaagatgtcagtcaaagcatttatcagtaaggaggagtacgaaaagaccgactcatacctcacccaggtggaaatctggaggttgcaagcttctaccctgttcaagacctctggacgtaggaacaaggtcatacatagcctttagagcttaacatgtattcaaccaaaaagcacagtggactctgtctgtgctctgcccggaatatctcagatcttttaccagttctgtgtgcctgtcccattcaccagcttctgtgtagttttgcttctaatgaccaacatctgtgagcactctgtggggttctggagcagttgccctatattcacaaagagcaggaagtgcctgggagtttacatcaccctgggggcggggcgtcccacagcccatgactgactgatgtgtgtgaaaatattaaagtccaaattctttggcgaaggcgggacaaagtttagatgtaattaataccccagagcttccctcaggaccagactgagactgggactttgctagaaatcacacccttacttggctttattcccttccctaccctgttatgctcaccccttaccagtttctcctgggaacaggttcttaataaatcaattgcacatcagtctttatcttagtatctgcttctgaggaactctacctaaagcaacaagcacatatattattaagacagagaaatatcgtaaggctttaccttaagtcagcaatgaaatattgaatgaaagaatggactgaatgaattgatagaagccagctttgcactactcatgttgcagttagggaaacagaaaaaggataaaatattgaaacagtgactgttacattttagagtttgaagggcgtatagtgagactgcccacatagtgcagcctctctggctgatggtaatctaggttcagcttacatatggccagggaagaagatactaccacctcctgggactgttgccttccatctagatttgttataaagtcagtccttccttcctctttccctttctccctccctccctttcttccttccttatttccttccttctactttatggaggtaaaattcacatgccatacaagtcattcatttaaagtgaacaattccttggtctttaacatattcaaagttgggtaaccactattaacataaatttcagaacattttcatcaccctgtaaagaaacactgtaccctttagctatccccccctcaactcctcaacccccaagctctgcagtcctaggcaacccgacatctactctgtggatttgcttattcttgacattttgtataaatgaaataatataatatgtggtcttttgtgactgacttctttcaattagcttacaattttcgaggttcatctacgttttatcagtatttcattccttttaatggccaagtaatctttcattgtatggatagatcatattttgtttattcattcatcagttgatggaaatttggtttgtttgtaccttttggccattatgaataattctaccataaacatatgtatacaagtttttgtggacatatgttttcatttctcttggctatatacctaggagtagaattgctaagtcagatacagaaagttctttcttatattcagacaaaatctgagtctccttaacttccacacttggtacttatccagctttctgaagaaatatggacaagactttcttatgtatgacatcccctcaaattattcatcatctttatgtcctccttcaactttcaaagactgaatatcttctgttctttcaatcattccactgcaaaaatgggacttacagaaatgcaaactgatagctttgaggttgtcatattatctgttataatgtacaaaacagctttcttttgttccaaatctcagactttcccatcaacaacagggaacaagtggctaagtttattttgctaagataagagaaaacaaattattttctgggtaagaaggcttttcgatagactctgcatgggttttccctttggaaaatcaagaggactaatgatttgtgtagtttatgtatacatttgtcatttcttgacatgttaatgtgagaaaaaattttgtgcttctgaaaaataaaattggatggaaatcaattatcttaagagctttaaaagaaatcacgtgtagcattctttttattcttagtcatgaagacaatggggagaaaacttgacaaaaccacaggaaaatgtagcaagttacttagcaggctctgggttgtgctgaactgggccaaatgttatggtcatttcttcttctgtagctatgaatggatctaatccttgcttgttagtcatacacttaggactattttccaccttcttttaacattaaatccagagctcaggatggcttctgactttgtctcatgctatctgcatgacgttggacaaatcacccggcctttatgagtttcagtttctgcatcatactaccactacatcagtggctttcaaactgtgttgcacgggataacaaccaaagaatctcactaaaaatgtcaatggtgtggtgctgcaaggaattgtgcaagtaggctctggggaggtcctcaaaatctatttttaaaaacccacccaagtgatgctgatgcccatggtcctgaagaccataccttcaaaaacactgactagccatttccttctggtccctcttcctcttgttctgtattccactgaaagggagaagaaatcttattatctttccaggtaatatcttttcatctgtgctgtgtgcaaggacatgaaggaagacaactaaagttgaaataatgaaaaaagtcccagtctgatgcttagattctgatttattagaattattttgaccataacaattttaaccataaagtagggtttcttaaccttggtactattgacatttgggaccagatcattctttgccttgtgtgtgggaggctgtcctgtgcattgtaggaagttgagcagcatatctggcctctacctagtagataccagtagcatctccccctccctccaagttacagcaaccagatatgcctccagatattgtcaaatgcaccctaaggggcaaatctgcccctggctgagaaccaccttcataaggcatggtccccaaagaaaataatcaagaaattaggcttggagcagttttcttcggttggttcttactgcacagcaaggcaaagaaggccctgctaaactgttggttcttgacctttatgtaccaagcattcctgggggatctggaactccctggctcatcctctctatttgctggattaatgggatacagacagtttaagtgacttggcaggagaaggacattctgttttattctcctcattttattacactcctgacaacgaattcttaacatttgccttatatgttctgctccctatcattatcacaagatagattagttggcggggggaggggagggaaaccaatatatgcaaaattgctttgaaacctgcaggcaccagagtaatgccaggtgtcatcattcatcctactcctgagcctctgaagccaggggtttcttgaggttataaaagtggtttttttaggggggtgactagtcaagcactccaaagaactccagagtggtcagttttgatcacacagatggccaatttttacccagtctgttagccttttaacaacacacagtgttgcgtggagacccacttgtgtatgggtcttcaacgatgggtggagacccagggctcagctctactcttctgctctggagaactttctctttgttttcttgggtggtgcaagacctacttcactgaaagaaaatgtgttgttggtgtgagaggtactgctaagtggaaattattaaaggatgaattccttatgtctgtgaaagatttctccgccttggcactctagacatttgggaccagaactttctttgttgtgaaggccgtcctgtgcagtgcaggatgtttagcagcatctctggtctccacccactggatgcaagtgacacccttcccctgcagttgtggcagccaaagatagcttcagatattgccaagtttctcctcagtggcaaaatttcccctgttgagaatcactggcctaggaggtgtggatgggacaccagcaatctaatgaatgggcctgatttgtcaaaaagaatctccaccttgaaacatactggaatgacctgcaaagagattggggtcaactaccatttacatctcaactccaccatttattaggtatgcaaaacaggttaattaacctcataaataaaattaagatagtcatactttccttcccagttgttctgaggatccagatgtttgcaaagcatctagttgagcctgtgatgtaggtgcttaatgaatagtggaattgttaccatttcaaacaataattctagcacctgcggtgttggcgttgtcatgggaattctgcaggctttagacaactgaaacactgtgcaactgtgcagaagaaaggagattatgatcagaggaatgaaggcaatagactaacattagattatggatataaatgaaaaatcatttcttaattcccaaatggttatttggaaagtcgtagctggagaaattgcggcctctcctttttgcctaatgacccttgaatagaacatatatattagaaatgtctctttttaggcactttttaaggataccctccctggctctgtggcatggagtagaaattcttcagtgaaaatatcaaaacggcaaaaaacaagataaaccaataataccaaatagaacctactgtaatggtcatttatttcctcacccttcctcacttgttttctttccctgaattctcggattatcatattctcgactccaattgatgcataactttatgatattctttgtactagggtttgaggccaaagacaatggtactatgctgtgccaggatgttctcctctctcttctccatctctcctatgtgactgcagctccagctgcaggaattcctccttcactggtcttcagcccagctgtcttcaggctgggggttgtctccttaaacttacctggaaaaaggaatgagaaccttcattcttccttagatttcttctatctccatatccctggaagggttaagagggtgggaagaaattatggctatagagtaaaatgataattcctgaaatggcatatatgtttacagttatcaggctgagattttacccccactttgctgaaattctgcctaatgagatgtcctccctcaaaagcacattcagtgtatccattgctcctgtctgtgcgtgtgggtgaagtcggccttatcactgccaatgccagggccttagcagggctggtaggtccttcacttacaggagacacatgatttcagccaaggagggccttaagctgctactccagctctcctttctgatcctggagtttgatttccttaatttcatctttgtagccccatgaaaaagacttaaaaaagagacaactctaaactgtgttcagtcttcatataaactgtgttcagtctgtttatacaatagtgtaaataaagattctaattaatacagtttggaaaactgttaggcattgtctagtaaagttgaagatatgcatgcctatgacccagcaattatattcctgggtttggaccctataaaaatgcatgcacatatgcacaaggagatatgtataatgatgttcaagcagtgtggttttcagtggtccaagattgaaaaggacataaatgtccatcaacagttacaaagataaatagtaataaacacatataatggagtactagacagcaattggaatgaacaaacaacagctacatacagcaaacatggatgaacctcagaaacggaatgttgagcaaaagaagtcagctataataaaaacatacttatgaatctgtttacataaagttaggaaacaggcaacactaagctctaatatttatggatgcctgacttcctaaaaggcagtggatttcaaccaggggtgattatgcctttccccactccctgggggacatctgcaatatctagagtcatctttggttgccacaattggcgtagggggaataatactggcatgtagtgggtagaggctggggatgatgcaaaacattctgcaatgtccagcctctaccataaagaatgattggttcccaaatgtcaagagtgctggggttgagaaaccctgctgtaaaagggaagtgaagaagtgaagtcatgacagtgtctaccactgggatggaggagggaaatacagccaagggacatgggggtctagggtactagcaatattttaatttttgacctcagtgaaggttagacaggtgaatgttttgtaacaattcattaagctgcacattatatgctattgatttttccatttcaaaatgttaaaaatactccaggggctagattaacaggacaataggatggcatagtgtgggcactgggtttgggggaggggattccccatcttagagggtctcatagtaactctgttaacaatggtggggctgggccttcaagaagggcctgtcctgccatctgaagtgatttttagtactcagatgggccctcagctcttcctacactctgaagttgaatttgcttccacagatttgggtaaagtttttctgaaaaaagtaatcacccttgcattggcattaactgtggaaaattttaactcagcctataggcaggcagaataaatgcaaacaagtattttaatttaaatgctctggcagaaagggcagcattcagttctggaaatgctgtaatgtttagggacaggaagacatggaaattccacagttagcagggcacgttttctcttaaaggtgatgctagtagagtaactcatacagattatttttaagtcctctctggggtgaatgataaacatcagataaatttattattttttaaaaaagaaaaacaaacaaaaaagaacattagcctagcaggctcttaaccaacaaattggatgaacttcagcctcctctgaagtgaggttttatgtgcttcttgctgcctttttatctctctccattaccccaaaggatcaaatgtgcattttaaaaccacatgccatgtcaatatacagtttagttgacctagaacaatacctgtgcatagtatgcacttaaaaatatttataaagtgtggaatgatagacaatggacactcagaagggcagtggggtggatgatggtgaattacttaatgggcacaatgtacattcttctggtgatggataccctaaaagccctgacttcatcaccacacaatctatccatgtaatgaaattacactgttaccccatacatttatacaaattaaaatttaaaatttaaaataatatttgttgaataatgaccaagtgaacaaataacatgggaaggatacttggaagtagagatatgcaaataagaaattttgattagagtggtgttttaaatataccctgaaatatatttaaatgaaataatgaataatgtgtgaaattcaaattgtttaagattgaacagacttcttagagttctgcatgatcttctagatcctttctggagctttgagccttacacaattggactaagaattgaaggaggtggatgattcattccaaggtgatttaagagtcttgcagcatgaactgatcatttctttaggtgctttgcccaatctcacaaactcttcaaacacagagaaaaaacaatcctattgcacttgaacattttactccaacttagctatgacactttagcaataaataatgctagaaggcagaagtcattcctaaaatgtaagtacacagtgtggggctgatggagtatttttggcttacaagaatgtcatttagtgacttactacatttttgaaagaaagaatacaaaccaaatccaggatgacccagttttaagaggtgacttactcaggggtaatgatcaaaaggctatggttaaggttttaagacccagggatccaccttgtgttgtttaaatatattcataattaaatagtatttgtagggaaagggatttttagcttcaggggcttaaaggcaagcgtgatggaagaaaaagtcctaaggctggagtgttcacctttatgaatagaccacagtgaagtgaaagtccctaaactggggcttgtctaggccattgaattacatctgtacacacgtgcccccatcaggctgccctggctgcaattctctgaaagatgccagatggtgaagctcaagctggttctctgtcttattctgaggatctttgatgactttgctctaaaggttgcttttagcagcagaacagagtgagagtaaagagggaactttagtgtgtcatttttcgagctctgcctggacatgtcacagagcaaggaaggcctccaaggtcaatgggcatgctcatttctcctacaaagcagaagaaaggagacttgggtagatcaggctgtgggagaatgaaagacttgggcaaatagttcaattgactttctcataagacaggcaacactgtttggaagttcctgggtttggcaagggattgattttaaatttatttttatttttattttttatttttgcagtataaaatacatgtagtgaagggtgtaaattacactagtctgaactgtactgcacagtgaatgtttacatatgggtgtactctagtagctgccatacagatcaagatatagatcatttccagcaccctagaaggttcccttgtaccaccttcctagtcaataccaccttcccactttggtaaccactgttatgacacctattaccatggattccatttgcctattgcacttaaacatttgaatttcagttgcagaataaataagtgaaatcttacagtatgtacacttgtgtctgatttctttctcccaacataatgtttgtgagattaatccatttgttctgtgcatcagtagcattttcctttttattgctgaatagtattccatcatgtgcacagactacagttggtttgtcatgcatcagttggtgtacatttggatcgcttttatttggggcaattatgcctcaacacagtatgagcattctggtatatgatgagattattgtactctgtatatctaggggtggaatttgctggattggaaggtaggcctatgattgactttagcagatataaccatccagttttccaggtggataaactgtcatgggactatctaatggtagattcctcaggccacttgcacccctggcttcacattcccactgctaattataattatgctgtgattgttttaaaatattacatgccagtggatggttcattcaactaaattgtaagggctgaaattccggggccacatccaactttcctcccctctcctcccctctcctcttacacagagcaagtggagagtcattcagccggttcagtacagtgggaccctgacaaactggcacaagctacccccaagcacatcttccactttgtagccacccctctggggcttgcattgattgattcatgagtctggagtctctactctggccccaggcctggccttcctctgggctcaacttgtgggaggctggacgtaaattacagaaggacaaggctgtggagggaactcgctgatcttctccaaggtgttttaaagtgcaggtttccatgaggggatttcagagcagaggccagttttaagggttattgtgaacctacagaatgtgccctgcaagcccccctggaactcgggtcaccctaagtgaccagcatcctgggcagccttgtccccgcagcagttctcctgggtagcatgacttggttcctctcagtcctgccctccccaagggtccccacaatttgagactctcacagaagaaggctttctagaaagggaaactctgccctcccaggagaaggctctgaatctccttccactgtcaggcccacacctccttcaaagttagtgaaagtctctctttcttggaaacccaagttcgccttctcgctggcattaaaggctttggcagtccccgcctcagcagccggggtcccacgggtccggggagggtggggtggcaggaggcaggcgtgccggccagcctgacacctgtcgtgggcgcgttcggcctccgcagcccccaacagctgtcagcggcggcggccgccggagggacccgccaggagcggaaggaattaaacgcccgcccatcgcatcagactcggccgctccctcctcctcctcctcctcctcctcctcctcctcctcctcctcctcctcttccccctcccccttcgcgccgctgccttctccaggtccccaccggctccgcagcggcagcgggacgctgtgccaggggcgctttgcacagcactcggcacgcacggagcagggctcgcgcccaggggctgccccaggatggcagtgaagtgcggggaactcagagagacaccgtgaccccaggctgagcccaaggcgcgccactcctcccggaggcgacatggggcacccggtgtaccgcggcgagaagccccagctgcactacgcggtgagtgtcctgacgcgtgcagaggacacagggggcgccactgggccgctccgggtggggactgcgaggggcgatggtagtcggggctccccacaggtccacggctgagggggtggcgggtggccgggtacgtcaccccgaagtgccacctgctcactaactcagtggcgcttcccgaaatcttttagaaggtacaggggagccccaaccctgaattcagtgtttctttgccccaacgctgtggtcactgcatctgggacggggctggactccgccaccacctcgctgacaaaggctgacaaatggggttcctggggttaggcctaggtcgctcattcagccttcagtcagatatgttgaaaggacgagaataagactggacaggaggcagggccgcttcatgatctcagtgtgcggcgagtggatttgctgaagaaatgctgccgggagcgttggggtgcagccgtttcactccttagaaagggagtgcatttccctcctactttgtggcgggacagaatgttgcacattatcattaatgttgcacgctaatacaagagaataccaggggctcttctgtcgtaccttccccctcccttatggtggcttctgttctccctgttgatacaaagatttactggggacctactgtgtgccagggactgcgctaggtgctgcaggtactgcaggaaacacaacagagagaaagctcatgggatttgccttctttgaagaaggagtcaagattttaaggttaacgaccgaccaaatccagatactagatgagtatattctttgagagagagaaaagaaaggaaagaaggaaaaaaggaaagttgtttctgaggaatgactactacttctgaagatttcaaatgccccctccaggaagggggcagggagaaggtttaccttattccagtcttcagacattgattttccacgtgtgagatgtgtcgttttgagatgagacactgcagttgttctgtcatctgctaatttactgagttttccttgaattgatttgcactgttgagactggacgttctgactgccaactttaaaaattggagagaagcaggcagagagttgacaagaatcattaatatttataatcaggcaaagacagttaactgtctggaattcgtgtcttccaaaatccagtccccaacataaaaaaaaaaaaaattgtttttttgaagaaaggagtagaggtggacaggggtggtggactcaggcatcccggagctgctccagttggttcctggtgtcacctcggggctcctggattaattgcagggccattgggcaaattgcacacctcgtacacttcgctttcctccactggaaaaatgaagacctgaattaggaaattgttaagataccttcccaggcaaacgttccaggaacctgtaacagctctttctctggtttttctatagttacttgtcttgaaacaccaaatgagatacttgtaagttactaatgctcgttcatctgtcttggagacaccggtggctcagtgatttgccttttaaagtagtttaaagggtaaccacttttcaacagaggttgctttacactgaaggaagtagagtctgtgctcattgtgcccattcaacatctccaccccaccacctttttgaactgtgtgctggtaccctttgattcatgatctgaggtctttgccatttgcaagagtgcgggtgggggaggaaaggtgagaacgggctccttaattttaaaaaaatctattcattcaatgaatggttattgcctcaattatgtaaatatattacaaaaatattttaaaattgtcatttaattaggctgtctgattcttctaaaatcataaactgaagagtcaagccgatgctaatgtcccctcttggggctctgaagactgctgatgaaatagccctttattctagtacagattatcatgtatgtatattctggtttaagactataaaaaggaagattccagagggaatttgttgggattccaggttggaataagtcacccgggctctctgaagtttcctatgcatactttaggatgagaaagcagcagctctgaatcagtcacgtgtccagagaatgttctttattaagtgcgacccattgtttttcatattagtataacccttggtggtataatatctattctaacgctgcacttttgtttacttccctcatttgggttttgataattccagagcttgttttgccgtttagcacaaatattccacttactttgctcaacagggttttgtcccactgtgcattttcctgtgatcttgggttttttttgggtctgtcttccttgacatgaatgaccctccatgtgtccttaatacctcctgcctcctctgaaatataattcggggataagtatgtaatgctcttccttcagtgctttttcgtttgtccaaggtgagactgcatataagaggtcagtggctcacatttgattcattcaataaacatttgttgaatgcctgttgtgttccaggtatttggtcaattttccaaagagacagttagatagtgaaaatgttaggagttgctatggacatctcactcatctttttaaatggtcataatggtcacagagagcaaaatgcaattaactagacaagaacatcctccatttacataaacagacattttcaaagtataatacaactgtcttcttgctttatcatcacacacagaaaataatgtgtgttagcagctaatgttctcctcaaaaaatttcctcctacagttttcccacgttcagattatggtgactccgtccttccagctgggtgttgtccttgatgccttttggtgactgaatcagatttacattttgaaatgatcccagtatggagtgaggatgaggaggagctagagtgcatcctggtatttgggcctgggagagattcgagaagatgactgatgctagggtggcagctgggtaggaggttgagagcagttggcatattggagagatgcttagaacatagaacctgtcagacttagtttggatgggataaagaggtgatagagtatgaaggatgaggatgacatgaatgaatcaatgattttctggcagcatttctagagaagctcttgaagtttatataataagcaaatagtcataatgatatttccctccttgttactgtcttatacagattgcaaaatatttgaacacagtctaggtcaatttcagtctgaaatccaattgctgccttatgcaggttttctgtttcctgattgaagaaatctaagctcagaacagtagaattcaaggcagcacatgtgtcgctgctgacagaactgagagctttatccaggtgccctgatcctgcagtgctcttctgagtcatttagacaatgaggatagtcgaacctaatcatccctctgcgatccactttgccacagtaataaaccaacaaccaaatgttggaccttcagtgacttaatgtgactatctgtattgtcaaattgcatggccaaatagcttttaaatttgactagtgtagacaaaaactaaaaatttaagtatccattaagttcaatgcaatatctttatgtctttctgaaagacactaaaaaaaatctggattaaaagcttggccttgtgacttactggggaccttaggaggctcaagctcttctctcctggtgccccaacctgtctttaccctcaagtggggcagagaaaagcaaatcagtgtccattatacagtcaccatcaggaatccctggactgacatcattcatttctctctcgctggcaggttgaaaacttgctgggagtagtactatgtgtgtcttgtccctgctgtcacctggacacctagcagagtgctggaagcacagtaggtgctcagtagaaatgtgttgaatgacttcatgaatctagtagttgagacctagtttttgaggtcctaagctgctcattctccttccttgtactggtctagtctgagctcctctgctgctgatgtcacttcctgtttggtgtggtcactgcaccatctgtgcttttgaccacagccttgtaatcagatgctgactctgcccttgctccagttaaccccttcctaaggaactcaccagaagtgccaagctgcttaccctgacagagaacctgttttcacatagaatggaaactatgaaagtttccacgtttgttctctatgaacattcaattttcaaagactttgaagtcattaagtttgcttaataattgagtggtattgaatacaggatactctctggtaattctgaagatgcccagaactgggcgccgttgcaggcctatgctgatatgaatcagttatcatccatcggtgctaacagtgtagacatcttaggaaactcagcagaacttatactgacctgtggcatggcccagaacttacttttataaaaccatttttatattactctggttgtcatttgtctcctcataaaagcaaaattttttcaacttacaaatatgtgagagattattgaatcctcttaattgacacctctactaattgtagataccttttctactcccacccccaacctggcatgcttacttttctgctgcatgcagaaattttcctggatgaggcctctttggtgtggaagccccatcatcttaggaagctacatctcccctccttcaaaccactcattaagtaccactactaattgataaaaaatcagattcctgttggatgttgcatagcagacatctctgccaatcatttgaaaacaattaccaccctttgcctagtcctttctggtgatgaacttttattatttacttttcctgttcccacattgtgataaccctggaccacacacacatgactctcaacttggttgtgaaattattgtccagtcatacaaagtcttcattgggttcttgattcctcacttccctgtcacctgtttcattctcagactttcccatctcagtgagtggttggctgtccctatggccagtgcaatctttttaaaaggtaatgaaatagtgacatttcagtgcttaagctctttggttggtttccattccacttagaataatagcttcatccatgaccttgaccttccaagtgctccttacatggtcttctctgcctcataccacaccccactccacaagcttatcattgcctggccacatctgtgccctttctgttcctcaaatgcgaccagttcttttctgccccaagcctttgtacttgctgtcccttctgcctggaatgtcctctgtgtgataggctttttttttttacatccttcaaattgcaggaaaaatgtcgcctttcctgactgctttctctgaagtgtttctgagcccactcagttaccctggatcatatcacactagccacttccctcattgttcacatcaccacttggtattatattatatattcattgtttgtctgtctcctctgactagtgtgtaagtttattcagggcaaggacccaatgatcctttcccactgtctttccactgccttagagcaggtcctggcacagggtaggcatacaataaatatttatgagaacatgaatctggctgcctgtgtatttttccctaggttacgctaggactttccaaacttaaccctttattagttgatgattgaggtcagagggagagacgagactaaaaattagctttccagtttcactgaattcttactaaacgagaatctctaaggaccagacttggaatcaatcctttgaaaaagctttgggggtggttccaatatcagctgggtttggcaaacactgattaatttacacggtgaaccacttactactcaagcagcccctacaaaatgtaggattcagcagcaaagtagattcagaaagtgcaatacaatacttcacctcagctgactctgaggtaatctagtacaagttttcagagcagtcctttgttttaccacccagtgttcatttcagccaaactctctaatgatacaaaaggtataggaatacttcctctatataatgtcatctggcaatatgtccctcggtatccatattctaggtaaaatcgaccagtggttctgaaccagaggaccctgggcaatgtctggaggcacttttggttatcataactggcaggggttgccacaggcatctattaagtagagacctgacatgttgctgaacatcctacaaagcacaacacaacccaacaaggagttgtccagcctcaaatgtcaatagtgctgagacagagaaaccctgacttaattgtatctcagtagatatcaaaatcttaaatgtttttgagaacaattttgtatggcactttctaaaatacattattcgtagtttcttgggttttcagagatagaggtgagaaaatgtgagtgagcttccctggctgtgagtcacagttatgaacagtgtgtttcatactgtgtggggattactctggagagggtgttggtggtccttccagaagcctcagcatcttgggctttttgtttcttcactcctcaatgccaaagcccttcctaatcttgggttaaaaaaatgtttactgtcttctctctcatgtcagacattagctaacttcttcctttatgaccgtctaacagccttgcctaatttgccacctctcttctgatttagccagaatacccgtttaacaaatgtgttaatcgtgggcctaaaattagaagttataatctccaaatgaggatgtgtggagtgctcagcagccttggtgtgtggatgtgggatctgcatctgtatgaaagtgagaaactagagtgcctgcttctgtccctactccttgaggataatgacacagaccggcctgctctggggaaaagggaagagttgctgaaagaaaagccaaaggaaagagggagggaaacagtggctcccagcgtttctctctcaatcacatcagggttcaaaatctcctgagcagcccagggtggcaggcgggtttgtggcctacctgttctcccattgaattgcagagcccgttcttaactcctggccatgtcactgcatgtccattagcatggtctgttttagattgtgagttacgagatgatggggagggtggggatagatttaacggtcttgggtgcttgccacattttggactgagaccactgtttacaaacacaattaattaatttaatatcttttaatgtactttctgttctcaggttttctcattctaaccttattttcaaaagaccaatttttctgatttattttattcttaaatataccctgaatacttaaaaacgtaaaggtagatccagtgatgcaacaaggactcccaccagtcattatgtggtactgctttcactatctttgtggtgactacttggatgtgaatatgggatacttttcaatacaagaaacatatacaaaatataagccaaattttttcattcaaatacagttactgttactgaagactcttccacttccaatttccttgaaagatgccatgactctttcaaatgaaaacctgtcaggcttgttctcctcttctcttcggatacttgtcattttcttagaacttttctaacataaaaaaaaatcttatagtaaaatttgagtgtttgggatgtcagctaaattagatttctgaaataacaattttagaagaatttggagttgtggctttagagaaaagttgccatggcaacagcaacagaagtagtttagatgaataaacttttaacatatttttgaatgacccctttctgcagttgactgaaatatctggtaaagaaatgtataagccagtccaagtgcaatacagaggctaaaagcatctcagcactttgtggagcacgtgggctccatatttgccaagcatctctgtgccaggtgggtgcctctccacatgggcacaaatccctggacattgctctaggttcctagcttggtgatgccatgttaattagacccacagatgaataatagattagcaagggtatggaacattgagtttgctagaatgatttgaaaatggtaacataacacatagtattatttctgtgggtatctatgcacatgactttcaacagttccattcatgttaagatgccatttcgatggtctgagcaaaatgcaaaacacggtcttaacttttatctcaaaagttaaggcatcctcccacattagctactgattcacagtcaagggctttgtgtcgatcaggatccaaacaggaaacagataaatcactcaaaaggcttaatttgaggaatgaactacgccaatgtgttgacaggtttaaaggaaccaacggtgagtggtgaagcacccagcaattagcaacactgagaagctgttaccagggagggaccagcgttaccagagcccactgacttgcagccttggctggaagggaccctggcaatgtgtccagagaagactccagcaagggcaaaatacagagaagcagggatagactggaacagtaaatactctgacttcttggtctccctgttctccatctccttctgggcccaagcccagccaatccagtgagaccagcacagagaagggcagaacattttatttcctatttttgttgagggctggcgggagggggggtcggtgttgacaaacataaaatatcattacaagcattttcagtcttgtttggggtttgcttacatttatgaaagaccttaaattcctaagtatatagaagtctcccaaattgcttcaaatgtctctttcttccacactgtagattattttgactaccacatttaaagtactcaggtgctatgccagctccatccatacgtggtgtgcttgcttttaaggatttttatatcacaaacctattaaagcatttagtagagagtgatatattctacgtatattttgtcattaatctaatattggaaagttcattactttaaagtgccctggtctaaatttattagtatttattaatataattcaaaatatgtaaatgtattaatatagactacaattagattttttttccctctaagcccattaggatagtctaatgtaatttccttgccaaacaaagaaaaaggaagatttggtttggctttttttctggttgatgggtaaagggttttaactcttaaaattgcacatcaacacaaatggtctaacctgtgcttgactgaaaggcaattttcatttatctctgctggtcaaggaatggttgcagctaagtattgcagttaaaccgccctgtaccccagtaaattttagcagagagaaaactctcatttcaacctggactgcagaaagtacctcttattcttaagttagttcctccttgagtcttctgtgcacccactttcataaatattcatcctgcttctttggagaccatattcacaacagaaccagaaaatccaaaaggacgcagaccagaaccagggactatattgtgtgtgactcaatgcttggccatttatagcatgtgcctgatgcttagtatgtacttgagtgtcaatgaaattaatcagtgatttaaagctctcagaaatatttagtctgacttagagtaataataatagccaatatttattgaatgctctctatgagtcctgcttattctacatatattatctcacttaatccttaaaataaccctgtgagataggtcctattatcctcatttaaaagatgaggaaaccaaagctctgaccttatgtctgtttcagggccacacagctagtacgtagtggggctgggactcaaatccttgtctcttaatttgattgccaagtctgcatgcttgaatcactgtgcagtgggtgattgttgacatgccattggcttaaggtgatacctttgaggtaatactttttaaagcctttcattttgtaataattgaagacttataagaacttgcaaaaatagtactgagaggtcccatgtaccccttatctagcttctctcaatggtagcatcttatttacacaatatcaaaaccatgaagctgacattgggacaatcctattaactagactacagattctcattttaccaggtttttacatgcattcttttatgtatgtatatatgcgtgcagttctgtgcaattttattacctgtacagactggcatatccactaccgcattcaaaatacacagctggtccatcaccgcaaaagcactccccccatgctacccctttgtattcacatccaccctactcctgccctcatcctgaatctgggctaccactgaactgtctccataagatgacacattttaaattcttcctcctgttcttgctgcacggtggaaacattcctgtctccattgattatttacacccaaagcatccataaacataacagaagaaagtatggtgaattgatagggagatcagagaggattttggtgtgtccttgttgtcagcaatgcatatatatgtatgtgtatatatatatatatatatatatatatatatatatatatatatatatgtacacacccatataaagaacatcctgtttgttatttttagttgagggtttgagggttgtggtaattttataattccaacacctgtgttttcactagcaaactgcttttgattgaaacacggcagagtttatctcctgcgtaaatgcggcacactccctctttgcatggctgttctaacggcacatccatttctggaccgacaaccgcgtgactgaacttgcagcagcctggaaaaggtacatgagagctggcactctgcccttgtcagggttttccaaaagtatttacgaacaaggataaacacgagtcctgcatggatttgaggtagccatgaccgagctgggctctgggcagcacaacagttacgtaaaccttggcattcatggcacacatgcatttttattcatccatttcaaagggagtggccgttcgtagacctctcttggggaaaggtttgaaccttatcatgatgaactggttcaaaaaatccttaatagctgtttttattcaggattgctgaagagtgaaaccttatcatcgggacacagttagaaagacttcctgcatttatttggtgctcactattttaaaaaaggtgtccaaactgctgatgctgtctgattctgcaaacataggcaaacttactagatacttcacatatttcagttttaccatatgattatgacttgatatttattagaaaggaagaacattttttaaatgtagtcatactgagcccaactcttgcttttaatgcaatttaattgcattaaaattagacaggtaatgtcaccattaccacgcagatactttgtatcacccattgcaaacatctgtaaaggatcaaaggctcatgtagtgagtctaagaggaaacttggtttgagaatgaggccttccatgatatttctgtgctgccgcaggtgggggagggcacatttttatttaaggcgtcattagaaaggaatgaaatatagaactcctagcatgcatacatatatgcacatagacacacaaaatcgtactttaccttatagctgtgttgtctaaaatgtagaagtgtgtttgtatcagttagctatcaccacactaatgctgtgtgacaagctactctgacattcagtggcataaaaaaaccatcacggatcctagtggatctgtgggtcggttagggttggcttagctagacagagctcagctgtttgaccagaggccaaagtgtcaaggctcttctgtcaattctgtcccatgtgtatctatcctggggcccaggctggcagcatctacccaaagaagttcagcaatgacaaaggcacaagatggcaagtgggatcaactgaagactcttgagacgtaggcaggaatttgacacactattgtctccacccacctgctactggccacagcaagtcacatgtaaaagcctaacttcagtgtgtggggaaatgcactccttccatgatggggctgtggtaaggatgtgaagcaacgagggatgaagagatgggggaattgattcactttacctcagtgtttaatcagtttatcctgagaatgccaatacttttaagaaggtacaaatctatcctgattttctttttctgtttcgtcagtgagttctttctgtcatggatgtcaatatctatgtcatcatgacccaattaaatgacaaaagcagggttttgaggttctctcactgatatcagttcccataaatccacagtgattggagaaagactgagtagacattaagggaatatagaaatagactgaatgatattaacatttaaacagaattgcgacactcgtccctgtttccttgtgtgtagcagctctggttcctcaaactatcaaaaagaaaccattcagaatcacctccctggatactttttaaaatttatttttaattgacaattaaaaattaaatatatttatgatgtacaatatgttttgaaatatgtatgcattgtggaatggctaaattgagataatcaacatatgcattacttcacatacttattttttgtggtgagaacacttaaaatctattgtcttagcagttttgaagtatataatacattgttattaactatagtcaccatgttgaacaaggaatatgaacttactcctcctgcctaactaaaattttgtatccttgaccaacatctccctggagattttttatctgcttctttttactagtatcacttttaaaagatttctgaatttagctactgtttcaaaacctagaagaaattaaggatgaggtgatttatgaatgaaagaaaaatatattaatcctttaggccaaacacaccagaggcaacgtttggcaattaaattattaatttgatcaattttgacatgtaaatggataagctacattaaaagcaatgcacttaaagtacacacacagaatcttgtctcattgaagtttgaacaccttcaccatatcttcctctattatatcaacttgattgaacagttgccaaggcctgtttttttttccagtttgctctgtacgtgatcatatctagtagactgtctgccatattacggtagctcagttcttaaatcaggggtcaacaaactatgacccacaggccaaatccagacaactgcctgcttttgtgtctcctatgagctaagaatcagttttacatttttagatggttgaaaaaaataccaaaagaagaatatcttatgccatgtgaacattttatgaaatacagattttagtgttcataaataaagttttattagaacacagccatgtgcatttattgacatattgtctttggctgctttcacactatgatagcagagttcagtggttggttgcaatgaactgcatggcttgcaaagcctaaaatgtttactctttggccatttacagaaaaagtttgcctatctctagtctaatgctatgtctcaaattaccacagacactgtagataggtctacgttacatcagtatgaaggcaaaagaaagggacacatattgttggtatggaggggagtggtgggtatatttcagataagggcaaaatgtcagtgaacattcattgattcaccagtatatgtgcagaactgggtatgtgtatagcgctaagggaaacatttttttaaaaggttagtctccaatttttactctaaggcttcctcttgaataagaagatgcatctgcaagtatagtgtctgaaaactatttgccttgtccaatctctacatcactggaaaatgctttaaaaattttaagttaaaaatagtatatgtttcatggtttattttgcaattattctaggcagaataattttcataaacattgccattcttaccagtgcgaaagggagacttaaactcagaaaagtgtcatttactcatgggtttaaaatgctagttcttcttgtggatgtatctgagatttttatgttactgtatccagaactccctcagaggcaagaacataaagggcctccaggagctgactctaaaaacaccagtctcctgttctttaaactccgtgtggcttgctgagcgctcagccacaagagctgggggtgagccatctctgggtcctgccaatgcagccagtgttgtgccaaaggaagtagccctgtcttacactttgtgatgtttcttttggctgactcttccacattcttgtgaccctttgaatgaagacgtcttaacagctttagctctacaccatggcctcccgctatcatttcctgcaggtcttgtcttagagctcagcagcttcctgagtaaatgtcaccttggtgtcttctaagagggtctcactgaggttcaaaaaaccatggcttccaccagattgaaagcataatgtccacgagtctttgtctcactggactgtgcaggaggatgaacctggaattctttttggttttgaagcaacgagtaggtcggggcacagaacagagaaccaggaaaatgtctctgagggtggaaatcaaatgaccccagaggaggaaattccagttgaaaatagaaaccgggtcagcacccttgtgagagccacagcatcctagacttggaaagtggcaacctgtggcctgtgaaggctgctatcagaagtccatggactggcctgaaaagagtgttgtgttttatggcaatccaaattgaaacaggatttatctagcttcacagatgtggtctgctggagagttatgtggaaatgactcaatgtcatatatttgtcacattgaccaagggttatttctttagtaggaaaagacaattcgggaacaatattttcttgagaactatgatatatgcatacatgatggtggtagcttccaaattaccatggtacgaattctctccattgatggttaaggggaaaagggttattttgttgcagctgtacaatatcccttcattaattcaatgaaaagatctcaattaatgattattccttaaaatgacagatctataattaacttggaaatgcccacaatataatcatgttgctatgaaaagtgatggtttttaaactagtctaacataattccggattatctttaaagagaatttaatgtctagaaaagtttctgtagctctaaaaagctgcagaataggatgtcattttgggaagtttcccttgcttaattcagcttatgatccaaatttgaaggagaccagtagtccaggagttttgtctgcaaataaaatgaacaatatgtgttctaaagtgttttggatttttgtttttggtgggaggctggttagtcatggagcagggtagaattagtagcttttggctttaatcaggaaaatatcacatggtgttaaagtgctgtctattaattggttattataaactttaaaatgtatattatggtggagaaacttctcatttgggggactgtttttcatagcatttgtggcaacttttatttattacttaaaaattttaaacatcacaaacactgaaattctggggtagagataggattttcttaaaggagagatatatttttgatatatctttttctatctgtgtgtgaaagtgtaatgccttccagaaatccataggaacagaaaatagattagtggtttcctggggctgtggttgggaaaggagagtgactgtcagtgagccccagggatgttattgaagtgacaaaaatgttctcaaattggattgtggtgatggttatccaacgcagtaagtttacaggtgaagtttatagaatgtaaattacatctcaatgaagttgttttagagtatgagttaataagagaatcaaaaagtacttatttacaaatgaaggattaaaatcaatattatacaatcaaacttgaaatacgttagtaatggtatatatatattttttcctttctaggccacctcttagaaagttcaaaatctaataaatgaggggaaacacctttttattttttgctagttgttcaggattcagtgatctgaccaagcacccatttgtagttaagacataaacatcccactgaactagacaccagacttctaagaaactcgactttctaaaatcaaaagcaaaaacatatctgagcagccaccaggactgtctatataatttgataaaaatgttgcaaaactgaattaatagttatggttacacaatttggtacatttactaaaatatcattgaattgtacacataaaatgcataaattttatgctgtatcaattataccaaaataaagttatcttcctataaatatatgttcatttgtttatatatttatgtttattatatatgcatatataaatctaacgtaaacatataaataaatgtttatatatttcatatatatttgtatattttatatatatatatatatatatatatatatatatatatataaataatgtctgccagtgacacaggcccaatatctatattccacataatgaagtcatagcaacagggccataatcttatcttattcatcttattttgggatattttggccttaaccatgtgacactgaaatttgcttgggactgttgaaagcattccccttgtttaaagaggttctactaaaaacaacttttcacccatttttttgtttgtttgtttctctctttttattttttctagcacagtggtaacaccctattcccactttaacttcttttccttccttcttttttgaaaattttctaacttgtatttataattctcttgctcatcaaggtcatccagacactatggttctgttcatgtggaattttagtctcatagcaatcagtaagactgtcttgcgagagccggaaatgtgttcattaacttgagaggccttcctgctaagtggtcaaacatggaaacacaaagttatgtagggacattttgctctgtaaactcaaggtatagcatcatttgtttaaaccctctctattgagatgtaattcacatgtgatacaattcacccatttaaagtgtacagttcagtgggttttagtacattcacggagttgtacaaccatcaccactagctaattttagaatatttttgtttccccaaaagaaactccatgccactggcagtcactctctttttatctcctccaccaatgctactctgagcccctgacaaccattaatttgctttttgtctctagatttgcctgttcttgagattttccataaatggaatcatacaatacgtggtcctttgtgactgtctcctttcactgagtgtgttgtcgaggttcacccatgttgcagcatgtattagtacttcattcctttttatcaccatataatatttcatcatatggaaacatgatactttgcttattcattcatcaagtgatggacatttgtggtgttttcagtttttctgcttttatgaataatgctgctatggacttctgtgtatatgttttgtatggatgtatgctttcacttctcgtgggtatataactaggagtagaattgcttggtcattataggaactctatgtttaactatttgaggagccgccagagtgttctccaaagtgattgcatcattttacattcccacaatggtgtttgagggttccagtttctccacatccttaccagtacttgttgttgttattattattagtagtaatgtttagagacagcatcttgctatgttgcccagactggtcttgaactcctgggtttgaggaatcctccaacctcaatcttttgagcatctgggagtatgggcatgtgccaccacatccagctttgtctatttgatagtagccatcctagccagtgtgaagtgttttattttagttataacttttatttgtataacaaacaagaggcacattagatggtgatcatttgcttcacaacagtattttttgtagtcctccttttaaaatcacaaaaccacatatgaatttaaaaccagatccttttctttaaaaatagtccactgcagtctgcccatattccagcagtatccattatcaaagtaaagtgtacacaaaaggctccctccacctctccttgcttgagaatctgtgtcccctgagtatggatgtcctgctccaccttcacagtgtcaccttggaggaagtggcagggggtcatccacttcaaccattttccagccctggcacttggcagcaagacttggagaggccagaggacatgtggccacaggcccctgcttgtgctcctgagtgaacacttgacatagatatccagtgaatcatggggtgcaagccagagacaaccccccaccccatttcttgcaggctgtggatctacgtgtcggtggccctagttattatatctgttatgctttaaaagtgaagactaggccaagacctacaggctgatgattattaggtggattaacatacggaaaacactatagaaaagaaggaatagtttgtgcaaagatgctgaggagcaaagtggcatagcaagttcaagcaaatgagtgaagaaagtagcagactgagtgaaggagtaaggggaacagtagcagaacagagctttggagagatgggtgcggtggtcaagaaaaatggcagggacttacaggccacagagtaaggatattggagtaaggggaagttatagaaacagttaagcagtgtgagggttggaggatgcgtgtgtgtgtgtgcgtgtgtgtgtgtgtgtgtatgtgtgtgtgtgtgtgatgatcaatttcctcaattagaaaaaagagatgtgatgaaattgtgttacagccttttggacactcagaataggaggtcttttattgccaggatacccatagcattgccaccctcagatatcttgtaaactctggtaggaagaactcatggatgactactttgtcgtcctactgcctttaaatctgcttctgtctgttcccggcacccactgaacggcaatttctacaactctcaatttgggcagcagcgtccatactgggaaaactcttccatcatgcttcctcatagacccctattgactgggtaactgctgcatcggtcacctcctctccctgggcctattatagctatggctaagggtgcttccgttgtacctggatagagttttatgcttataagctgcttgtggctattaaacagagcaagaggaaactgtgtacatggaaggaactttgttgcccttctctgttacagacaagcaaaccaccaatgagagcaacaactttttaagaaatcctggcagacttgtggcaagaataaccaatattgtagttcacccgtgaggcttatacaacgtttgccacactgtatgcattgagaatctggttgcgatttttgttataaactcttccattccgcttccccctccctgcctccttacacacgtttacttcagtgaactctgcttgacagactaaccaggctgaggtctcaatctgtgacctaggagccagtgataacacctttgactaatggacagaagacttatagttctatttttgttgttttgattttttttaagttatagtgttgaagtcatacgttgtctttagttattaatcttactgcttccttcagcattttgttgaatagcatttcatcatgctttggttaagtgatttatagttagctcacaaatcccaggcttaagattaaaaagctactcataaattccttagaacattcattgtgccagcagaaagaaaaaaatactggactataggatatcattcctgtatctgattcctacactattcctttgaatatcatcccacacctcctccccgttcaactccaaatggccaatgaacacatggaacatacatacagttagccaataagaacatgaaaacatgctcaaaatctttagcagtcagggatatggaaatcaaaaccacaaggaaataccactttacacccaccaggatagtaatgatgaaaaaaatacaaagaataagtgttggtgaggatgtagggaaattagaaccctcataaactactggtgggaatgtaaaatgctgcagccactttgaaaaacagcctgtcagttcctcaaaaagttaagcatagagttaccatatgactcagcaattccactcctagttatctacccaagagaaatgaaatgtgtgtacacaaaaaacttatacatgaatgcacatgcattattcataacaacaaaaaagtggaaaaaacccaagaatccatcctaactgattaacagataaacaaaatatggtcaaccatacaagagaatattattcaataggaaaaagaatgaagtactgacacacgctcccacatggatgaaccttgaaaacatggtgctaagtctctcttgagctggacacaagagatcacatattctcttgtgattccacttacatgaaatatccagaataggcaaatccatggagatggaatatagattggtggttccctagggctgggggtgggataaaatgcagagagactaataatgggtatggggtttctttttgaggtgataaaaatattctaaaattggttgtggtgatggttgcacaactctgtgaatatactgaaaaccatttaatcaaacacctgaaatgtgtgagttgtaaagtatgtgaattatatctcaataatgtagttataaaaaatgaaccaagaaagccaagcaatgctagacatgcatggtctattccactgtaaggtaatagtctgtctaggcacatttacttattaaaaaaaaaaaaactccccatttatctatttagatgtttctttgttatatatgtgcttaacaatcttctcagtttacttgcagtttgtaggtgacagtttattttatgtcatgggaaactgaaacagaatatgtcaggactgtttacgtgaacacggtctggcctttcgctggacactgggatacagtatatttcaataccccctacgcacacatcccacacacattaatcagggccaacatgctgggagtaaccacgatggccaaccacaggatactaggatgctttttatatggacatttgtgggtgaatgtaccataatctgtttaactggctgatagtcatggtggcagtggcatatgtgtgtgtgtttacattgtgtgtgagtgtgtgtgtggggtgtgtgtgtgtatagtttacagcaagctcaggcggaatgctgtaagccaaacagtaccatgaatctctaaaaaggaaaaaagatcattatctttaaaagtgcattcttacatgctgtcaagtatttgaggattgcttttcctagctgaggctcagtatagtcttctttagtctgttgccaggggatcagcaatgggcaaaatctccgcccccatcccagtacccactctgtgtcatacattttccttgatgacttatgcgagtactttataatctttacaattctcggctgggcatggtagctcatgcctgtaatcccagcactttgggagagaaaggaggatcatttaagcccaggagttagagaccagcctgggcaatatggcaagaccctgtctctaaaaataaaataaaatattagctgggcatggtggcacacttacagtcccagctactcaggaagctgaggcgggaggatcacttgagcgagggaggctgtggctgcagtgatgatcatgccactgcactccagcctgagcaacagagtgagatcctatctaaaaaaaaattccttacaactctctaataggtttctttatatcattttatagatgaggaaactggggcttgtagaggctaagtaacttttccaaagtcacaaaaataagtggtgaagttgggttgtaaactcaagtccactgattacaaagaccatatttagggtcccttaagttaagctgtcttacatcttcccgaggagaaataacatgcttttttgctactgacttaatcataattattaatgaaactgaagtagaaattgattatttgactagaaattgattacacaacaattcaatgtttagactaagaaccaaggatttccaattaatatgccagagcttgccattaaaattttttaaattgtcatttttttcttatggatatgtaataatcatacagtaaacccttgatttgtaggataccaacctgcaggaatgactagtaatttttttaaaaagaaagaaaaaagaaattctccttaaaagtagaattgggatccagatgtgtttttacccagcagtgtcttccgtcatggatttgtcttatagaaggaaaaagacattccaccccagtggtgataggtgcatgaaaagctcattttgagaactaaggatggagaaagcaaagaggagcagagtggtagagatcacagtggcaacagtactggggtcacctgggacctcaaggtgggcacccatggccatgtggtggtagaagtgagaatcaacagagggacagcagtttgcccttcctgttgacagtggaaaagagagcagcaatgaagaagtagagtcaggaactgctctaacgtttgctggaggggcagccagcagccccttatattaggcctaccaggacgctgggtgccatattgaaaagatataacagtcataatggattgtcagtgtggatgcctgcagacatttgcttcatgtggtaatatcatgacagattcaatcagctctttatttaatctgtattttcacctataattatgcttataagacaaactgttcaatggttttaaaagacatgaaaatgtctccattagagaaatagaagctcttacaataagatagttagaatgttaaccctgagctatccaggatgtgtgcttatctagaattactcgttcctacatgatccaggctcgctgaggatttagcatactgggccttaagagctatgatctgcttttttatttttaatatttttggagatattcttccttcctgaggttacccaaagcagtatcctttggccacattttctttgagctctagattagaaaaacatttataaccacccacaaacacaaaactttttaagatgaggttttggagggtaaaaaacttatgaactgaaaagaaaatttggttcctgttggcagacagtgatactttctttgagttctaattatatggaataatttgtaaatgaattaaacaaatgcaaaacaaagggattatttttatgttttaatgtaaatgttgcattaaaaagactgaggattgacttgaatagattggaagactacttcattattaatgattctcgtgcttgcctttggaatctcttgcttggctggattatgtagaatcggattttaaggctttgatgcaaggatgacctcgatcctgggctgcctgctactctcataggttcttaagccaaaagttgagatgatttgcaatggtagggggacaagacagattagcaatgggagatgcaaagagtggagaggctcatcagagagatgaggaagacggctttgcctctgacccaggtgtgaatcagttaagtggtggaaattaaagaggagatgccaaaaagcaagaagtatcagtaaggcatagactggtgaacttggatatctgtaacatatttgcattcataaatgcaacgttttctctcttgccttgtgcagacctggcctttctgcatctgtgtctttttgaaacattacaggatattcaacattagcacctaattatgagcccatttcaatgttagagcctgttttatctctgctttaacgtggtttaagtatgtctgcaaaggaagaaagtttagttacattgttaaccatcctttttcatgtctcaaagagtagaagatttgtttatctaacagattttgccaagaaggcagtgaatgaaatttcagttttgaagtatatttgaagttaacattttgagatagggagccaagctcagtcaagcaacactttcctatggaagcgccttcctttgagctcagcataaatcatgccttaaagtaactttcagcctgattagtgttgtccaatagaaatgaaatccaagccacatatgcaattttaaattttataatagccacatttagataagtttaaaaataaaaagaaacagtaatatattttatttaacctaatatatctgaaatattattttaatatgcaaacaatagaaaagttcctaacgagatatacacatttgtcatgccaagtctttgcactattatttatttcatacttacagcacattttaattctgactagccacatttccagtactcattggtcacttggggctagtggctgtcgtatttgacaccagggctttagagaactgaatgagcaaccaaaagatgactgatttgactcagtttcctactggggaagttttcacatcaactatctctaactctcccccatacctacacccagccctgagcaccccaagattgctgaacttttctcacactgaaatagtcaggatgtcttatcttcacaggtggggaggatacagagctgtgttttcacatttcgtagtaaaattcagctgctgttctctgcccgtattctactcagctttgaatttcaaccccttggctttcccatactgagcagccaacgcaaactattgttttcaatgacacctgttcctttcgaagaagatgaaggcagtaagcagatttgtgcttagtacaaggtgttcaagtgaaattacctatttattttggtgatcaccctcccaaattgctagggtgtatcttcatctggagttacataaataggatttgcccacctcctaaatagagtgtgtgataatggaggtaacctaggcatcctcctacgctctgccacaactgatgctcaattattccccagaacacctaatgctttatgtaacagagctctgagagaataggggagtggcaggcaaaaatgaaatagatatttcaaacatcactcctatgtgaaacatatagatttggcatttaggtggaaggctcttttttccttccacttacagagtttgttaaattgcaagcatgccttggtgttgccagagcaatgtcttgtagctgatactcacagagagctagtgacttgtagacttctctatacaagcatagttgtggataaagccattctagaagggaggtgacccctgtacaataaagcctgggttgttgcaatgtgagatcaagagagcagaacaatcttctattttgttaattaatctagtatataaagtcttgcttaaattaggcataggctcaaagtctgactcacagtcttttatgttttgaaaatgttcaaagaaggtggaaccaaaatgggtgaaaaaaacttgacacatatttgaattgttctcatttgttcatatttgtaattctttaaaacgagacagacaaacgtacagcatacttttgtggccaagaacttgggaatcagatcctaaatctcaatgcaatgttgtactttgggtttgtgtttggaatcaggcatggtttcaaatcccaactcttgtatctactaattggatgacttccagcaagttatttgtgagccttagtattatatcataattgagtcagcagacctatctttcagagatggagtcagaattaagcagaatgatgtacataaagttattggacagtgatgggacaaagtctgactaaataataacaccactgaattttaaaatttaacatgttatcagatctccttcaattatttatatgtatatatgtatgcaatgaaaacataatgcactagcctttttactgaattattcttattctaaaacaggaaatatatacaatcatatggttttatttaagctaacaaacatttgctgagttttggtaatgtcaaataacttactgttggatactgaagggtatatttttgttcaggtcgtaagtatcctaatatcctgtacatatgaatggccgttaggtcacagcttccctcctgtagctcttaacatgtaatgcctctagccctgtggctctcaactgggggcaattttgccctcccccacccctactcccccaccaagggacatttggcaatgtctggagacatttttgtgtatttgcttgccacatcttggggagggtgctattggcgtataagcaagtagaggtcagagatgctactaaatatcctacagggcacagaacagcccctacagcaaagaattatccagacccaaatgtctacagtgcctaggttaagaaacatggtcttgatattatgtatttttctagagtttattatgtctttcatcatttgtgactttggccatgctatgaggactgtctagataaaaattgtccagtcatgagctggttggacataaagctgtgactacttgaactcaaggtgatacttacctaatagcatcgtcggagggaatttgttcattgggcgggaggctggattagctgcttttggatgctcttccaatcccaggaatcccgtgcttttcctcttttgtcacacaaagctatatttcagcaagaatctctcccaaactttgtgttcaccatgaccagcttcttctcagatcctgccatcaaggccaagcagagtatttttggaatgtggatgaatgtgacaagaatgttattcttaaatagcaattctgctatgcaacaccatgatacagtctcctgaatggatctgattccaagtggaggcttgaactctaatatttaatagtaaactatagaaaccttatcaagataaacagcactaggagtttttaattctatttacatgactagaagttgacattcatgtccttcttgaaactcagacccccaaatattgggaaagtcaaatacaatacggcacagtcacagcatgagtatcatacagtgatagttcatgctaggttaatgtcaaacattaagagtataatgctgaaatatttctggatgaaagataggatatctaggatttctttcaatgtaattgagtgggacagaaatctaaaagttggtgttttaaagagaaattggtaagccacagctgtgaaaatggaggcttaggtggtttgcatattggctgccttgaactgtaaattccacctgaagcagaggtaaacgacagtgcttttagccagggggggacggggtgcgggggggcacgttcattgacaatattattgcaaggtatgttggttcttttttttttcatgactggaacaatgaccagcttcacttcgtcaccttctttctcttctatgaaatgccttccctccttaaacctaaatccaatgcatccctgaagacctagctcaattatcccctccccctggaagcctctaaggtcttccaaattttattaatacttctccactgaactcctgcagtgatgcatcttttgcatgttttaagaaattgaggtctagttcacataccataaaattcccctttttaaaagtgtacaatttagtagtttttagtatattcacagaattgtgcatttatcaccacatgttctagaacatcctgatcacctcataaagaattgctgcattcattagcagccaaccacccctccctttccctttaacacctctggcaactactaattactttctgtccccatagatttgccttttatggatatttcataaaaatagaatcatataatatatggccttttgtaactgtctcctttcacttagcataatgttttcaaggctcatctatgttgtacatgtatcaggatttcattttgtggctgaataatctttcgttgtatgggtacgccacattttgtttattcattcatcagctgatggacatttgggttatttccactttttagctattatgaataatgctgtgaacatttatgtgcaagtttttgtgtgtacatgtgtttttgtttctcttgaaatgaaatatagctaggagtggaattgctgggtcacatagtagctctatgtttaaacttttgaagagctgccagacagttttccaaagtggctgctccattttacattcccaccagtgatgtaacagtgatgattaaaagcaatggcaaaaactgcaattacttttgcaccaatcttaatacagggattcagatttctccatatcctctttgacattttaccctgcacaagtctgttgatgtcactatttgtcctcaggattgattatcccacatcccaaattagtctcacctcccaaattagactgtaagctacttaggacaatgatccatttatttggtctttatttaagccagtggtttttttttttttttttttttttgattgcttattgtgtggcaggaactggtaagtgctaaggctttaattaagaagctctattttgtgggggaggcacataaaatcacactggcctgttttggggtgatgggtgcagtaataacagcctattcaaggtatagcctttgcttcatatagtttccctcccacaatgtcatacttacaaacaccactcaagtctactatttaatacattctattagagaggaacagatctctgtgtgtgtcctctttttagtccaaatgtagaagctctgatttttctgttgggcttttgtgtttaaatgtgcttaaagaaatcaatgccagcaatatttctagcagtaactttggatgtaccatgtaagttattttgaaacagtgaatcatcacgaatgttaatctgttgacttgtatgtataaaagcttcttgagactctaggctaaggagagacaaagcatcaaaaatgtaattcctctggattcagaaataaattatccacatgccattttcacctgcagttaatctggttttatgtttgtctttctgcaactctcattcagtgttttggagaaattaggacatttagaattcctaaatgacatcaaggataaaaggaatcaaactgcaaactgtagaaaagaatgcattgttatactatatataaaggtataattatataattatgactataataattaaaacatattgtgcttaacaatagtatcaaattgttttcatctgagttcttaattacctaatataaatatgtctatgccagccatgccaaagcaggtacctaaaggaatttcttatatctaggaaaaaacgtattgatcacctcatgcatttaagggacaagaatggcactttcattccagcttataaatcatgtcaattttaacaatgacttaaaaattcttttgtgatttgtttaaactctgaaaagaggcttgtttgtgttaaggaaaaatcaaactgagaatgagttatgtgctcatattatatatagatgagtaaaactcttactccctctgcaaacattagaaaacaataagatactcccacggtttctttttttttttttttttttttatagcacttacgcagtccttactatttaacaggcactggtttagaatttttacaaatacttctttaatcttcataacaaccctaggaaacatatacaattattatccccattttacagataaggaacctgagagtttcagtaacttgtgtaaggtcaccaggtagtgtaagcccatgagatttggcaccttttccaaagtggagtaggcctgccccagagtaaagagtgcctgttctagtctttatctcaaagaaagcagtgatttaattagttactatcaatgtggggaatctgttggtctgacatcattctaggtttcagaggcaacttggctgcaggttttgtttttgttttcgtttttgttttcatttttgttttgagacagagtcttgctctgttgcccaggctggagtgcagtggtgtgaccttggctcactgcagcttcgacctccctgggctcagttgatcctcccacctcagcctcctgagtgcctagaactacatgtgtgtgccactacacctggctaattttttgtgtttgtattttttgtagagatggggtctcaccatgttgcctgggttggtctcatcctgggcgcaagtgatccgcccactttggcctcccaaagttctaggaaaacaggcgtgagtcaccatgttcagcttgcaggatattttcatacagcttaggagagcaatgaaattaaatgtgagagataaaatatacattgtcacctacctgtttgatggtatatataatggattatctataccatacattatacattatagataatatatattatattacatcttcatattatgtatagtcatgctgtctttgatatacatacacatatatatgcatatgttatacacacacataaatgcttagccccttgcaggctaccctttcccatgtgcttccatgtcttgggtaataattcttctcagactttcaggaagtacagtgctactaatattcttggaggttattattctttcttcttggtgaagaggatgttgaaagatcaataatttccatctatctccagatagtaaggatgccttgtaggagagagatctgaagaccctgacatgtccacagctttgcagcctgattctgacctttctgctttgggggcaacttccatcaaaaggagtttcttgtcgcagttcttacaggcaggggcatctcacaacagttgctagtaatgataccatctactcccaagaatgggaaacctatactcatctacttggcctcccaaagatggatcccatttagggtgtgtgtgcacatgtgtgtgtttgtgtgtgtatatgttttaaccaaaataattagtgttaccaaatctctaggcctccatgcctagaggatctctcattaagtaggatattctatgcgctcatactagaaagttataaaggcaaaaaagacactagattaaaactgataatgtccatataggttctgagatttttttaaaaaaaagtctgagcttatgttaaacagaggtaatgaggataatcagttgtataggcttccctaatgtaagtcagcgtctctcatcttggcattcattccagaactgtttttaaacaggcttgcatgtgcacagtatgttaccttgccttctaagtactgtcagaattggactggtacctagcaaaaatatcaaaattatgagtcctagaacagtgcttggatgtaataagcactccgtaaatacttttggaaaaaatatgttgatcaactacggttttattagataatttaaaaaagataactttaacccctgccctctctggaggagagagttgctacagtaagagggagcagtcatccccagacctctctttgatgcttctgggtgtaagaagggcaattgaaaagggatttaggaaacaccaggcatgctgggtgagtaatatggctgccacctaagagaccatcagggaagtgtcttctgtggtatcatgccctgagccagaatgccgttgactgcttgactctgaagaaattttaaagtgttcctgagggtgagagaggtcttttgaatcagggattctcaaggtagcctatggtgatttgaaatgtttacattttaatatcacatatactctcctttctattggaagcaactaaaactgatagtgaagacttatgcttttgctgtaaagagtaagagttgcctatctgtggtatgatagtactcctagagggtgattcataggttaaaccattggaacagaaaagagaaaatatttttacttggccatgctctcttttttaaaaacaaatattactatttttttaaaagccatatcactggcatagttttcagttgtttttacagtcggttgctctttaggcttacaatctttaaccttgaaattattcagagataattatttttggaaggaaagtgacaagggaaatagttatgtagtcaatttttgattatccaagatgattttgccattagaattagtatcttattttagcaaatagcaacagtcaccttctctctttgctaacccttggaacaaaatgttttataagggaacagaactgaattttatttctcctcctgtgccccgggcctgtcttatattttcactgccggtagtacctaatgttttccccatttcagcagtatgctggagccagcttgcgttggctggagaaccagttgtgtgcatctcttcctaactgcatgtcctgtgtcctcaccttggtaccctggaatccgccacaatgagtatttatattatggaaattaacaaatggcgcaaatcagagctttcctccagagaaccagttgttaaatgttttatcagcacactgctgccccattgagtccttcctttttgttttttgatgaatattttctaaaatgtattagatgttgctgtctttgcaaacagggtgtaatagaaaaatttactatttcctggtcccattattatacttcatattgctgggttagcttcttagtgtttcttcacttttcccttcagaagagggcttcttccttctgaaatcttccactcagttcttatgtgttgattttgattgcccttagtccatcaaatgagataaccaagtccataaatgtgcatgtagaataaaatgagagttagaggacttctgttacagaataaacctcttgaataaaatgcatggccttagtccagaatttttgtgacaactagtttgattgccaacaccagctttatgagtatcctacctgtgtggtcgcacagggcccatgctcagaaggacaacatgactaatgttctgctgtcatcattttaaaattattaatctgagcaagaggtcctgcattttcattttgatcagggctccataaattatgtagccaatcctgatagttgttcagatgccttttttgcttctgattttagaaagctgaatttcttagaagtctggtgtgtagatcagtgggctgtttctatattaaccacagatggatgcttggtcagatcactataaatactaaataagtagtaacaaaaaaatgatgtttattttcattcattatattgtgatttttctaaatgggtgtcctaggaaggaaaatgatacattataatgttactcacttattttgaatgtataagattaattttaatccttcacttgcaagtaatttctggttctcttattgagatatatttttaaaataactttattgaagtaattttacatcataaaatttactcagtttaagtgtgcaattcagtggtttcttaataaatttacagagttgtgcaacattcccacaatctgtttagaatatttccatcatcccaatgaaattgttcatccccatttgcagtcattccctgttcccacccccagccccaggtacccactaatctactttctattggaacagctttgccttctatggacatttcatatgaatggaaccatacaacatgacatgtggtcttttgtgattgacttctttcactcagtattatgtctttgaggctcattcatgttgcagcaggtcaatgcacaactttacgctaagatttataggatatgtgaggttggtgtaggacaaataatgcttatctacttatctgtgagtgcacatttatttttgctgaaattttcattgagaatggaaaggtagccccattgcattctacaggaagtccatttttggcttataacgcttatcattttggcaccttctggatcaactactcaccctaccttctgagaaactttaagctatttatgagggtgtaagtgaacttaatatttgagttcaattactaccaagcacactttctggaattactactaaattgcaaacatattgtagcagttctaaagacgcttttttgagttaatgttcatcaatatttaaaaaatatttttctcagtattaaaacaagttaaaaataccattgataagaattcaggctctgggctgagacagctctcagtggaaatcctagctctgcctctcaaagccatgtcctaaaataagctattaaatctctccaatacttgatttcctagattatgaaataatactacacactacctcagagaatcattgacagaattaaataagtcaggtaatgcattgaacacagtgcttagtacaacaaatgttactaaatgtaaacatttctacaatgatgagtgatgattctgttatgtacagatatgtactaccatttgctagtgtatcacaacagaatagaacacatcatataatatgatgcaagttatattaataacataatgtctatgcatatattttgttatatccatagaaaattttaacaaattaatagcacagtgtgtggcctttactacactcaacaaatgttagttatattattattatcattattacttacaatggctttcttcagggggaggaactataggagatttcttcttttcacagtatatttctgctgtttttggtttttgcttttgtttgttttctttaaaaaagtattacttttttaaataggaaaaattaaagactaaaaaacttaaattgctcttgaatagatttgtaatcattatcatatactctcttaaatcacttattattcaccttttataatctttggaataaataataattaaaacttccattttctttaaataagaaaataatactgctttataaatactcagtaatacaaactaactgactatttcctgaatttgatagtgtctttttcaggatatccttcttgtaattcagtaaatagaaagggcccccattaaaaatcacatggagaaagtagggtgtagggttgggacaaacacaccaacgtgacttgccttgtatctcttatttcccattttagatactggtgggttaaatttacttaatatcaagttcaaatgtatgtacagtcttaggacttggttgttgattcttaagagtgtgttgaaaaaataaagaagtcagctaggagaagttgaaagaacttagactttgaattcagatgcctgcctttgattcttccttctgtgattttgtgctctttggcatctcaaaaactcagttttcctaccttgagaatggggaaaatccccaccctatgagtttttcataggcatcaaatgagacaatcaatttgagattaagctataaatgtaaagcctcctccaaaatgctagccagtgtgattttttaataaggtcattatttttcttccttttaggatttctctctcccaagaccaatagtactaaccaatattcaggcttcattcatgtttcagcagggcatgggaatggttgtgggtttctttgagctcactggccatttattgttattgattaattaactcgtgataaacagctggtgaaaaacccaggataaggaaatgagagtgatggggtggggttgggaatggtacataggaggaggctggaatgatgaacaggaaacagccatgcagaactctgctgaaagagccttccagaaaaggaaacgcaaaagctaaggctggggcaagttacctgtattaatataagataacatcaaatgggctgtccttccagaggagtaactgagcttcctttggtctacaatggaatttcttcccattagaaaatttgacccttttttcttgcaaaagataagccaaagatatgtgaattgcatgacagtgatttaggatggaacaattccttatttgaggaatgcttctttttctattttacttctgtgcccacatagcacccagcttacaactaggagcttagtcatagacagttctcaatgctggctgcacattagaatcaaacaggaagcttttgacacctcactattccaagtgtgttccttagaacaccactgttgacattgcaaaatgcagaatctcaggcacaccccagacccactcaattagaatctgcattttacgaagatccctaggcaatctacatgaaagttaaagtttgagatgtgctgtacaatactgtgccaaagatcaagcttcactcctagagcttctgatttatttggtctgggaagaagcctgccttggcatcattttaaaaaagaaaaagaaagcttgtaatctccaactgatgagaacgtacagcaaaacttgaagaccactgacttgattgttctcactcacaggccctcaatcactgatgactatcaagcacgtggaaatgggattcatcaattatttaaattgcttgtttgagagtaccagttatgttttaaagttttctggcttttttttttcttttcttttctttttttaatcatactttaagttctagggtacatgtgcacaacgtgcaggtttgttacatatgtatacatgtgccatgtttctgtgctgaccccattaactagttatttacattaggtatatatcctaatgctatccctccctcctctgcccaccccacaacaggccccggtgtgtgatgttccccttcctgtgtccatgtgttctcattgttcaattcccacctatgagtgagaacatgtggtgtttggttttttgtccttgcaatagtttgctcacaatgatggtttccggcttcatccatgtccctacaaaggacatgaactcatcgtttttcatggctgcatagtatttcatggtgtatatgtgccacattttcttaatccagtctatcattgttggacatttgggttggttccaagtctttgctattgtgaatagtgccacaataaacatacgtgtgcatgtgtcttcatagcagcatgatttagaatcctttgggtatatacccagtaatgcgatgtctgggtcaaatggtatttctagttctagatccctgaggaatcaccacactgtcttccacaatggttgaactagtttacagtcccaccaacagtgtaaaagtgttcctatttctccacagcctctccagcacctgttgtttcctgacatttgaatgatcgccattgtaactggtgtgagatggtatctcactgtggttttgatttgcatttctctgatggccagtgatgatgagcattttgtcatgtgtgtattggctgcataaatgtcttcttttgagaagtgcctgttcatatcctttgcccactttttgatggggttgtttgtttttttcttgtaaatttgtttgagttcattgtagattctggatattagccctttgtcagatgagtagattgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctacctggaggcatcatgctacctgacttcaaactatactacaaggctacagtaaccaaaacagcatggtactggtaccaaaacagagatatagaccaatggaacagaacagagccctcagaaataataccacacatctacaaccatctgatctttgacaaacctgacaaaaacaagaaatggggaaagtattccctatttaataaatggtgctgggaaaattggctagccatatgtagaaagctgaaactggtttccttccttataccttatacaaaaattaattcaagatggattaaagacttaaatgttagacctaaaaccataaaaaccctagaagaaaagctaggcaataccattcaggacataggcatgttttgtggcttttaatgaatactcttaataatttgtaaatctttctctagaatagacttctagttcccattagaactagactagtggttaacattactgttatcacagatcagagactgggatgcatgataagttttccttgtcttccttcagctctaaccacaccgactttctcatgtttgggggtgatattatttctcactgtatttgcattgcaattctgaaaaatatcttcctatcccacctctgttttgttttccatgaagtgagcaaatttaccaagtgatttggaagaaatttatataattgtatagcttgaaaagcctttttttcccctacaaatgtattatttaggacatgtaaaatttagcaaacacagatattttaagcataatttactaaatattgatgataacgcatgctcagaagtcttcatttagaggactctcaatttgtctgagtgtaaactcaattccaacaatcaaaataatttgatatctggtttttgctttagcaacttcacttggttggccaatgttttaattctccagtccttgatctctcattgtggtaaacccacaggataattttattagtgctttgattttctgtaagaggcttttttgtttttctttaattcagcatataattggtgcatgtttaaacttatttgtgtttcggttgaaaggcagttattagtagagagtatcaatagagagttattatagagagtattagttattatttgcagaaatgttaaccttactatctagagcaggatctttctgcctcagcacattgatattttggactggataattctttactttaagggatttgtcatgcgttgtagagtgtttagcagtgtccctggtcgatccccggtagattccaataacaagctgccaatcatgacaataaaaaatgtctgaaatattgccaaatgtcccctaagggtgcaaaactgcccccagttgagaatcactgatcagtagagatgaaaacagaaaaagaatctgtaggcattttgtgacctaaataagacattcttatctccgtgttgctagcttttattttgtggctgagtgaattgttttcagtgtgaagaccaatggtacactggatttctatttaaagatggtttcaaatatgtaaaataattgatagtttacaagccacccaaacatatttccccacttccttttctgagtttagttgagaaaattttatatgtagaaagctgaaactggatcctttccttacaccttatacaaaaatcaattcaagatgggttaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaagagaaaataccatcagagtgaacaggcaacctacaaaacgggagaaaatttttgcaatctactcatctgacaaagggctaatatccagaatctacaatgaacacaaacaaatttacaagaaaaaaacaaacaaccccatcaacaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttagaacggtgatcattaaaaagtcaggaaacaacaggtgctggagaggctgtggagaaataggaacacttttacactgttggtgggactgtaaactagttcaaccattgtggaagtcagtgtgttgattcctcagggatctagaacttgaaataccatttgacccagccattgcattactgggtatatacccaaaggattataaatcatgctgttataaagacacatgcacacgtatgtttattgcagcactattcacaatagcaaagacttggaaccaacccaaatgtccaacaatgatagactggattaagaaaatgtggcacatatacaccatgaaatactatgcagccataaaaaacaatgagttcatgtcctttgtagggacatggatgaagctggaaaccatcattctgagcaaactatcgcaaggacaaaaaaccaaacaccgcatgttctcactcataggtgggaattgaacaataagaacacatggacacaggaaggggaacatcacacaccggggcctgttgtggggtgggggaagcggggagggatagcattaggagatatacctaatgttaaatgactagttaatgggggcagcacaccaacatggcacatgtatacatatgtaacaaacttgcacgttgcgcacatgtactctaaaacttaaaggataataaaaaaatttcttcctttcttccttctgaattttaaagctccttaagtcaagtgaaaaatctagtcatttacctgcgaagttcaaataaggaaatgactttggctacaattattggagtgcttcaggtgcaagtggctgtttgggcctgataatttagagatatgggacctcacatttactctctctgcatgcaaagcagtgggtctcagccctagctgcaaattgagatcacctgggagctttagaaacttcatacccaatccccaagccccagagattccagctcagtggtcgagggtggtgcataggtattttgtagagctccccaggtaattctagagtgcagtcagggttgacacccactgatgtaggtagatagggctttgctgcctttctccttcattgatcactttcccacatttccctgtagcctgctttcttcctgtctgcaacatcctggtcaaactcttctgcctatcccttgttattatttttaaccaaatgattttttccaagtgtttttcctttgttcagacttggacttggcgtggaaactgctggatcagtctacttaatccatgaccttctttcagctgctgccttcctttcaactgctgcctttatttcaactgttaacctcagtccaccttaaaaaatatatatggtttttaagcgggtatttcttcctttgccagcaaatcattatacgcagttcctgtctatgtttaccaccatcacttgcctctatttctttttccttactgctatttatagtttaattttctttcttttctttgtgctcttttttattcatgtttccatccttagatgacatgctcacgttttgtgaattaggtgtgtttcaagatgctgggaaagtaagttttctgtgctttataacttcagacccgtgtatttggtttgtgtcttatttaaaaatgtatgttcttatggccctgtttgccccacctaagcgtttaaatgtgacacctcatgtctgttgggctcccaggttcctattatggccggtggatctgggccaggcaaaccatcctaggcctcaggcatctcgtcacgtctagattcacctctccccttcccacaagacaggctcacctgccttccagccctgtagctgctggcctctccctgaactccgtggtctctagcaacctttggacttctaagtaatattgcaaagatctttatccttggcttgcttgagagcatttctgctaagccctaccagcaactttcatcttgtttcctcagttagttcttctaaaataaatcataaattgccccattgctaaaacttacgtcacattctttcaattctagtatctgagtcattgcaaaaaggcatctcaggttcgttccagagatttggcaggggagcttcccacaactcagcaaagtgtttggcccctttgggccttttcactgagacttgaggctagatttgctgtgcctgctctgtcctttcccttctaatttctcaggaattgtctttgctgtcttcttgtgttctctgagatcacacttccacagctgttccagaaacatcacaccacttgtatttttttaaagccttagcttttgcttgtgggttcacttgtacaagaatattaacgttgactctcactttgtgtaatactagtatatcaagctagtcttttaaaaacaccttttttaagcctttaagcccaatttatatatctcatttttttatcatttttgcattaatgtttaaaaacaaaacaaaacacaacacctttcttttgatcccttaaataccagctagtgagactttcaaatctagcacttaattttttactgagcatctaaatattccttacaaaatttaaacttctagatttaactcatcagatttcctcaaacacttaaacagagattgcaaacttaaatcattaagtcccaagtattttagttaaaatcataagttcgatatgtcagattctccaaaacaattcaaacacctcaaagaacaaataaaacttgcatatcctaacatgttgattccagaagttatttttacactcaactcaattgtattaataccaaagtttgattaatttcttcatttgccccatgtattttatcaatattactactagtacctgattagtattaatactggtagcagcattatcattagtattcataatagtgttaatgctagagctatcatcattattagtaccagcaccagcactattagcatagaattagccttggtcttagaattatattagtattagtatacttctcagagttgcaaggttactgacccaaataaggaaaacagaaatgatagatacagttattggttgagaatgtgacttcaaatttataaattgggggttttcagtcagagattttggaccaagacaccaagaactagggtttgccattctgattcctcaatcccactgggcctttattgtgctatagtcatttatacagtagtaagaatttctaagcttcaaccttttcttgtagtctggtgaatcatggtcatttatacttaattttcttacagtgttttcttatgtaatttttattgaaaatttctgtgacaactttttattgcctgattggagagggtgaccaatcatccttgtttttccaggactggagggtttgctgggacatgggaacttttcagcgctaaaaccaggaaagtgtccaggatgactggttatcctagattctaggccagtggttctccacccccactagaatggtctggggaacttttcaaacataccaggccccaagccccacctccagagattctgatttaatttgtctggggatagtgcccagtcattgatattttttaaattttctcaagtgattttcctgtgtagccaaggttgagaaccatcattctgcattctctacccaatttgaaacaccctatgcaacattgtattgtctactttgacctcctggaacttagcaaaacttgaatttgacaagcatgtgtttgggttcatcaatgtgaagtatttccagtaaatattcctgggggaagtcatgcacatctttcttgagcagattatgttatttgttgtttttgagtatatgtgttctcatgacttttcacagagttttttgttgttgattaaactgtcatgctttcattagtgacaactgcattaagctggtccatttgtccagttagcaccacccttgaaagtattcaagcttcttggtaacaacaaagtgttccagactcatcctggtttttcctgccacaagacatggaatcaactacttttcaaggatccctgtgtctttcactttttagttgaaagttttagagaccaaaatcttggctacccgggggcacatcgtgttgttttacaagagcattcatagtaggtagatcttggatccatgatcttatctgaaattgaaattcttaattctctcacatggtttttgtgcatccccattgtccatcctgtagatacttttttatccttattctttttttctataaatcaatatggtgttctttgtgtttttttcaagcattaaaattctgtcactcttttatttactttcctttcaaatttcaactgagaatcaggaaaactgtgtgtatagacttcatttattttctagtttattctgagaggcaaggggaagcaccctgttgtcttttccaggcacaaactctatttccttttatagtttgataatttcttcgttctccagtactcatattttctgaagagtcatcactccttagcttatttcttcataagttatagccaactgagttttatacatgaagtggaaagtggattttcctctgaaatgagaggaagtaggtattttgttgccttttaaaaagaggtagaaatgtacgagcaggtcaccctctcagtcctcatatgggctgataatttgtacctgagactatagatttaggatatggggcagaaattgagtcagaacagtacagccaccaatggcagagaccacaggccaaggctcaaaaataaaacccacataaatgttattttagtgagttttgccctcatcctgggttgttttgtagggaaagtgatgggagagagaagggggcatatcttaagaaggcagtcccttttgcagtgttttctgacttaatcttagacctaactcttaattttagaattcactctgagaagatattaggcaaactcttactatcaaaggatttccctcatttgggatcctgagtttcgtcaagtcacttcagatcagcaataaaatccccttgagagtttccagatttttctccacaatgaaccatgaagcatgctgtttatttgtggaactcccactcctggttcttcagaactccttcatttgccgatctaaagatagcaaaaaaggctcttaaaaatacacgccttattgattttggaatgttctggtaaatgccaatctgattgatgtcatttatgtagggaaggctttggcttaagccccaaagtgattttagccaagaggaagtaacgtatctaataaataatgtggagtttgtgtattcatccaccaaataataattatcatcactaaaaatgtgactagagatgccacatccacttctccattgaggtaaatttctaacagacaaagccaagtgaaatttgatgtccgtataagctgctttgacctcgttgtttctgactttcattacagatgaattttcatttgtaattttgttgttgttttttggtttccttggtactttgatttgtttgggcaaaaactcagtgaatctgtagtgatttaggagacagtttaatcaacacaagtgcccatgtttcagactcagacatgcaggtgatatttattctgggtaattttgggggatctacaccttttgtttattctaagatgacgaagctgcattattattttatatgtaacatgcactcattgtaaaaaagttgcaacgatagacaaaattataaagagtggattgtaataagaaaaaattctgagtacatggcaggatccatatactatgtgtattcttgccttattttattgggacaacaatgaaaataggccaatagtttatcacatgaagagccagccttcacaaatacagctctgtggaattgtatctgagcataaaaacactctttatttaattattattaatataacaattaccaataacctttatatctatctatttacttatttatcttttcctgtggtggggggttcaaaggtttctgggagtgatcaggatgcccaaacttcctctaactttaaaattttaataagtaaatgaagaaagctccatgttttcctcctagagtttaattagctactaatataagttgcttagcccaggatctatcctatggtggtaggtgttcattatgtttagctaaaatttccatcaccattatcatctttgtcatcattactgccatcactaccacaaccaacaacattacaatcaccaccactgtcatcatcaccattgtcatcatcctttaatactaggcttgaggaagctaaagggagccaaatgtacatttatgtcttatgtaacattaatgttacttgtcttattcctaatgcctcatcttaaatgtaaagaaagtaagaagacccagagatagttaactttgtcgtctcttgactcccaggatcaaaaatagttgttgctgcagtgtttggaataaaaaagcttaaaagaccttgtatacaaaagtggttcgtactgccttctctcgtgaattcatgccagcagatatttttattctggtaggaagtaactaaaagctttgttcaaccctggtctgccagcctctgtaacgcacgtctgacaaatatgtgtgactctgtgagaaagtttggttctccccctggtggcaaaaggaaaaactaacactagtgctccttatgggagtgtattgatagggtacgagatatgtaaatacagctttacccttttcaccagtgttgcctgagatttttatctcagcccccttggttacttttgttctttggacaacaactggtttatatcttctatggtcgttgggatgaaagggatttgacaaactgacaaagcattttgcttcagaaaccacttgaaaaacacatctatgtttcaaataaagattatttcaggatcataaaaatatgctcggtgtattagccatggaactagattttaagcttcatgatcatagagatagatattgggtttattttattgttattgcctctgaactgagaaaagactctagaattctaaatataacgcacacacttgaactaagtagacggaaacttacccttctaggtaggtaactctgcttaccttccaaacagagtttggatgatattgcctcatagaaagattttttgatacaatactcaggaaccgctatggactgctgctttggggccaggccccatgccacttgattaaatacatcctcacttaacctgtccctacaacaactctgtgagggaggcatactcataccgaagctttagccatgtggacactgctcccctgaaccacatgcgtagtcaaatggttagggcagatttcagctcatgtctcttttattcagaacccatcctttaagccagtagttctcaatgggggtgatttgactcccagaggacacttggcaatgtctggaaacatttttggttgtcatacctggagaggtgctactagtcggtagaggccaaggatgctcctcaacatcctgtaatgcacagtgcagcccccacaacagagaattacttggtccagatgtcagtagtgccaaagctgagaaactgtactcctaaccagtgctactcaaaatgtattccacggaacagcagcatctgcaacacgtgggagcttgttagaaatgcagaatcacgagccctgtcccagacccagtgaaccagaaactccatggttggagctcaggaacgtgtgtttctacaagcccccaagttcttcttgcacactcaagggagagaagctctgctctaaaacaacagatcattctgtgtctattgagctagacacaatcgtatggtttcctcaccactttcagtgttccgttgtcgcatagaagtatctcctcaagcatctaaaaggggaaagtctggcgtacactaggaacaaatgtgactcatggggaaatcagtgcaattacaaatccaggaaccacacccagctgaaaatctaggaaggttctttttctcttattttctctacttaagaagggaagtctcggagacttagtctaggttcaaaagatgtcaacatatacacaggcttggtttggggtttgattatctaaaattaaaccttaaattgaattaggtaaaacccattttggagagccacagaattctaaattagaaattacattgagtttcgtatttactggcccaaataagtaatcttctctatttgtgcatttttctaatcacaaattgtcttctgagagccagtgaaataattatttttatatgggtctctcttcaataattgctcatcacttggtattttatgtgatttttgtggggcatacattataggcaaggatgtattgtaaaggataaaaatgtcagataaaacatctgtgtttaggtagtttgtacgtcactgtcctccatcccacctcatagattcctactgcttggctataactaagagtagaatttaaggctgacacaggaaaccaggcaatcaagttcattaagtaccttaatcaactctggccagaggatgatctcagagctcccctatctcaagaagaaatttcatgagaaagctttggggttacttccagattaaagattatgttctggacagttcaagccctaaacaacagacacatgaataagtggagccatttctatcatactttttcagggactgaagatataaatattgctatttgttattaaaggattttgtttgttaaacctgatgatacttatttttatgtgagttcatagtattccagctcttcaaaacctaatttgtttgtagatccctcattgtcatctttgaaaggttccagtagtttctggaatactttcttttcctatgccaaatacaacagtgaccaagaaatccatctgaaggatttggatagtgtggtagcatgtattgatggacccagtgttccactcatccctgtatacatgctctttaggtaacatgacagtgccctctaactctgactctggagtcagccttttgactggctttggccaatagggacatggagaagtgatagcatacctgttgtaatcctagacctcaagagacctttcttgttcacacttgtccacttgtgcttctgccatggccatgagaaggacatgtctgagccggattgctggagaggaatgagagacatgtggcgtagagctgcatagctaagcaactccacccaagcccagcctagagcacagccccctgcagatgcatgagctagtccattcaggatcaaccactctccagcttccgagtaggttattacacagcaatagctgactgatacacatgagtagagaagaaaagaattttccaagtaaagataatagtattgataaaaccgtgaagagaagggtctatcaacatgttggatcacgagaaagttggcttgagtgaagtagaacacgcttattgagaaataatcaaaaataaaactggatagagagtgctgactcaaattatagaggagtttaaaagccagccaaaagaatcatagtattgtgtgaaagtgccatagaaataatctggtgccaggtcttcaactaagacaaagtgattagtggccaaacaataatggtacccaagtcttaagtgtttgtaagtgatgcaataggaagagataatggaatgatggaacagggattttaggaaggtaaatacaaccatgagttagaaggaatggtttggctgtccctagacatattacctgtgagacttttgtagtattatggaactggagtcatgaagctctgaagcagaggatggtcttcgggaatggaaaggatagttatggaagaatttttgagaaagaaaaaatattccagttatctattgatgaaacccatgtttctctcctgatcacacttgatatttaatgagagagttcttattaaaagtaaccatgtccatgaaggatcttattgggatgaagaaagtgttctaaaactggtttatggtgatggtagcaccacttggtaaattttctaaatgtcattgaattgcatgcttgaaattgttgaattttatgatatgtgaaatatatatcaataaagctgttaaacaaagaaacaatgaaaatccccaccagttatgttccatagtccctggagggggctgttttcatttgaatacccaaactcatcctgtcaagtacaggtagcatcctcctcttctttctcagatgacactatacgcagcgaaccattggggtgcccacatgtgccacacagcctagagccaccactgtgtccatgccagtggtactccatgtagatgcagggaagagcccttcttccccatcctggcccagactgtcagtgagtaacaatgacgtgctgcttgtatccatcatgaaaacagtccctttcatcttggccagaaaccctcttttcctagatctgagatctatgtcctgtgtttgggcccacagatcagttccttggctccacttctcaactgtcccttccagttgccatccttcttactttttctgtcctggacctatctctctcactgtcgtaaaccctcagcctcatttgaatgttggcaacgaatgaatggtagcaaattctactactaaaatcccgctcacgaggggactaatcaaaggtgacattgaaataagtcttctggattttaagcacaatatggggcaaatgaggaaattgatataatctttttaaaaaatttaatagcattattgagctctgattcacataccatacaattaactgatttaaagtgtacaactcaacggcttttagtacattcctctagttgtgcatccattaccacaataaattttaaaatattttcatcactccaaaggaaactccatacccattagcagtcacaccctattttccccatcacccaccagcccttgcaaacactaatctgctttctgcctctatagatttgcctattctaggcatttcataggaatgaaatcatacaagatgtggtcctttgtgactggcttctttcatttagcatcacgtttctgtgttcttgattcaattaaattaacacaaaactttgggatccattttgtgccaagcactatgctgggcactggttggaaaaagagcttacctttctgggaaagcagaacaacaaggaaacaatgaatcccattccatttaacagagggattgatcatttggagtgtgcaagttgaagcatgaggtatgggactcacactggaagaattttgctctgcaggccatcaaagcaccagagtattgaaccaggcaaattactttaattgtgctcttgagtttattagatgtgaatgtcttgctggcaatcatggttttactatggaagcaaactgaggtcttggagagctcattctgtccttaattgtaacatttagtaccaagaccttggacatggtacctctctgggccccccttgtctcatcaggaggggtagaattgatggtctttgcttatattccacaggtcttagaatgatcagacctgacaatatatgggaaagggctttgtatgctgtaaaatgacaaccaagcatgattttaacaattgtgctgcacaaaataagcattttgctgtaataatttgtgatctcataagcattagtcttctattgatgcaataataaatgaccacaaacttagtgtcttaaaatactacaaaagtattatattctagttctgtagactagaattctgacacagatctcactaggctaaaatcaaggtgtcagcagggttcctttgggaggctccaggggcagatccctgccttttgagctcctattaatagaagctgccctcattcattggcttttgtgcccttcttccatcttgaaagtcaacagtgttgcatctccctgtgcctttgtgcttttcttccatttccctttgacagactccaactggaagagtctcacttttaaaggttcatgggattagattggttttacctggataatccaggataatttctccttctcaaggtctatacacttaatcatatctgcagtgttcctattaccatgtcagtcaaaatattcacaggttccagggatgggtgtgtggacatctttgggaggccatctttctgccaatagatgagtttctgttatttctctccttatcgcatctcactgtgtttgtatgtgcacatgatcatcttgttattttctctcttctgtatttacagtcttttttcattttctcttttcatgctgtatcactgtttatccttttttactatttctttcccttgctacacatttcttttttcccttattgttactatcctttactgcttcttagtattttctttgtatttcttattcatttggctatttatggatattttgaacttcctttatcttcctggctttttctaatttaattttcttatcaccttcctttgagccctcttggtctctatttttacacaacattgagtcaatctctttttctgtccttcttagcttcctcttctaacccttgctctcatgcagaattcttatcttcatttacacacattgtttaacttttgtagctccttcagccctgactgtgcagtttatatcttgacaaatgggaggcgggaaagcagacatagcagggagaagccattggtactgagaatcacaatccacatctacataaaaatgccccatgttctgcagccaaacttgaaccttttggagctcctgctaaaatctcttaaggaaatctcaaagacaacagttacatgattactgattacacatgcgtaaatatagaggtatgtttaataagaaagatcagaatagaatttggagtgatctaaattacctaggatagatgaagttctttttggtgtaaattttcttacaattacagcaacaacaacaacaagcccttcaaatataaatgtttcatgtcattgctttttcaacttatatttattttgtatgattctaataaagtaagcatttgatcagttgcagaactttcatgtatggacattgcagagaatgatgttgctgataatgaaatggcataatgtgtgtaaaactcaggttcttagtctttttaagccccagaacaaatctgttcagaataagatctaagttatacatttgctctccagaggaatgtatatgaagaaaattttgtatctgctttctggaggtttcattcataaattcattctataagtatttactaagcatatataaagtgaacaaaaacagagatactgttctaggcattaggaatacatcagtgaataaaatacaatactttcttttaaagagattatgctgtagaatagggagactgacaagccaataagtatataatatgccaggtggtaatacagaagataaggggatagaatgatggaggggagtcagtaggatggtagggaagctttctcaaaaggtgacaatcagaaatatgacataaaggagacctgatatttaaaggatgagtcaaccattgttaacggcttgctatcacttaggttcctgtgtgggaagtcaatttagatagtcagacaaagaaagccctttttgtctgttaatgtgaagaacaggttttagtttaacttcttacgcatagcagtgagtaactagaaattagcacattccagggacaacatactctttcagatttatttgattttccaatatggctaagcaaacatatgattattcattgaaatagtagctccagaggtggtattagattgcctacttctgaggaattaagagaagaaatggttgcagataaattttaaaaagctaacactttaaatgttatagcacctagatatacagcattgtccaatagaaaattttgtgatgctggaaatatgtaatatctgccctgtcccagtgaatagtcttcctcagaggttttctttatagcttccacatctctgttgtttgagatgtcccaaggaccacaaagatggaatctccaccctagagcccacctgagagggagtgactactcaaagcctctttacgagcaaaactgtggctcctaagtacctggccaagtcaaccacagtcctccaggatcttgttttgaattttaaagctgctctctcttgggcccactccatattactaccacggagagggtagctaggccatagtgcttctgtgaaggaggaagagccccttcaaactccagtcctttacctcaacaggcttagctatagggatgtctcctcaggcttgtgtttgtatcttcagataatttccatgggatattggtcttgattattttattttatgttatatagtcaaaaggctgataattgcttggtctcaataataagacattgcctcctcactgaaatattaatcagaatggtaggtggctgctatctctgtagagtaccaatcaacttaatctcatttggataaattttgaaaatgaaggaaagaaatgtggctacaaacaccatgttttattttttagcacctggaatcccactccaaaggagataaatttatttcactaaccttagcaaacaaatcaaatttacccactaactccacctatgcccaccctgcctaggagttcacacttgttcaatcattccattccattgcagcccaggtgaaaaaggctggttgaatttgagatgtgacctttgcttaaatttcatccccaaagtgtgcccctcagaatgtcacattcttttggtaaatagccctttcaaagtgaagacacaattatttcatgttatttatatgcttgaaatgcagaccttctgtttttcaaatccacaaaagcaatgatttaattttcagtagttaggaagtacttgggtcaaattttagccaccttgcttcaggataaatattactatcatttgcttttttctctctctcttttttttttaaacaatgtcttttttatgaacttgagagggctggtgatgattttgttttgttttgatttattttccccaaagtagagaaaacaagatctcctgttttacattttactttttattttacttaccaagcaggaatttgtcggtctgttgtctcacctactaacatctgtgtatcctggcattgaagattgggaatcacaagctctttaaaaggctgacacagatgggcagagatttagcatcctaattttaaaagtatatatatatatgtgtgtgtgtgtgtgtgtgtgtgtgtttgtgtgtgtgtgtgaaaaaaatagaaaatattcatatttaaaaatttagaattattagaatctttagtttcatggttagggatttgtatgaataatttttatttcaatatttacatatggcaagcattctataaacattccaaattttttgtacctgataagaaagaaaagaataaagcaatattaattgtggttggcttttgaatttccaaagtctttccttaacctttcagcatcagtagaattgtaaatcattgtcccaattaagttaacaataatttcgtttcttttcttttctttttttttttttttttttttttttgagatggagtctcgctctgtcacccaggctgcagtacagtggcgcgatcttggctcactgcaagctccgcctcctaggttcaggccattctcctgcctcagcttcccgagtagctgggactacaggcgcgtgccaccatgcctggctaattttctatatttttagtagaggcagggtttcaccgtgttagccaggatggtctccatctcctgacctcgtaatccaccctcctcggcctcccaaagtgctgggattacaggcgtgagccaccgtgccagtcaacaataatttcttaaccattctgtacaattcacatagcatgaggaatatgagatcaatatcccaaagtgaacatgatttttaaaaaatccattctttattaatattcacttggtatatatttaatcactgactcattagtcaagaagtatctgtagtgagaaaaatgtttagctttaaatactggtttcatgtgggaaaaagttaatatataaacatatagtcagtatatactttatttactaagaaaacacaattttgctgaattttccatctgattataatgacacatctagatattttaataataaagctacagcaaatacttgagggtctttgaaaggagaaagcaggttctatatttcaaaagtagcttggatataaactgcaaaattatttctgcagatgggcttgtttccccttttgttttatcaactttagatatttatgtcttaaaattaactaaagcaggacacagaaataaccctcttctccatttaaatatatattttttcatttgggttctagattctcaaatgattacacatatacattgttaaaagcttatgagatacattaaatctagattaaaatgataatatacttttacagagacatttcctgtagtacttacagcagagtcgtggatcaactcatctattcctaattattatgtagatattaggatatgagcatgagctcaagtactagtatttattttatgatatactggcagaaatcagagctgttgaatatgtttacttgttatctttttcattaagtttccaatatataaaactaggcattatctttctcataaataatatttgattaatttgttagtgattaaccatataccaaagggatatttgcatagaaatttttattccaaatctctccattgtagcttttaattacctctattaaggattatagtaatttaaaattattaaagatatctatgaattcttcaaactaaatcactgaaatgtcaatgcaagcttaatggttttgttgttgttgtttttggtaaagtagcatggtcttttagttaagaccagatagtaaatattttaggcttttctgaccataagatctcagtcacaactctgccatttgagtacaaaaacagtcatagacaatacacaaatgaatgtgcatggctggttccaataaaactttatttacaataacaggtgatgggctggatttggtccatggattatagtttgctgacccttgcttagaggataaatagctgtgtgcttgtagaaccaatctggtgagggaaacacttaagggaccatgttaattttaatgttgcacatatcctggttgctgttctctaggaaatagccatccctccagtcagataatgaaaatatgctggtgatttctcttctttctgcatggaaatcttcttaagggattttgagaattatccatcaagtgagacctatcagtgctcagtgcaaccctggtggaaaatataaattagttattcctactatttctataagtaggccctccagtcattgtgatagttgggccaatctttgttaagaacatgttgttgttgttgttgttgttgttgttgtttgtaagcatactttgaaaatgacctgccatgtaagtgtcaagaatagttaactcaagatggaatcatgattgacctgtagagtgtgatgggcctcaggaagcatgccctggtagttctgtgagttctcactagggagagacattttattatgttcttcatgccataggtactatggtctaagcaagtgtacaatgaataagtcaatgaattaatcaatggaaaattatagtctatagtgagctttgaattgtaggaggtaaacctatagcacattgtcacttcaaactcaacatccagttttacaatgactaagtagagattttctagtaagaaaattatccaagtttctgatatcacttttattctttcactggtgactctacccagagagaaagaacatgggtcctacattaggactgacatcagaggaaagagaaatgtttatagccagaagggaccttgaagatgaggaagagaataacaattttgatgactgcaacaatgatgttgacgctataggtttaaatagtaagttgttatttacaaaatgctgtttcagtcctatcactttccatgagttaaaacgaaggtttagattatgtgacttttgaaaggctaaaataaagtaagtgaaactggaatacttggaattctgctacctgatacccaattaggaaaaagagaaggcaaagtttaaaacaaggtctaggttgatgagttggtctattaaacttttctatttttctaatattcattctctttcttctggtaattctgggttttagaagagtatatacaattgaattgcttctgactgctgctattgacgcatgctaactaaaggaggcagcctcagcccagggaatttaatccagtcaagtgataattaagcatctatgaattggcattaattgccaacttttggcccttcctgtagatctgtccaaaccttgattgtaattcctgcatgtactgacaacttgatagtttagcatatcccagtgtccatttttaaggcactatccaaaatatatctctgctcattaccctttgatatttatctaaacaagtaacttctgatgttaagctttgagtaaaacgggggaaatggcagggaagaactgggcagagaaaacgggggaggaattcaaactacacttgataactgtgatgatgacaatttcagctaccaccagttttgaacatttacaatgagggaagatagtactgttttatatttattatttcatttaatcttcacatcattcctctgagataattgttattctttgtatctcatatataagaaaactgagttttagagggatcaatacattgtgtaaggtcacaaaggtatgagtgatgagggcaaggtttgacctcagctctgtggcttctaaagagtatcctgttgagcactaagcaatgttatgtcataatagctgggctctaagtcatggctaactaggaaaacttggagacccttgttactcaaagtgctgtcctcagcccaacagtatcaggagccccattccagacctgctgaataggatctacattttcacagaagcccccagtgatacattaaagcacactaaaatttgaaaagcatggccctaggcttttcctagacaacccctgcccagtagtctgaaagtccgtagagatactttatcatcaggaaggggagtaggcaaaaaaacaaacaaacaaacaaacaaacaaaaaacctaccacaatgtcctgtaaaaagaaagctttctccagcttctgaaatgcacatgtagaattttacagaggggctcaagggacccgggagaatagtgattagagggtcattcaaactgggatacttttgaaagggaaaagatcactaggaataattaccctggcacattaggcatgaactggaactgcactaagcaaactgggacatatgggcacctaagtcttacttggtgagaatctaccaaaatatcaggattttttagactgtaaaacatgaaaccagagagacaggaaatttaaagtctacaaatttaaaagggtgacaattagttattgattaaattattttattccacaaatatttatcaagctctttccttctttgtcaggtactttataagctacagagatatgagatggacaagacacaatagaacttaacaggactaggtaataccctttaagcttgacaacagcaatattaggaaacataaaattagagttaacttcatggaagtcataaattgcaagcatcctggttctatttctatcctgtatcttaagaagtgatatagtctaatattttaattcatggaagatgaatccaaatgtgataattaaggcaggttgggaagttagaattggaggaggaataagaatgctattttagatgatagccaaaaccatgccctccctaatatgtcacggggatcttctgacagatatggaaccctgggccaaatgggccataatgaaaattagaacacatgtaagctttggagtttatcatcttttgtgtgttttagaaaagagtatttatcctagggctttgttcaccctgagctgtatcttgtaaatgaaaagtacaatgtgtgcatcttccatgccgaaaaataaacagcaaccttacccttttgtaaacagtaatgcaatatgctcaagcaagatttacagatgcatccgtttagataaacaacaagaatccttattaacaattagtcctcatgcaagacccacggcaatctgtgctacataggaaaactattttacgatcaccatgctttctccagtgcctaggacagagtctaatgcacagtatagatcagtcaaaacttgtgggtttagtaaatgagtcagacggcatttcagggatgctgaaagaggagaacagtgtagtccttcctgctttaattctttttgcagagtgcagaattggttgaaggcagttcacgtagatagttccaggtcagtgcaggaaaccaggaaggagagggcaagaattgaccttgttgctttgccaactgactcttctattctggttttgtttccttcatctggagaagcagatgtgcctgcctgatagggcggaagcctggaagtcccacaatctggaggtaacatcctggtctctcaaacttcctgggtgattcattagccagccacaagcacaagatctgtcacttccagaaacttagccccatcaatgttcttatgatatgagcttaagatccagaacaaataacaataattgggaaattttaaatgaccatattatttatatataatactttgtgaggttaaaacaagctcacttaaaactttaaatatcctttgttatagctagttccacatgaaagtactgggtcaatttgtccttgtagtcaaagattcatcacaaatgaaattcaagtatgggcagcacaggccccatttcctcccatctcagaggcaaaggcatctgtcatcctgtccaaatcccatgcagttctgcttcatcagggtcactccagatagcatcatgttaactcttccccagcttcaacttctacactctcagtcatcttgtcatgtcaaaacccttccttgagcaaacctcttctgaaagccatctcttttttgcaactaaatctctcataagaatagtttacactcaaagctagttcacatgctcatctatctactcctgaactctctgctatctggcttctaccccatcattcctttgagtcttctgtcttcagggttataggcaactttgctgcgaattcaggagagtgagtccttattgcatgttacctctggaacctctgaatccagctgttttttcctgacaacgtcttttcttcccttttccataactctattatttctcctcctacctctgggagtaatatgtcttgctctcctttgaaggcatgttattcctcacctgctccttaaacatacttccatcttaggcctcttctcctctcactgtagacacatttctttcacccttttatcaattctgtggcttaggctactactttgttttatgttcttccatgttgcaaggaacagagacacacttggttatttcaggtaggagatatccattgtaaagttacacaggaaagaacttaaaaggggaaaaacatcttagcccttgtgaaaactgaacaccaccccatgcaagactcaaaggaaactcatccctgtgcaaagtatgactctagtaacattcgacatttaccaggctgtagacttgatgctaactagctttctctctttctccccacctccctcacttacccacgtcgctctagtctactctcaaatacctttcgttgacttttcttctctttccctcatggcttctgctccttcatgacatctgatgtctcttggtttctgctatctctctatctacccataatttcttgatagatacaatttattctataacttaaaacattgcaataatttttatatttgctttccttctgctttcaatgccttctggaactaggtggaatctgaatgtatgtatgtataaacgaatgaatgaaatattgaatcagatctactaactttgtctttgtatcctcactggctgcccatgatgtcatagttgccagttaatgagtactatataactgccattatgccacttacacatttcttcaaccttcacacattcttaagaagagatggttttatggactgaatgtttgcgtcccaccaaaattcctatgttgaagcctagccctacagccagtgtgatgctatttgcaggtagggcctttggggagtgattaggtttagctgaattcatgagagtggggctcccatgatgggattagtgcccttataagaagaggaagagaccagaccttgctctttccctgccatgtgagaacacagtgagaaggtggctgtctgcaagccaggaggagatccctcatcagaactgaactctgctggcaccatgatctcagatgtccagcctccagaactgtgaaaagcaaatgatattttgttttggcagccaaggctgactaaaaccagtggtattcctctcccattttttaatgtataaaaaactatggctctcacagatgaaattgctttccttagatcacaatgcaagtggtaaggccaggaattggaaccccaatacctgaattattttatggttttctgcattcattttataaaacaataagccaaaagataaatgaacaattattttttaatgaacgtgaatatgacgtatttaatgaattttatctttttgttctgcttttctattttggtctacatgacaataacacatcactataggcatatacgttacttaatattgctaaggcattaatcaagatatattttgataatagtgattaaaataagaattgattgatcttctatgtctctagaatttttagcttgtgaaaatacaaaccaagagggagaaatgactgtctttaaatttgtaaggcctactggataggtcgaatgaatttgaagacatttgtctgcaagtaacagaagactccccctccattggaaataaacagtaatgaaatttccatctaagatgacaagaagtccagcatggcctacgatctgggtaccatacagaatgtcaggatgttgggtccttctctctgcaggctctgtcctgctctgtgtattgttggctttgctctcaggctggtaccaagatggctgcatcagtttcagacatcacattgagatgtgacactgatcagagggagaagtacagtttatctctttttgtttctctttcatagcaggagactttcccggaagcttcatatttcataggcgggaattgggccacatgctgtgacaatgactactagttgtctccccttctccttgcatttcccccaccttcctttcactacctcctgtatagctaactgtcatcatgtgactaagtcccctgcagtaagggcttcctgttggctgaagttgtccagggctcctagcagcagtgccggacctgagacagcacagcaaaatggcagaaaagtaagctagttgagagcctcatccctgatgcatctatctactcctgaacagggtgccccctgttgcctaacacctgtcttcttttctccagtatataaaatataattccccagggaattatatttgcatcttatttaagaccactgttatttttatttcttgctcttttttgtagttatgcaaccaaacttaatctgatatgcatttcccttcttaaaacattcctggcaaatggaatagtgtaaccacaagggaccaaacataatgaggatctatctttggagccgggatgggtcatctacccttggtcacgtggcggaaggttgaatagccaaataacattagacctctctttggaagaaggagggaaggggaaatcactgttgggtaggcaactaactgaggctgctaataaagttaattaagttttccaaggtcacatggctaattattggtggaaaagtaatttctttttttttttttttaacatttttagtttcaaaggtacatgtgcaggtttgttatataggtaaattgcatgttgtggggctgtggtgtagagattatttcatcaaccatgtagtaaacatagtactcaataggtagtttttcgatcctcactctcctcccaccctccaccctcaagtaggccctggtgtctgttgttcccttctttgtatccatgtgtactaaatgtttaactcccacttacaagtgagaacatgcagtatatggttttctgttcctatgttcctccacttatgataatggcctctagttccatccgtgttgctgcaaagaatgtgatcttgttcctttttatggctgcatagtattccatggaatatatgtaccacattttctttatccagtctactgttgatgtgcatttaggttgattccatgtctttggaatattatggatagtgctgtgataaacatacatgtgcatgtgtctttatgatagaacaatttatattcctttgagtatatacccaataatgggattgttgggctgaatggtagttctgttttaaatgctttgagaaattgccaatctgctttttacagtggctgaattaatttacattcagaaaagtaatttcgacttaggttgtctaaaagcaagttcagtggacttctgtctataagataagcttagtcaatgatttgtcattgatattataacagaaattcatacacagctgggagatgacacctagctgttaaacatttattgcttcatcaattccctcttactaagatacaaatgtgagcagttacctctacattgctgagaatcatatgcatacaggtcaatgttatactcatatggaaagaagcagaccgcgcagaccacctcaaagttatatatttggccatgggcaataaggtgagaaaaatctgctttgctaatgttgttggcctgagctaaatattgaaatagcatccagttactcagcatgtgaaccaggcagtggggagtcacgcaaactgggactgttttgtgtggtggaacagaggtgatccaaatgtgtgtttgtgtgctttttagagtttgaggccaatttaaaaaatagtctgcactgcaccatgcacgtgggtttctttgtcaacaccatctgggtgctgactctagaagtttcacttcccttagcatactgtggctccattaggagatggggcacagcactttgatttcaaaggtggttggcctcattagctatttgtggaacttagtaaccagcagaaatgatgctgttggaaaaatcctctaccttaactttaattcatatggttttattttttttcttctgcttttgaggggctttcaaatgaagtatcagaaggaaacagtgctttttatatgcgcatgtgtgtagtttttttcttagtcaactgaaaagatagaaaaaacattctgtgtttgtggacagtattcatataaaattcaaaggcaaattttatctatgtgaccgataaacaaattactaatgcctgttaatcccagtgaattttacaaaatgatttgactggtgccgaaggaggcaggagaaagacagcaaatctgaactctataaaatccctcaaggagtaccttcttagaagacaagggaggaaatactttttttcaaatgggaagcaaatcacaatatagaattacagtgtttattattattattattattattatactttaagttttagggtacatatgcacaatgtgcaggttagttacatatgtatacatgtgccatgctggtgtgctgcacccattaactcgtcatttagcattaggtatatctcctaatgctaaccctccccccttccgccaccccacaacagtccccagagtgtgatgttccccttcctgtgtccatgtgttttcgttgttcagttcccatctatgagtgagaacttgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatccttgttggacatttgggttggttccaagactttgctattgtgaatagtgctgcaataaacatacgtgtgcatgtgtctttataacagcatgatttatagtcctttgggtatatacccagtaatgggatggctgggtcaaatggtgtttctagttctagatccctgaggaatcgccacactgacttccacaagggttgaactagtttgcagtcccaccaacagtgtaaaagtgttcctatttctccacatcctctccagcacctgttgtttcctgactttttaatgattgccattgtaactggtgtgagatggtatctcattgtggttttgatttgcatttctctgatggccagtgatgatgagcattttgtcgtgtgtcttttggctgcataaatgtcttcttttgagaagtgtctgttcatatccttcgcccactttttgatggggttggtcgtttttttcttgtaaatttgtttgtgttcattgtagattctggatattagccctttgtgagatgagtaggttgcaaaaattttctcctattttgtaggttgcctattcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatgcagtttcagctttctacatatggctagccagttttcccagcaccatttattaaatagggactcctttccccattgcttgtttttctcaggtttgtcaaagatcagatagttgtagatatgcggcgttatttctgagggctctgttctattccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacggtattgattcttcctacccatgagcatggaatgttcttccatttctttgtatcctcttttatttcattgagcagtggtttgtagttctccttgaagaggtcctccacgtcccttgtaagttggattcctaagtattttattctctttgaagcagttgtgaatgggagttcactcatgatttggctctctctctgttattggtgtataagaatgcttgtgatttttgtacattcattttgtatcctgagactttgctgaggttgcttatcagcttaaggagattttgggctgagacaatggggttttctagatatacaatcgtgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgagatacgtcccatcaatacctaatttattgagagtttttggcatgaggggttgttgaattttgtcaaaggccttttctgcatctattgagataatcatgtggtttttgtctttggttctgtttatatgctggattacatttattgatttgcatatattgaaccagccttgcatcccaggaatgaagcccacttgatcatggtggataagctttttgatgtgctgctagattcggtttgccagtattttattgaggatttttgcatcaatgttcatcagggatattggtctaaaattctctttgttggttgtgtctctgcccggctttggtatcaggatgatgctggcctcataaaatgagttagggaggattccctctttttgtattgattggaatagtttcagaaggaatggtactggttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgttgaggaatttatcgatttcttctagattttccagtttatttgcgtagatgtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcgaaaaaccagctcctggattcattaattttttgaagggttttttgtgtctctatttccttcagttctgctctgattttagttatttcttgccttctgctagcttttgaatgtgtttgctctggcttaataatgcttgtgcaaagatgattaggaattttgaatacattggaatatggtgataggaggtttggtactgatacacatttttagcaagccttttattataggctaaataagatttagaagttgtattgataatacatatgagcaagactgtttggttacctttaatcttcctttaagtgccacttacagaattaatttgtttattaaacataatgtcctcttattatctaacaaagtttcttatcctgaaaatctgaataattgtgtgttcctgaatataaaaatgtttacatggaaaaacttgtttgtttttggtgtcactaattcagattgatccgtttgtctcatataagatgggtttggcactaccagattttacagtgagcagaaaatgtttctgtacagattcataccatcagctctcagaggacttgacattcacacaaggaagaaattatttgtaatacctagtacctgaggtgtttgctttataaggagatgccataacagataatattataacaaagagttattaatgaatggggaatttacccatttttttacatacagaattcttctaaatcaagctgaatttatttttaaggagataagtgcttaggatttaactttctttaggactttgcattaaaatgtttctagacatgggtggaggacctttatgaagataaaatggaataaaatataccaaaccaatttttctattataaaaaggcaggaagtcactaaatcataaaagaatttacagaagaattgagaccactcatagctacctgaggaaaacaattaagatatagttaaggccgggcacggtggctcacgcctgtaatcccagcactttgggtggccaaggtggacggatcacctgaagttgggagttcgagactgtcctgaccaacatggagaaaccccacctctactaaaaaatacaaaaaattagctgggtgtggtggcgtatgcctgtaatcccagctactcgggaggctgaggcaggagaatcacttgaacccaggaggcagaggtagcggtgagctgagatcacgccatcgcattccagcctaggcaacaagagtaaaactctgtcaaaaaaaaaaaaagaaagaaagaaagaaagaaagaaagaaagaaagaaagaaagaaagaaagaaagatacagttaaaacgtagaactaccatatgacgcagaaactccactcttggttatctacctaagagaaatgaacatatatgtctacatggaaacatgtacatgaatgttcagagcagtgttatttataatagctaagaattgaaaacaatccaaatgttcatcaacaaataaacaaatgtgatatatcaatacagaagaatatatttagccacaaaagggatgattcctgcgacaacacatgcaaacctcgaaaatgttatgctaagtaaagaatccagacccaaaaggctacatattgtatgactggatatatatgaaatgtccagaacaggcaaatccacagaggcagaaagtagattcatggttgctaggggttgagggagagggatgtgaggagtaactgttaatgggtatggatttctttttaaggtgatgaaaatgctccaaagttgattgtggtaatggttgcatgactctgaatatactaaaacttactggattgtacactttaaagtggtaaattttatagtatgtgaattatatctcaattttaaagaaagatataattaagactcaagttcgagaaaaagcagacctgactagtagttctagcttttctatccacacaacagatatttattaagtaaatcgctatatccctagtgtactgctgttcatgacttgtaggatacccaagataatttctgggttttaaaagacttattagcatgggggtgatgtcatctctcacaaaggcagaatctttgcagctggccagagagaccccatatccaaaaagtaatgcagctttgggggaagaaaggagaaaaaagtactacatctgtttgaatacaatggatagagttaggagtctgattaactgacccaaacacataaaatttggagaacaataaagccatgagccaaatcataagagtgtaggatgtaagtttccctaaccccatccctcatctaacttaaaaagagaaaacattttccatcaactgagtgggaaaaaagccaggaatctccatgaatcaggaccccctggatttcttccatcctcattgctttggaagtgattaagtccaatgatgagccagtgtctataaagaattatgctttgtgtatgagcctgtcattttgaaattatattataaaaggtaaataaaggaaaatgacttcccaattcaatgcagtttggggtcggtccataagcacaataccattgtaattaaaatctaaaatgaaatactcagagacaacaggatcaaaagccgtggcatttcaaattgacctgaactatcacttactggcaggtaatatggctgtgatgaaattcctcagcaagaaaaggtttcaatggattaaggagaggtacaggctcgggtagtattatgtgtgtagccaacatagcaacaaggaggtaaagaggatatttgaaaatgcactccctccattaattatgctctacaataatattctaaccttgctttaacactgtagcatcattttcctcatttctgggtccaggcaatatggatattttgtgttaaatatgaaataaattctcaattttctttagtataatttaatacataaatggatgtaattcttctagaaagttttgttagatattaaggtacatatatcaaaacataatgtatgctatatattttatattatatcaaaatatgttaaatcactatagtgttgaagcacagtctaacaatattctttaatgtcccatcagacattaaaaagtatattttaaaaagacaaattttaaaaattaacagtgatcaagagatttaagaaaaaaacccacattgacatactactgtgatatttttctcaaaaaaacagcaaaaatgtttatatcaccttgatgtcaaagtacttcaacttaggttgaggtcatatatcctagtgaaagtagtcaaggaaatagtcatcttgccaaacaagtttctttttgtttttgttttgtttgtgtgtttgttattttgctttaagttctgggatacatgtgcagaatgtgcaggtttgttacataggtacacatgtgccatggtggtttgctgcatctaccaacctgtcatctaggttttaagccccacgtgcattaggtatttgtcctaatgctctccctccccttgtcccccacccccaacaggccccggtgtgtgatgttcccctccctgtgtccatgtgttctctttgttcaactcccacttatgagtgagaacatgtggtgtgtcaaactagtttctactgttgactaatcattcctcattctttagcctgaactccctggagcaaaagtagaaagttaataaagctgctgcctagtgcctaaggtgtcatgaggactgtgaaaaagaataaaacatcattccagcatggggagggaatggattagaccatagggcacttgggcagctatctttgactcagttgtcattagaataggactagcattgagtaaaattccaaagtttggtttgagcctttattaattaattagtatgaattcatttatcatgggaactatgctacctgctacactcttcagctacccaaagccagccgtaaactgctctttccccatttccagccatccccttctcctctaacgaagccctccctcttcctcatatcactcattgacactttacacaggagaactgaattacagttgtggcaccctaacggtcatatgtttggccactcacccaaaacaggattcctttttaccacattcagaatggataatcagatggttatctgcatgaacctttaagtattaagaatccccttacccttaagtcacttatccttgggtgaatgttttctttagatatagtctccttgaaggaggcccaggcctacttcctgaaattctcattctgtcatttgaaatctgctctcttgaaagataggccagatctactacttcaccattcaaatattttaggtcagcatttctattactgcacagcctttgcaacttcagtctcaacatcagtttctttcatggatttcaaaggtttgtcaaatgaccaagctttcaccatcttcccctctctagcctcactaccctcttcagaacttgctggatgcctcaatgtctttcaaaggcgtatcctccagaccagagtttagtgctccatgtgtgctctggctggggtggaatccattgcgtggtcacttttctcttttcttgagttggattccaaagtttttttcatgcagctcaagtttccattgcctggtgtaatgcttttgtcagacttggagttcatttgagcttatcggacaattgttggctcattagaaatcctacctcttccttttcacagaattaaactcaagttgcctctctctgtctaattaattgttacaatttaaatgcaaatttctaatttcttgaatttttaaagtatcatcctaaccttttaatctaattaaattattatatataaattacaattgtattttaaaaccccaattctctcttctattatattatgcattcttcctagcttagttgtctagtaaaaatttgataatcactgcccatgcttttatgtaagtttctgatgaagatgttaaacaagatgggaccaggtacctgtggtggtagatttgcctactttgttaattagtacctgatatgcatagttcttcagtccatctgtatgtacagctgtatttgctacattttactgtctgatccacaaagtttccggaaaaatttgtccagcatgctgctgaaatcagtaatttatctaaatcttttggagtcagattccatggtaatggaagaaaagtggatatatggtttgtggggaaaatatgtggagactgatgaactctcaggggatccttctacatagagaactatgtattattgtgtttacctttcagtttattctatcatggatggtactcctgtcctaactaaaattttataatcagtagtcctcatttcacaataaatgatgacaatgatggtggtgatgatagtggtggtggtgatcatggttataatgattatgatgatgctgatgaacatatatatatatatatatatatatatatagagagagagagagagagagagagagagagagaaagagagagagagagagagagagagagagctctttccatgtgccaggtactacataagtgctttatactttttatctcatgtaatcattgcaacaaacttgtaggctaggtgttgctcactgaccctaactagtttagacattcacaactggtaggttctctttggcagataatggaaacactggagaagtgacaagtggtaaaagttaactgctgtactaccatgtcactaccaggttgtatgaaagagcaaattcttctacataaccatttaatagccagcaggcaccaaaaatccagcctgttttggtagcttggagataatcaatttatctgtctttttgggctttctaagcatttctttgcatgaaaagtttgcctgatgtagtcacaaacgattgttagctcattaaaaatcctaggcagtgacttttctagaatatggcttcacccactctatgagtacaccctttccaatgatgaggtcaaggaaaatgatcagaaagtacagagaggaggcagaacaattagggaagagagaactaaaatagaagtgacgggtcagacaaaaattcatttgggctacttgccacatctctaatttcaaactccttatcctaaatcgggtttgtttaactctcaagaaataggtgtggcccttgggacaagttggctcagattgacatactaccatgcatacacacacacacacacacacacacacacacacacacacacacacacactataagcaatactgttgcctgagacaggttgtttctgattaaataaggacaccctagcaaatagctcaatactaaagacttctaagcactggccaagttcagtaaatgtcctgaaaggaagaagtttagttctcagggtgacttgaaattagaactttttttgctgtttttgttttaaaatgctttgcctgggagagagcactatgtggaattaatatccccttctgtctccacagcaccacactagtcagcctaacttagagagggaaattctttgttgccttttttccaaatacctgttaaagaacttttgctggggcttacctctgtgtgttgatcaaactgaaaattttccaaggatctgaggcttctctggagggtaggttggcattaagatttcttcaatagtgcaaaggatgttgtttttcacaaccaacacagatgtgcatgcttacaatttaccttcagtctggaaacatgttagtgaggcatgaatttctaattggctacccacagatggatacggtactaagtatgcttgaactgaatcatataatttgaaggcatttctaaaggtcagttgacatatattgtataaaaaagaaagattatatatatgtgcatatgcatatatatgtagtatatatacctatacatagtatgtatacatcaatccaggtgaacagagtgtatatgcataatatatagtctacatatgtgtgtatccatatattatattccaactaaaatatcattctcaggcatttaagaaacctgctcttacctcatttcagattccccatgggtactggaatattttatccttggggatgattaagtaagagagatacaacaccaaagctgacttatcattagtgactcagtactggagaattgagaattattcagatgtgccgaaatctctcttctgaccccctacatggaggacaagtcactacactgaagttggcccttgtctgtccccttgtcctttggttaagaactttgatcaactgacttaaggcctcagatatgggagatcctctactttttcatgccctaatttggtcctcagtggtttctgtgctgtctttaagtagataagggaggccctacttcttactggtaaataaactgaagatataccaaaggtacctgcttcagcatgaccattgccttatttggaccagttaacagtgtgtacttaaggctcccaggcagtgaatatctttcatctcctagcagattacaatctgctactataataactccccatctctgttgcattgttagctgtctttgtgtgtgtgttgtgtgggtaaactatttgatcttgtatttcatcaacttttaccaaactacctctttgctattgatgagaacagtaacctttctacacgtaagttccacttattcaagaggactattaagtgatcatgtctctcagttgattagaacatggtgttactgaggtataatttatttttgtagtcgttttattaatgacaacagtaaaatatacacattacttgccatggaacagatcacatgctgagtgttggacttgccttatgtttctctgtgtaagagttgactccaatgatcactcaagtatttccagaagggaaaggtgagaagtgattggtcaatgcctaaggctctcacaacttgtggtctacaaccctgtttgacagtgagctgtttgggcctcggtaggaattttcccacagaaaggatgttctcactggcaggctcccaggaccgcccagaaatccatttaaccataacagagctgacagcactgtcaggactggagttggcttccaagtgggaagtcagcctagtattaatagcacagttccagctgcactgtgggtccagcagacttctgacggtccggcctgggaaccaaggcactctttgtaacatttatgggaaatggagtcctcgttgagaatggtgggaagacagtactgaggcggtacaaggcccatggcttctcacttcccctttctactctaatcacttccaacgccactatccagcaggacgagatggaggggaatcctagaggaatccttctctagccttcaagtctggggagagcctgccctgttcctggcctggctcacttgggtcgactgttctcatgtacaggatatttgtaagttgggtgtttctaggtcacgtgtatttagttatatgatatgaatgtttattttaatatagtagctcttgatccaggcacaaatatattagaatgtaaagttcatttttatttttaaaagatttttcttcattttgactaatttcagttctgattatgatctcctgcttctttaccagtttaaaggcatcatttttatgtaaataaaatgggtgtgcatgattgtagtaaaacattccgttttgtggttacaggaggaaatgagagaagtgggtggtgcactgtgtatgcatgcgtgtgtgtgtgtgtgtgtgtgtgtgtgtgtgtgtgtgtgtaatttgaatatgacctaaaggatgggggtgtttgttaccccaagacatacttcaaggaattaaaaattgtgttgtactaaagggaagtctttttcactaataacttagaagtattgcagaccatttaggtttttttgttggtcagaagtattatagttaacagatttttttcccccgggagctctttgaatacataatttctttaaaaagatttttaaagactgaccagcaacctgaaaattattttctgctaatcccaagtaaatgtctctgtaatgtaagtgctgctttaaagttatcttatggggtacatatgacccaaagggaaaataacttgtttattaagttgattttctttcttttttcatgattcacaaattgtcaaattcattctgtttgggacagtagaaatgtggaaacatgtaagtgagtaacaattttaaagtgtaaatcaactaaaatgtatatgaaaccctgctgggttcttaggcagtctcttgatatttctaagctacacttctctcttctaggattctgttttgggacatagtcataaacacaaaaggaagatttcagcaccaaattatattcatctttaaaatattggggcccttcagccccttccaaacactggaaaactctctggagtttggtttgccaagacatgggaaactttttttccgaatatttttaagggaaaattatattttagggttatgaatgtagaattataacacagataatttaataagcctctatagctaagtctaggttctctttaaaagatcttgttttttcacccagccccatagttacatatttgagggagtgaaactgagcatacaggatttttggagtggcaggtccatttgaaatcattctcgtccaatgttttcattttctagaaaagggaactggagcccagaggggttaagtgacttgagcaggctactgttggtgatggcaatagtaggagtggccatcatttactgaagatcttctttttctgggtttccttacgttttattttaccctcacaaccaccttgtaaggcagggggccatattccagttttataagtgagaaatctgaagtttgggaagtcctctagctgctcaaagtcaacaggtactaagaggcagagcaagaatccactgattctggatgcctggtggcttctgcctcagggtgttttccattgtaccagacatttcccaggcctaagtagaaatacaagaagcattccttctttatacatgtttacttctaatatatcaagagcatctgtatctaagcaatcaccctggttactcaatcttttggatagtagtctggggtattgggtctccttaccttagtttttctgacaaaaaataatcttcctcctactggatttcataatattccaaaatttgtcttcagtggatgcctcaacatatactttgaaatgtctattttatttagatctgaagaagagtattctttttttttgctctcattcagtgattcattcatttatttattcagtaagtatgttttgaatgcctactatgtgcagatgctattctaggctttggagatacagttctggacagaacagacacaaacccctgccctgatggtactttatttctagagggccaaaggatggccaatacatacacggtaaaaaataaggtaagtgagatggtgataaatacactagaaacaaaaaacaaagaaatttgtttaatgagtggaaggagacaccaggaagatggggtaggacttactcaaaaataactgagaggggaaattggggagtgcttcttatcacattgtcaattcagcaaaaaatgccagtgtctattttgttcagcaaattcctttccaaaaatataagttttcaatcccccaccaatagtaaaatgcttatcctaactctgtctctatccttatgatatcttcccatccaccctttatggaacccattgttatcactattataccaaaaaaaaaaaaaaacaggaataacaggagttatccacatatctaagggtaatacaatttgagagtaagagaagcttagtgcctggcctatttttcccaaacatctaatttatggaggagaatcttgaatctcagaaatattgaaatgttgggaggctggggcaggagagttgcttgagcccaggagtttgagaccagcctgggcaacatagtgagaccctgtctcttaaaaaaaactttttttaattagtaggtgtggtgcccacctggagtcctagcagtttgggaggctgaggcgggagaatcgcttaagcctaggaggtcgaggcttcagtgagccaagatcacattgctgcattccagcctgggtaacagagggagtccccgtctcaaaacaaaacaaaacagaaaaataaatgttcaaatgactaaatgacgacctcagatcaaatggcaaggtgcttattattttatttccagtaaatgatgtgctgagttcccatggtgagctaagtgattgagctggatccaggggcctcagcactgacttcagaggagatggtctgtggcctggaggcacagagaaagaactgatacagacaaagacttctgatcccaacccagtgctccttcccctatcccatgatggggactctttgctgttttccagggtctcacaacggtgagaatggggttcccttttacatttgtacttcccactctgtacttcacgtatgtcataggttaaatgagactacttgagctgacctacgaaccaaaaccactgtatctttatttctatgggaaaatgcatgtggactttgaaatatccagctatcttaacagactttcagaattgaggagtgtctgagttggaaaatataagcaaagatcatttagtgttcagtgaggcaaactctagctgcccagcctctaagatactgactatctcctagagaaaacacaatcctctgcagtcctgaaggaagcatcagatgagatacaaataagtagtaacagtttcttccaaattgtatggggaaagttttcttctcttcactatgaagaaaacctgatgatcataaatagtgaccattttttccacaaagtggcaatttgtgagtgtgtataccagccattctgtagtttgtcatagttcctagggctatggggacctatcacaggattgtagctcatttaatctggattcactactttgtgggctggacttatgtttctattaatggtagtagccagtatagtgtcccaaatgcatgttgaatggcgtggagtggaaggacatgttctcttagctattctgtatgctagcaagtgtcattttcctgtctgccttccataatgggaatgccatggacatttcagttcgtgttctacattcctatcatcacctgattgattggaatgatattgctatataataaggatttcgaacatacataagcattctgaggaaacatgaggttagattgaactgcagtggatgctctaccacagttcaagggcaagattattacagttgccttgacaaccatagctctgcactctctgttttattacatactcttttcctatttgggaatccttttgagaagaaacaaaagaaagaatgtcagtaaggtctcattttcaatttatgaggcttctggaaataatagagtcttatatagctacaaaaacgtctccatttcttaaaatttccccaaacattggaaagtccaggcatatgaaatgaactaaaaataagcttttacttatgtcaaaacacaaatatcatctttactccctatagaagtaattattttgtaaggactgaaagaaaagattacttttctatttttctctagcgtacagctgtgacttctatttttctataaaagggaaatatttttgcctataaattttcattagtatttttacctgtattacagttattcaactgcaaataggtatataagtaaaatagtcttactctaggaaatggctaggttgagagactatcaaacagtgatattttaacaatgtgttacattattaattatcaacacatcctcttttaggtttcctttgtagagcacactagtttgtttgtttgtttgtttgtttgtttgtttgtttttcaagagaaaaggtgacaatatttgggtctttataattgttttttctgtattaaagcaaaaatgtagtataaatgtatactactgtgtgactataaaagtcattgagaaatattattttttattttgtccacttgttattaaatctttcttttcttttctttctctctttctttctttctttctttctttctttctttcttttctttcttcttgagacagggtctcactgtgtcacccaagctacagtgcagtggcatgatctcagcttactgaaacctccacctcctgggttcaagtgatcctcccacctcagcctccccagtagctggcactataggcacccaccagcatgcctggctaatttttgtagagacagagttttgccatgttacccaggctggtctcaaactcctgggctccagccatcctcccctctccgcctcccaaagtgctgggattacagtggctctatggaacaaattcatatgttaataccctaggatgggagttagggaacttttctgtaatgggacagatggtaagtatttcaggcttttgaggctatacagattttgtcacaactactcaactctgatgttgtagctgaaagaagccatagataatatgcaaacgaatggactgggctgtgttaaattaatactgtattcacagaaacagacagtggactggatttgtcccaggggctgtagtttgccaactcctactctgggagaaaaattgttttgcttacttatctgtccacagtctacaggggagtgtagtgcttcaggcaaattgcttcttttataatatatgcctaaactgagcatggtggtgcacgcctgtaatcccagctacttgagagactgaggtgggaggatcacttgtgccccaggagtttgtgtccagcctgggcagcatagagaaaccctcatctcttaaaaaaaaaaaatgtgcctaaaagtccatcttttcactctgacttttgtgtaaaatgtccccattgctaccatattggttctattagagagaaaggcaggggttacacacttttgcaactcattagggagagtagaagcagatattgataataatttccttgttttaaaagctgttagagcacatgaaaaaaaaattcaactactaagatttccttacaccctagctgaactgctcagttagaactgctcttgaatatcaaaggctaacgtgccctgcctgcgtaaggtggcaatataaactgaggtagacactgtgggatgcagccccttggcccccagctggcctccccatccccatggggtctacatagtcacctggcaccaagaaaaacgtgcttttttctttatttttctttgaagtattcactggtgctttgttcaaactgattttagcatcctctttgagtttgaatcagatacttcaaagaaaaatatagaaaaacgaaaacaagtatctatgtatttgttactcagatttagtaactgttaacatttgttcttatttgctttggatatttttatcttttttaaaataaagaatccctttcattgacacaattgtaacccaagaattttccccattctttctaaagaggctattgtcagaggaatctgaattattttccacttattaaaattggttattgagaggcaaaagaatagaaagaatattgattttatagtatatattcagagcatcactggtgcatagtatgaacgatttgatccaatttgtatggttttctgcccatcgaagactgaataatatcatgaatctactcccaagagagacatagagaatgcatcacatctctttcctattgggaatgggatatgaatctaaaagacagtaaatataaaccatcctaattcataatagagagctggatatatttttcaatttcaatggcaactttgaaaagtacattatttttctctgctgcctttaacatactaattgccttgtggtataaatgctttcataaatgctctctcatctgatcttgtgtgatagttacaatagatggtattacagctctctcccaggtaagggtatggatgcactgggatgtctgtacagtgtttggcagtcttggctggacctttgtatcacctaccgagctttgaaaagatactgattctgagcctatccacagaggttcaatccaaccagtctgagcaacagtattcttttcttttcttttctttcttttcttttttttttttttttttttttttttgtgatggagtttcactcttgttgcccagactggagtgcagtggtacagtctcggctcactgcaacctccgcctcctgggttcaagtgattctcctgcctcagcctcctgagtagctgggattacaggcacctgccaccaccatgcccagctaatttttgtatttttttagtagagatggggtttcaccatgttagccaggctggtcttgaactcctgacctgaggtgatctacccacctcggcctcccaaagtgttgtgattacaggcgtgagccactgcgcctggccgggcatcagtattaattgattctactgtactgctgaggttgagaacccccaatggaccgaccagtggttctcaagtagggactatttgcccccgcaaggggacatctgacaatgggacattttttattatcacaactgagaaggggcatcccctggcatctagtgggtagagaccagggatgctgccaaatatcctatagcacccctacaacatagaattatctggccccaaaggtcaataatgcttatattgagtaaccctgatttaagctggactaaagtccctctgactctaagccatattgtttccccagtctcaagttgctagattattcaaattagtcatcctcttattattgctgctaataaaatatattttaattaggttgttcttcaaaacaacatttacaatgactttttagtttatcaggaaccaagtgatcttgtgtcataaccatactgggataggcaaaaatccttatattaaacattttcaattacttttatcagaatacaaaacaagcaagcaaacacacaaaaaacaacacaccatcaaaaagaagaaaagagctatttctcaacataaattgctctgtatgtattatcccagatgagcaatgtgtattatataaagcagtggatttcaaacttgagagtgcattgaagtcacctagagggcttgttaaaatactgattgccggcctcatctccagagtgcctagtcagtaggtccggggtggggttcaaacagttgcattttgaataagtttccagctaagattgacatttctctcctagggactatactttgacaatcattaatgtaaagaatttctctatattagcatttcaaatgaatattaaccctggggaccatctattaaggcctcaagttaatattcctaaaagttaaaaatcattttatcatagtatacaaataacttaaaatatgattcatcaagaaatatagagggcttcctaattctatagttacaatcaggacagccctatagaatcaaaccttttgctcccacttctaagagcagcaagagctagcaacagcaagctttgcttaagaacaagcctagtagttttatgaatgcacagctctctacctgatcggaaatgaagggatgccagttcactgagacatttttaaacgcatctggtcaatgagaaagttgatattttctgtttcctgatgtgtatccttcaaattatacataagtgcttaagtgaaaatgacttgatccaaattcccttagctttggatacattaacatatgctcatggaagggtggatgggatatctaaaattttattgaagtgtattgcctctctataaaataacaaaaccttaactccttaagtaattaaaatatttggcagaagtggctaaataatgttagattcaagtatggaatctgaagcccatttcaggtatttcaagaacaagtcaattattcatccagtctatcagccaaagacacttgacagagagcagtgacatggtgttttgtaaaaggcatttccatagtactagtgctctcattttgttgtcatccagtagaaagaagtgtacacatttgtgaagaaatgcatgaggtaataaaactatttaaaaatccacattttctcaatttagatggacttttcttaaactagtataaagttaggtgttaccatatattttgtaggcataaaaatctaaacctcaaagtggcagaattcaagagtacccatcccttattttctacaggagttcatctgaatcccttgatagtaaagattttctttctttctagaacctgacataattcctagtacataccaagtgataatgacactttcattgaatttacttaaatagctatatgagaggtccatgtatttctatatttcatgaatttcaaattatatatttcagtcccatttaaagttaggatctttataaagaaaatcctgaagaggatccagactatagcgtccaatgtgcaaatttttaattgtgagctagagattgagaataaaggaaagttattggaaaattttccaagaactaagcctttctgttgtgctggtattgatgatatatgtgtcagtcagcaataagactaccaaaggtgaactaaataatccggtgccataaaatgtcttataaaacttaagctgctaagaaaatctaaggattaaaaaatgtacctattcgcatacttctgctgttgtgtgtttaagagcaaactgagaggttgctatggcattacttatgcgtgcatggcaacagagcgaacttagtgattcagcttgataaaagaggaaattagctcaccatttcccctttccccaaatcagagtcagatatccaaatatttcattttgaaatggtatatccatcaacacgttctaatggatgaaagtcagtgggggtgggggtgggggaaatgtcataaggtgaaattcgtatgtcatgtgcttactttagggaatgcaacttgtgtctaaacagtctattcatatctctgcatccttctttccccctgataggatggggtttctcagtggcatctgttgggtgaatatacgatgatgagtaacactttggcaaaagacagcaatttatcagcccgtataactttgttctaatggaagtggatcatcccagaatttgagaaagaaacattgttcagctgtgaaactccaattccctgtgtgtaacagccctccagggaaggagtagattttgtcagcataatatgtgaagtttagtcattatcaactgcacaaagcagaggtcaggcgtgggcgtacatgtgggaggcactattatgaaatcaacccacagccactgccctgctggggtgatccaatacaaacagagccaaatgtcatgaataaatgctgacattttatcacatgattagtttaaatattattttactactgtgctttttcttgtattatttatctttcacatctttattttgtttccggtttcctttctttaaactgataaatgaaaaatagggaagtatgttttgagtcagtactttgaccatgaacacaggaagttaactgaaccctccaccaccagaacaacaacaacaaaaaaactctaaacctgtgaatcttggaatcttagatttgttctgggttgacatgggttttggaatcataattttattaatttattttttaatttacatagagtaaaattgaccttctggagggtatggttctatcagttttgacaaatacataaagttgtgtagccaacatcacaattgtgatacagaagaattctatatataccaccccccacccccacccccaccaccaaatctcttccttctgccttttcgtagtcaacccctcttttcaccctcaggctctggcaaccattgatctgttggaactgtattaatctgaccgtttttctccactctgtccattcatgcaacaaccgtttattgataatctatgctgagctccattttaggtgctagggatgaaatggtgaacaagactgacatagaagtttctatctggaaacaagataatgaacagtagtaaatcagtaattccaaattgtggcaaatgctgtgtaaagaacagaaatatttctgtgacaacagatatctgaaggcgaaatctttttttttttttagacggagtctcactctttctcccaggctggagtgcagtggcgcgatctcggctcactgcaagctccgcttcccgggttcacgccattctcctgcctcagcctcccgagtagctgggactacaggcgcccgccactacgcccggctaattttttatatttttagtagagacggggtttcaccgtgttagccaggatggtctccatctcctgacctcatgatccacccgcctcggcctcccaaactgctgggattacaggcgcgagccactgcacccggccgaaatctattttagacactgttaagaaggttactctgagaaggcagcatgtaatctgaggactggaggaggagaagaagccagctgtgtgaggtgtgggtggggacacatggggtaatcattccaggcggagggaacagtatgtacaaaagagagttgggagtctagtgagtgaagggagcaatgccatgaggtgctgtagatagataggcagagcttcactaaggtgtatgtacttcattgcattgcagtgagaagccattgaattaggatggggctctaatggggatggtttgattgatgttttgagctctgtgtagaaaatctgtggtagaccagcaagaatggatacaggggaccagttgatttgcagccaccatccagttgactgttaatggaagattgggcttggcagcagctgtggagatggagaagggatggatttgaaatatattttagaagtataagcaacaggactaagtgtttaattagatatgggtaaggggctggtgaaggaaaagggggaatcagatgtgactctcaagagcttgcttgagcaactgggtgggtgatgctatttactaacatgagtaaaatattgagagagaaacaagtttgtattggaaaatttaaaagctggggctttggacaggctgaaatagagaaacccattagacatccgtttggagatgtgatgcccctagatggggatatgcatgtagaattcagaggagagctcagagctgaggagagagaaatttgtgtcatcatttaacttttaattattcattatatcataaatatacaatttaaatatattattatattttgatatattaacgttaatataaaatctgtattattaacaatttattcactgatatttattgagggcccaccatgagggagacttagtgaggaaatggaggtatgatggtgagtgcaagcctgtatgatctgagacaggctggcagtagtcacacagatatgtgtaaaatttaagggacctcagtaccacaaaggagagggttctatgaaagggcacgagagggagattcgactaaatctgggtggaggtgagggtcaggaaaggcttccctgcgcattaaagaatgaggaagtgggagaggatatcagattaaggaaagaacatggataaaagtcggtgtggtagaagaccagagattttggttctcagatgcactgtgattccaatttagatgtccagaagggcatcccaggaacatctcaagcacttcaggcaattcacattccttcagcaaatatttgttgagcacctggagtgtgcctgagattctttcaggtgttgggaattcagcaatttatgtgcaaaagttctttccctcatgaagcttgtttctttctggtggagctgattcaggaggttcacaaattccagacacatcttcagaaggattgactaagagatgttggcctgcaacagagccatgaggagtgccagcatttagagctctaaaggagcagaagcagcagcaaagaacctagagcaagtggctagtgaaggaaaaagagagaaaaggggtgcgtatagcaaaagctgggggaggtccagatggcaaaggtaatgaatggccagctaggtttagtggtgctgagggatcaggtagaataaaagcagaatagtcgcccctcagctttataacatggcagcattgggaatttttaccaaaccagttttatctgaatagtggaagtagaaaacagattgagttgcttgaaggagtgtctgggaagtgaaaactgacaaagtgagaagatattggcaattgagaagtgaaaaattgctgatgactttagagaagtttgccttcagttcgggacttcattattttcctgcaggaaagagtcttctgttagtggggagattaattaacttatttttgcccaacttgtctatctaaaaggaagaaagtagtaatacattaaaagattgagactgctgaggatgaaatggggtagtatatgcatgcagtggatgctcactaaaaataagagcttgcatttatagtattttaagtttgccagtctcactctacctgacataaattttcagtaattatcttattaaatgccaagtaagattcaaattattattaactgatactcaagggaggaaatagggtaagttaagcaaattgccctaataacgctgctcataagccatggccctcggagaatttgaatccatattttctgtggtttggacatggtttgtttgtccccatcaaatctcatgttgacatttgacggtcagcatggtgatatcggaggtggggcatagtgggagatgtctgggttacagggatggatccctcataaatggcttggtgctgttctcatggcagtgagggcattctcactcttgacactagattggttctcaggggaattgattagttcctgcaagagtgggttgctagaaagccaggacacccctgggtttggtccctctttgcacatgtctgcttcctctttgaccttctcagacatattttaatggaacacaaaagctctgctgaaatccaagcagatgccagtgccatctatcttgtaaagccagcagaactttgaaccaaaataaacctctgttgtttattaactacccagccttagctattcctttatagcaacacaaaatgaagtaagacaacatctgttgacttggttctatgctgtgtttgctccacttggtgttgtaattttattcccctataagaattgtatctgcttaagtggagactgagtattcatctactttgtatccccatacttaccattgcatttagcccagtgcctggcacaaagtttgcagttgtgagtggcactgatatgaaatttctcagcccttggcccagccttcttgggctgctcttgtttttgaagctccagtttatactcaggagaaatgctttggacttcagacctccaaactgattcatgttacacatatcatcagtggagaaagtgggacagagtaaagggtggagatagctcttgaacacgacagtagaaatggtatgatgttagcagaaaattaatatgtgcacatcttgttgtactgagaaatactctaacattataaggaaacaaataaaactgatcattgctaggtgacgtattatatatatagtatataatgtaaaaatacatatatagtgtatgttgtatataatgtaattgaatattatattgtatattatatgcaatgtacatctatatatctatagatatctacccttgtgtatttttttcctacaaaatgaaatactttcaccatcagagagtaccaagtaggaatattcccaggagggtctgagattgggatgcaatctcggaacccattaaagagcctggggacaggtgggctgtaggagtcctgtggagagcttaaaaggtgtctcttacctcttgaaagaaatgactgtgaggggtgaagtaaactgacccggtgtacgtctccctgggatatattacttactaacttttaggtcttacctaggacacgtatataggaaatgttcctgaatcatgcttggctgcattatttccctgtagtggcaaaagtggcctgcagaagctgtgcattctgggtccttgctagaacccagatgaatgttgcttgggaattggagaggaaaaaaggaaacagagcactcccaaattctttcccaaatctcttggatcgaaacatcttaaattgccatttttatatgtccaagatggtcaaatagtaaccatttcacgcagctcaaccaaaaagtatgatccagctactacagagatgtggacattggaaggccttcttgttggtttcaagtttggccaattggtagacatctggggctgtatattaaggcatcttgattttgtgagccagagcaaaggccttcttgttcctgtctctatttgaatagtatctttggtgagagagtgccagcgtcatctatttattatccttcatgctcagtgactatgtgaaaagaaaggaaaagacctttaaagctggggtgattgtctagacagtcctaaaatagctgctccaggtgcaaaggaagccataaaatgcagacaaagcatgagactcctttggcgaaaatacagtgtgtttgaactctcataggctccctgtaaattatgaagtagaaaatgcccaggagactagattccaataattatgatcattagttattttaaattgccaccacttacttcacacagaggcattctctgtgtgctaaattaaatttaaaatattttaaaaataattatttgaataattcagagctgaaatagtccaggttgaactatttagcaggctgaaacacctgtgcaagctttaattcaaaatatacagagaagtgacttcatttttcactccactgtggaggtcttctaatacaaaacaagaccttcagcaggagtccatgccccctggttctgcaccttcttgccttctactttgtcctgtgcctacccactgcactctcaaggtccaccatgacccggccctgctccactccagccgtgtcctctaggggatcgctgccaccttttacctaggcctccccaccatggcctctgccagagccagctccttgtgggcccatgtggaaatgagacctccagatcccatcctgggaaccaccaaagcctttaagagggaaatcaacagcaaaaagatgaatctgggagttggtgcctaccgggacaataagagacccagttagattaccataaaaaatttagacaacagcaaagacttggaaccaacccagatgtccatcaataatagactggataaagaaaatgtggcacatatacaccatgggatactatgcagccataaaaaagggtgagttcatgtcctttgcagggacatggatgaagctggaaaccatcattctcagcaaactatcacaagaacagaaaaccaaacagcgcatgttctcactcataagtgggagtttaacaatgagaacacatggacatagggaggggaatattacacaccggggcctgtcacggggttgggggctaggggagagaaaacattaggagaaatacctaatgtaggtgacgagttgatgggtacagaaaaccactatggcatgtgtatatccatgtaacaaaactgcacattttgcacatgtaccccagaacttaaaatataataaaaaaatttagacaaggaatacctgcccatttggggacaagctgaattttccaaggcatctgcagaaccagccttgggtgagaagagcaaagtgttgaaaagtggccagtctgtcactgtgtggatcatttctggaactggggtttaagggttggagccagttttgtgcaaagatttttaaagtttttgaagacagagatgtctctgtccaaaccaccctggggaaatcacacacctatcttcagggtagctggcatgcaactacaagattatcaattctataaccccaagacttgcagttttgacttcacgggtgctatggaggacatttcaaaaataccagagcaaagtgctcttctcctgcatgcctgggaccctcatgcaaagcagtgaaaggaaataataatagtggcaaagaaaaagaaactgcgttctttgatatggcctaccaaggctttgccagtggtgatggtaacaaggatgcctgggctgtgtgcaacttcattgaacagagcattaatgtttgtctctgtcaatcatgtgccaagaacatgggctttatatggtcagtgtatgagagccttcactgtgatctgcaaagacagtgaatgaaaccaaaagaggggagtcagttgaagatcctgatccatcccatgtattccaacccttctctcagtggggcctgtattgcctctaccattctgaacagcctgggtttgtgaaaataatggttgcaagaagtgaaaatcatggccaactgcattactagcatgcagactcagctgatctccaactgcagtaaggagagttcctcacacatctgacaacacatgactgactaaattggcatgctttgtttcacaaggctaaagcctgaacaggtggagaagctaaccaaggggttttccatctgtatgacaaaggatgactgcatccctgtggcagggatcacctccagcaacacgggtaatcttgcctatgccattcaccaggtcaccaagtaatgtccctggtgtgagggaacaggtacaacttttctgtcttcagctgctgctaccgtgagcttcacatggaggataagggagggtagatggtggtgagtagatctttttttttttttttaaccacagtgcgtaatactgagtgattgaatgcatttctcagaaaagaacatgtagcgacattgggcagaggcatctgtggctggtatctggaactttgtgactctaaaccaaactctcccccatctttttatctccaacttttccgaaagggtttacatgtgtgagaaactcatagcaccaaaaaacttgtcaattatgccactgcaatatttcagaagctttaactgaagcatcttacggtgtcaggggttcttcatgagaaatagcacacattagaggctttgagagaagacctagttctgtcattaacagtcagcctcaagtttgtcctcccatgatggagcaaccttatcaacagaccatatcgcagaagttgtgttttatgaaaaccaatgagtttgctgccactgcagcaaggaaaataaaaggtgctttttcctctcatttaagaaaaagaaaaggctatctcttctcctttttcatgctattcttttccttatgcacaaagatttttaactatcctagattttcatcccattctactgctggattgaccatctaccctgtattagtccattttcgtgctgctaataaaggcatactggagactgggtaatttataaaggaaagaggtttaattgactcatggttcagcatggttggggaggcctcaggaaacttacaatcatggtggaaggggaagtaaacaagtccttcttcacatggcaggagcaagaagacttgctgagcaaaaggggcaaaagccccttataaaaccatcagatctcgtgagaactcactatcacgagaacaacatgagggtaaccatcccattgactcagttacctcccaccgggtccctcccatgacatgtggggattatgggaactataattcaagctgagatttgggtgggaacacagccaaagtatatcaagccccatcctacttggatttatttaagaataaagaacataattttctaatgacgccatagccttactgttctcagtggagaaggtaactgcaatttatctgagcatcttcttcgatgattgtgtaattgtctcctgctggatgttgcctctgcccagttggacatcctcccttcattgaatatggaaagcagattagtggttgctagatttaagaagatgatgagttgagagggaggtgcaaatagctgtaaaggggtagcaagaggaatccttgtggcaatgaaactgttctgtgccctgactattgtggttgtcacacaaagatacatatgtgataaaattgcatataactaaatacacacacatacacacattcacacacaaatgataacatgtaaaacttgtgaattctaaataagatagttgaatcaatgtcagtttcctggctgtgacattatactatagtcatgaaagatgttacaactgggggaagctgggagaagagtataggagatggctctatattatttcttacaaatgaatgtgaatctaaaattatctcaaaataaaaaagtttagtctaaaatgcattcatcaacatgaacttgagtcaaaccatcttggaagagaggcactttgatgtattcacttcacaaagcatagggatgaagatctctggtagtaccagcaagccaaaacacatgactttctgctgtctgtaccctgtggccctgcactgtggataagggaatgtatgtgtcctctagaacatttttgttttgattgctttgtgtttgtttgcatcaagaaaaaagttgcaaattaatgagaatatatgtgtatatctctaagattcatcagcacccaaaataccagagcaagccagacgtcatagggaagccctgagcagaatctacaaaaaaggattgaataatttgattattcagagaaagcatatttctaggggatggatctaagagtagcttgatcatgaaaatggtgggaaaaatatagcggcaagagggtcactaggtggaagtaatatgtctagtttttttgagaaccacacttgagctaaacctttaaaatccaatcaaagaatgaaaatgaatagattagtgtgaggaggtaaacgtatcatttgaaaatagccttggacttgggtactttgctctcattgatttagcaatatgccccattttgttagttgtttatacagagcttcacagttttaaagtaagcatagccagttatgtctatgatttctctgtattcagttatatttgcccaggaaagtctaatcaacaaacagttatcagttatcttacccatgacaacattgtgagatgttgtgagatgccaagaatagaccacaagagcctctttgtgatggtctcagacctccaaaaccaataaagaagaataacacagtaaatcagtaacatatctatagcatttgaattcacatagagaatttgtttagtgggcctgactaaatgccttcactttgcagcttacaggggcttgtgtttattctgcctatcttaagcatggttttactcatttagtgggagcagttggctcatgtcttttacctatttcatttactaactctaagggagtcaagaagaaacttcccctttgcgctctaaagggtcactgaaaatatactggcatgaggcagattgattaacagaagaaaaggcatacacgtttatttaacttgtatacacagaaaccttcggaatgaatacctaacatacaggggaaaatggacagttgtccatttttatgcttaggttcaacaatatgtggacagccatgtagaaatgtgattggacagaaagggtctgatttaaatgctaatggactgagtaggggaaacccagtaaggcctgtccatctagattattcttggcctctctgagaagcatttcttccttcttgatgtgagagaggaccctgtctggaacaggagtcttaggatctacagtcaaaccagttaggtcagatcatttcttcatggccagtttttacgtagaatatttttaggttttatgactgactttcaggaaaaggggttctgatttgtatgatctatcttggggaaaagggattctagtttccatggctatccttagggcaaaatgggactgagaggaggacaggagaaggtcaggagaaacttttgcttctgaagctgctcagcagcagtcttcattttgagatactgttttctgagccccaacaaaattcttctaacatgctgaacatgtgccaggcactattctaacatccatgagaatagagaggaaaggaagagagggatcctgcagctttccagttgggtgctgagatgatgacaccattcactgggtgactccaattgatttgctaaatctattctctgcattttgactctgccaccttcttaccgtgggtctatgagcaagtttctccactgttctattaaatatctgtgaaatgggagcaatggtggtgttgtgatgattagatgagtaaacacatctagagcatagagctctatgcctggcacaaacgaagccctcagttaatatttgcgggatgtgtaaaagattgtgtttatctggttttcaagaccatcctcctcagagacgccaaggagatagttgctatgcttcctggcgttctaagacccacatgcatctcgttaacccttgagaaatctagtgggctctcagaatttttaaaattatatattaataaattataattgtatttatttggtgaaaagtgatgttatgaattttgaatacaatgtggaatgattaaatcgagctgattaacatatacatcccaaatatttaatctttttgtgattagaacatttgaaatttactctctgtaattatgaaatgtatggtactcagttattagctatattcaacatgctgtgcagcagatctcaaaaaaaactcaaatgtcttcctcgtttctgaggctttgcaccctttaaccccattgctgacatcccccagcctcaccagcttggtggaacaccttgagatgtgcttataacagtagctgggatgtagtcagtgctaaaaaattgttagcttttgctgttgtgcatgtagttgttgttgttattgtaaaatggtggctggaatccacttgcgaatatgcagtcatgttacaaatgaggatgtttctgtcaataatggaccacatagacaacagtggtctcataagattataataccatattgttactctacctttctatgtttagatatgtttagatacacaaatactattgtgttacacttacctacagtattcagtatagtaacatgctgtacaggtctgtattacaggagcaataggctgtaccatctagcctaggtgtgtagtaggtttgtgtaagtacatgctatgatgttcacttcgtggtccactaggtcactagtaagcctttctgtacctttttgtatgtaactctttgtatgtctgccacactgtatgataatgcttaggtgtttgtataaatacactctatgatgttcacaatgacagttttctcaggatatatcctcatcattgacacgtgattgtactttaacagagatacaattcttgaacatcttgttagaaggagatgggagaaataacagaaataaaggtagtgtcttgcatttttcaattattaaactaatcaattcattaaaacagctgtcattaattacttaaagtcaggcaggtgagggaaagaatggcttgacgttttctaatttatcactctttcctgttgcccctgactaaacaaactgtggctgctgctacagctaagtatgtcaaactgttgaatacccaagccaggcttttgaaatattgaaaaatgactactcccatgttgatccataaaatctttaccatcttacagagagctgatgaatcatctctctagcaccaggttcacgaacttcccataatgatctcataactctggtgccaacattgcctgggctcggtaaccttcatgaaatttattattaaagtttgaaattcgttcttgtgtaggtgtaatgggattagtcgaattgcaaagatgatagggctgctatttacagaaaaagctcctttctaacacttgccttttctaatgagtcaccataatacctctgtaattattacattgattgtcttttgcagaattagatttttttgtaactctgggagattttgattagaacattcagttattatgtctgaagagtgatctagctacatgagttaatagtctttggattgaatgtgttgaaaattaaattgaaattagaatttttgtacatcaaggcttcaggtgccctttagcaactttgggagacgaagatatctccacactcagaaataggttttactgaaaagtttttggtggtgaaaaaaataaaatacctcaaacaagctgcagaaacaaagattttcccagaaattctcaacaactatgaggatagactagaagttctgcaagggcagacacttgtacatcattaatccttgacagaattggtaggaaacctttggattttagccagtgtggcagagtaccctgagacgtgacagaaaagagtggtggtggtcaggcactgaattcagttaactgttactggtttctaagaactcatcatgcattcacatagaatctttgtcaacttcacaaaaatcctagtagagtgagatttttatccccattttaaaagtgagccatgtaggtaactcgctcccaaattactcaataaatgctgcatctgaattagaatctatcggaggctggctcccccatctggacttcagcatgacttcattaatgttccctaccctctccagccctatgctggtccactagtcactggtgtaccttcctataccataactgtatctcctgtacagaataataatgctcagatgtttggagatgtatgtgcaaagttcagaaatgactttagacaacattttaccttccttcacgatgaaatgagaaaaattaacaccaatctaataccaaaacaaaataatttaccacaaaagtgattatcttgtaatgtgaaggattcaatatgaactatcactgaatatggtttgaaagggttccatattaatgcatgtcagagaagcaggccagatgctgactaaatcagcaatgtctttgttgatgctttttggcctgtaaagtacctgtaaagtacctgtaaagtacctttaaaaccctgtaaagtatcttgtaatggtgtagaataatcaaagacttgggataacttctgtggtcacaaagcctgttgtaaatgaataaccaggacttttgttttgataaatctaatctacattcctctgtagcacacgattatactcaaaagcaggttatgattgcccccaaattcctaggtaccattgtgaagtcaggctcagacctgactttttgatatctttttacctgagcccctacatccctggcaccaatagaggacatggtaatagtcactaaatgaacccataatatctgtgtttaggaggagtgacattttttggcttattgctggtattcaaatgcctctttactcacctatctttgacaacatccctctggattatggtactcacttagtatgcccttcccataggtgttcaacattccaaaattatttgatactttgcaaaacatccagcaacatcaaatattttccaatctttaaagggctgaatttagtttggccttagaacaaaacaatctgattgaagtaatgcatactaaaaagtgaatgacgaatatgttttgttttgtattatttgaaattttagacaaacttttcccttacaagtctttaaaacgaaatgtgtgagcaagattttcttttctttcttagcaggaatgaatgtcagatgtccttttcttacctcaacttctctttactaccccattcagaaacttgacacctttctcctgaagtgttgatgacatgtaatctaaagaatatcttggacatttaggaaaattaaacacataggaaacttttttttccttcctagcatgaagttttctatttttccttcctttgggtgggacaaaacattagtaacttatacagtgctactccctaatgtaaaattataaagtcatttgtatttagggatgtaggggttttttttagatttaatgtgtacttatcatgaaatcagtggatgattgggtcaagtctatgacattatttaactaagcggtctgccatggcattatttaatgaaataatttttaaaaatgcttttattttactgtaagccattgaagaaaaattttactcaaagtttaacaagtgtttagttcatgatgaggcatttgcagctgtaagcaatcatattactgtgccatcatttagttttatggaaaatgaaaacgtttacttaaggctgttaaaagtttgttttttaatagtgcctcctaagcaatacaggctaccacttacttttgacatcgagggaaaaagagttactcagattcattcaagctttagttatattgatttctacgatgggtttttcttagcatgtcaagtgattcctgttttatagtgaaggcattactttgagtcaatatcaaagtacatgatcccctcaaccttcaactgtgtttcctgctttgtgaggtgccaacaatagcaagaagggataatttaaattccgctttccataggaaaaaaaaaaaatcccagctgggcgcgatggctcacgcctgtaatcccagcactttgggaggccaaggcgggtggatcacctgagatcgggagttcaagaccagcctgaccaacatggagaaatcctttttctactaaaactacaaaattagctgggcgtggtggtgcatgcctgtaatcccagctacttgggaggctgaggcaggagaattggttgaacccaggaggcggaggttgcagtgagccgagatcatgccattgcactccagcctgggcaacaaaagcgaaactccatctcaaaaaaaaaaaaaagaaagaaagaaagaaagaaaaagaaaaattcctttggtaaaacattatatactctctaaacagggattctcttcacaccattttgaattgcgtgcttcttgccttgttgcacagattaaactgggaaacaattttatgtgtagcagggtttctaaacctcagctctattgacatttgggggcagatcattcttttttgtgaggggctgtcctgtgcattgcagaatgttgagcaggatgcctgatttctagccgctagatgccagtagcaccttcccctcagttgagacaaccaaaaatgtttccagacatccctaaatgtcttattgggtgtgaagtcatcctcagttgagagctactaatctagcaaattagcatatttctagcaaaatagcataactacttttaaaaataagtttggtctaggatgtttttctctttcaaatgaggtatattttagataattttcacttcaataataaataataattacagaaaccaaaatacaggtttcagatgttatctgtgtaggaatgtgaataacagtgacaacattttctgaaagaaaaatttgtatgtagagactaacaaaggtgttttttctcatttgtgcatttaattatgatacaataatttgattatatttagtggtaaatgaataatcttcattagaaaattatacaaagaaatgaacaattcagaaaaaaataatagctttcatattttgtcctgtattattgaagtaagcatgttgcacccacttgatatgcttattattcttaaaaatttcccacatttcttggtaaatttgagtaattcctgtattgtcagtgaatacattataattttaatagtgattgataagcattttgatctctagatttattatcattaaacaatgcagtcacacactttaaacagaattagtagaaacattttcttatttttcttatttggaacatttatcagactaaagaattttaagtgtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagtcgagattgcgccactgcagtccgcagtccggcctgggcgacagagcaagactccgtctcaaaagaattttaagtgaaaccaaccactactttgtgctgcatatatgagagcacttcaaaaagttcatgggacaaattaaatgaaaagataagaaataataaatagaaactttctcagcatcaagctcaagacacttttttgatcaatgatacccgccattttagtccatctctaaagaactaagggtcctgggaattttaccatgtcattgcaatcttttttattttattaactgaagacaaatgggtgccctttagattttttttttttttaagattagtaagcaaaaagaagtcagaaggagccaaatcaggactggaaggtgagtgcttagtaatttcccatagagactctcacaaaattgcccttgtttgataagaggagtgatccaggagcattgttgtagtcatttttctgctaaagctttggctaactttctcaaaatactctcatagtaaacagatgttaattgagttttggccctctaaaaagtcaacaaacaaaatgccttgagcatcccaaaacgctgttgccatgacctttgctcttgaccagtctgcttttactttgactggaccacttcctcttggtagccactgctttgattgtgctttgtcttcaggatggtactgggaaagccatgttttatttcctgttacaattctttgaagaaatgcttcaggatcttggtcccacttgtgaaaaatttccttcaaaagctctgctcttgtctgcagctgatctaagtgcaatggttttggtaactttagggcgtaaagtttgcttgactttaatttttcagtcagaattgtgtaagctgaaccaattgagatgtctatggtgttggctattgtttctgctgttaatcattggtcctcttcgattagagcatgaacaagatgaatttttttcctcacaaattgatatggatggcctgctgctgtgggcttcatcttcaatatcatcccttcttcttttttctttttttttttttttttttttgaaatgggggttttcactcttgtcaccagactggagggcaatggtgcgatctcggctcactgcaacctctgcctcccgggttcaagcaattctcctgcctcagcctcctgagtagctgggattacagctgcccaccaccaagcccagctaatttttgtatttttagtagagacagggtttcaccatgttggccaggctggcctcaaacttctgacctcaggtgatctgtgcacctcagcatcccaaagtgctgggattacaggcgtgagccaccacactcagccctcatcacttcttaaaatgagtttttcatttgcaaactgttgatatctttgggggactgtcctcataaacttttaataaagcatcagtgatttcaccattcttccacccaatcttcaccataaatttgatgtttgttcttgcttcaattttagcagaattcatgtttccctgacaggggctcttttcaaactgatgtcttatctttcttagtgcctcaaactagatcttgttaaggcaggttataacaagttagtaagaatttattttggtgtaatatacatttgaaatttttgtatagttctttcataatgcatattttctatgaactttttgaagtcccctcatactttctctttgttcattttactagcgtgtttgactaagataagttttaaggacaaaagtatgacttgtatggtttttataattaagtatttctgtaatattccacattattgccagttctgtccagggagaagtttttccagctcattcctgaataattgttacaaaccattcacattcatctaaggtatttctgataactaatatcaaaaccttcagaattcagggtatactatgcttagcaatattacttggagcttctattcaaacagcagaaacagattgttttcctttatccaaaatataatataagttacatcatgtaaagcagtgataacattttgggttaaaccccaaatcacaacttctgggtgagaatccttcaaattttaatataatcagcagaagcattctagtagagtttaaaaatgtttatacctaagaaatagtcactccagatttgtcaatctattgtgcttaaatatgaaaaatgtgtacatacaacacttaggcaaaattcacagaatgagttctgtatgaatataacattgtggacaattttatcctatttaccacatcaattgatcaaataagtttatgtgaatgtatgctatcttggaaggccaaggcaggtggatcacctgaggtcaggagttcaaaaccagcctggccaacatggtgaaaccccgtctctactaaaaatataaaaaattagccaggcatggtggtgcatgcctataatcccagctacttgggaggctgaggcaggagaattgcttgaacctgggaggcagaggttgcagtgagctgaggtcatgccattgcactccagcctggacaacaagagtgaaactctgtctcaaaaaagaaaaatatgctatcagtgtttttcactggggaaattttgtacctccccccaggacacatttgccaatgtctggagacttttgtggtcacatttgggaggggtgatttgctactggccaaggatgctgctaaacatcccacagtttagaggacagcaacacccaccacaaaaacaagtgatctcgcccaaatagcaagaatgccaagattgagaaactctgtactgtagagatgatcaataaaatgttttctttattctccagtgattttcttgagatgttcttcagatttgggacattttgcaaatgttaacttgcatcactgtatctgtgggtatgccaacagtcttactcacatatgtcacgtcacagcagaaagaaaagataatctcttaattgtcattttatcttattttccagagcgccactttaactgcaatttcttcacaaagatttctcaccaggaaactggcagctgtaatatttatgatccgtttcttttttatttttaatttgttttaatttttaatgtttgtgggtacatagtaggtgtatattaatgatgaaagtgcgccattcctgtggcaaatgtttttgaatttttgatgcagacttgttttgaacatctgctttgtgctttatttgtactctttagaatcttttctttttgaataatatgaaaattgctataatggctgtggctaaactatgcatttttggtgtgatggacagttacaacttcttttaacacaggcttatttttaataggataacattgaatttgaaaatgtgtgcgtatatgtgtgtggctgttgaagttctgggagctcagatctgagagccagcaaatttagatgtattattttattcaatcattcattttattgagaagttacttgtgagtagcatttattgcactatttttatattcaaaatattactatttttagaaaaggtacttattttgaaaaatgttcacttttcctgctttttatactaacttttacatcaaaataccactgtgcaactaaatttgtgcccaattgaacaaatttttaaataaattagaactacaggccaaattgttacattagaaaacacttagaaattgttaccatttcttctattttgttgcttccagtaaatttccttcatggcacaatttacaaaaagtaataaatattgaacatgtatttaacattaaaaacaccgcttacatccatatacagttatggctcttaaaatgcagacttttgtattgtagcagtctatgagctgtctcttttgcaaaatatttttctttgtagtaacagctttatttcaatgttggctgactatatcttttattcagggactatttgctgaagtatttgcaactaggggcattttggatgtttaatgggaacaaggagaccttatatataattagaattattccataaggtctgagtgtgtgtatgcatgtgtgtatgcatgtgtgtatatgtaggtgtatgtgtatatatatacacatatatgtgtttgcgtttatatatgtgtgtgtgtgtatattatacacctgtgtgtgtgtgtgtgtgtgtgtgtgtgtgtgtgtgtgtgtgtgtaaagagatattttctttgaattgagcaaaacacacatctcccttttcttcattagggcacaagattttttcctattcctttaactattctgttctgataccataaaagccattcacaataggttgtaggtggctgtaatttataatcatttcagtagtaaaattcatcatccctgggattattccctctcttgtcacacgttaattcctggctccagattgtctttgctgtgacttcatctgtaaagatttgcttcccttttcaatgtccgccttttgctttctggagatataacctttgtttctcaagatctgaatgcatggaatatgaaactttccccaactccaccagcacaagtgacctctttctctcaaccctgcagttgtttatccattaaaattaccaattaaatttccttttatacatgtcttgtctcccactaattggtagccgctgaggtctgagacagcacagcccatattctttaacttgaccctgaggagatgccggtctagcttttatttaggttagggttggcatctgaggaactgtgttcctattgcatgctgcagtcatgagctaacagaacgcttaaatcaaaagctgtcaacctaacatgaagaggcatccacagagctgtctctgagaagctttattctttgactcacatctccaatgtgagtaatgtggttgaaacctagcaaagtcaaaatttacttgaagtgatatggtggatccggtgctgtagatgatgattgtagacctgaaaaaaagaagttacgcgaataacatctgcttttctgtgtgatattttcccccccagctgtttagagaattagaaattgctctgtcaagggtttgtttacaaaagcctggccaatttcaaaatgaagctgcctttgagttgtccctgtttcatctcactgtttggaaaataaatctgaaccattaagatgtaaatacatcaagttagaagccaaaggcagtgaaaaccaagtaaaagcaagaaatgtaccacgatttaagtattctcctgggaggaaaaatatacatggtaataatttttgtatcttataattttattattaaattaaggggagagaaatttgaaatcagcataatatctattttgtgtagtatttaacactgtgatgtatattgacaattgataatgaatcaaaatatgtgcgggtaactgtatgttcattaaattagagtttggtaatgagatagaaagagagaatgagaggggtacaggtgtaagcagcagttctcaaagtgtaatcccggaaccatcagcagctgcatcaccctgaaacattagaaatgcaaattctcaggccctgttgaagacctactgaatcagaaactctggggatggggcccagtaatctgtgttttaacaagccctccagaggattctgatgcatactccagtttaagaagcacttctatgtagatggatggatggttggatggctggcaagatatgtgggtacaatgacacatacatatgtaagtacaagtataggtatgggtataaatacaaatatgaatacaaatacagatataaatacagatattttgagagagagatatatagatagacatagatatagatatagatatagatatagaaatgtggagttaccatcacaggacttttttagaggagcaaattatttccttttacttattatatgattgaataaaagctgttcttttctctaggcaatgggtctatcatttataaactgagaaaatctactggtggtccatttgttgaaccattttccattaggttcacttaaagtgtttgttccatcaagtctgccacctgggtggtttccttcactgcaaaactggtttgctcttccctcccctctgtcttcttggcagctgctgtctgccctggttcttatccattggtagatctgattgctttggggactggatcaacagttgaatcctcacaggattttgaagccaacaatatcctacatattggtccatttttcagaatttcttcatttgtgttttatccttccatttttctttctaagcatatataatttatttagattggtgcagaagtaattgcggttttgccatggaaagtaatggcaaaaaccgtaattacttttgtaccaacctaataatttcagccaactattcatatgcagcactgtttacaatggggatgaataagtaacagctaaatatctgataaaaggggatgttttaaatatagtagattgcaaaataatatgatactttttgagaagaaaatttcaatatgcaaaaaatataggggataatattcattaagacataatcaatgattgttggattatggatgattttaattttactcattttgcttatttttatatttatgattacattagttgtaagctcaaattgctgttataagcaaagataatgcagatttatatgtatatatataaaacagtaaaataaattgattgtattttttatcttcttcctttccccactatgctatgaacttaaagtccagcaattatgccagctgtatctattcatcatttttcacattaaaagcaatattgctggatagtagaattaaatgacaactctgcttttggaaatgacaggaagtctgctgtaaatagataattgatgtagacgttaaagccaaatagaatttccatttatggagaagggaatatttaagggtatgtggctataagaaaatatttccttttgcttttaacacaagatgtaacatgacttgtcatgctcaggatgtgttttgaagtggataatggcactttccctaatatttggaggcaccgggcttgatcctcttttgaaggccttcctttgaagataaacatagacattggttttagcttaattctccatccctaaaattccttcctgctctaaaattctataattccataacaacagtgtataagcaataattatgaaatggaaaaatgagccattctacttgccatccttcatgtaaagctgtactatggaatcctgctctaaggtggggccggtgtcatttctccaagcagtatgatgccctggaagaaagcaatgtacagtggcctgtgattctggaccttggatcactttgatgcccttggcttataataaaagcaaaatccatttaaaccaccttaaataattaggaattttagaggctcatgtcaccaaaatccataagtatgtagggtttcatccagtgacttgacctttttcctgcagtgctcttcattttatgtccctctaagtgtcacctctaggctgatagcaacagaacctgtggcagtttggggataaatatgacgatgtctaagctagtgtttctcaactgtgggtgaccaccccaggagacatctggcaaagtcgggaaacatttttggttgtcacaagtggagaggtgctactggcatcaagtgagtaaaagccagggatgcttctaaacatcttcggtgtgcaggacagccccaccagagagaatgatccaacccaaaatgtcaatagtgctgagtaactctggcatagaagaagaaaggtttcctctgcctataactcacttacattctaggaaacatttccaaaggcttccagccacatttccctcacatgctggtgcctatagtacaaaaggctttaggcctgggttctgagatcaatcgtgggtggggaacagtattaccaagatcagctcactgagccccaaaatgcatgtggcatgtccatgctatacactgtcaaccagaacaataaatacccgtcatataatagtactattttgttattagcaagagaggggaattcaggcatcattactattcagccctaaaaaagaagaaattcctgttatttgcaacaacatggatgaatctggaggacactgtgttcaatgaaataagccaggcacagaaagcaaagacaaatgctgcactttctcacttacatgtggaatctaaaaaagttgaactcatagatgcagagactaaaatggtgctttccagaacctgggggtggggctgagggttggagagatgttggtcaaaggatgcaatattttacttagacaaaaggaataaattcaagagatctattgtacaacatggttactataattaacagcaatgtattttattttgaaaatcactaacagagtagattttaagtattctcaccacaaaaagtgacagctatgtaggtaatgcatatgttaattggcttaatgaagacatttcacaattgtatatgtatgtcaggacatcatcttgtacacaataaatatgtacaatttttatttgttaattttttaaaaatcctgtgaactgctaaagaataaacatactctccaaacctttctgtgggatttggggaagtgtttcttcacctgtatttttttctgggttatctgcattaatatctttctagaaaaggatatgactggaagtggcttattgacaatctggattttcccaagagaaattaccttcaaccaggagagatgactactttaaagaagggctttgcagaacctatgtctttactgagtcattcagcaatccaagtgagagatgatgatagcttggaccaagatggaaccattgaaattatgagaagaggtcagattctgacatattttgaaggtacagccaacaagatttactgacagattgactatggattgtgaaatggacccattggtgatagagagtggaagttttggcctgatctactggaaaaattgagttgctattgacttagatggggaacactatagagaagaatattgagaagaagttgaagaactcagggaattcaagaaaaaaatgtcctagttggagatataaactaggtaactatcagtgcatagatgtcatttaaagatacaaggttggttaaaatcaccaaagaggaattgcagatgaaaaataaaggagattcaagaacagagccatggtgaattccaacattatgttacattcagagaggtgatagacactcaaaagagtgtggcatccacaaagcttattctcacatttgttaattgacgtcaaaaacatggctggttgttttgtttttgtttttaacttaagctctttcaaattctggaatttgggtatctttccctaaaagagaaaaaacagccttcgtcttttgagcaagccaggaagcctcttcctgccgtcaattattaattttcttaacatccacttatcatctaaaacaggggttcccgacccccgggccgcagaccagtaccagtccatggcctattaagaatgggactgcacagcaggagtgagcattactgcctgtgctccgccgcccgtcagatcagtggtggcattcattagagtctcataagagcgctaactctattgtgaactgcgcaggtgagggatcttggttgcaagctccttatgagaatctaactaatgcctgattatctgaagtggaacagtttcatgctgaaaccatccccgccgcactgtctgtggaaaagttgtcttccacaaaaccggtccctggtgccaaaaatggctggggtcagctagtctaaaacatagcgaagctatgggctaaggaacttaccttgcttttgtttttccatctgggcaaatggttcatcctgcccctccagggtgagaaatgcctgtccctttctctcaatctgtatatgcaggctaacaaaagatatttttcagagatgatttatttcaccagaacgattattgataatttgcatttatggacacttggtgatcttatcaatatttttatgttttctcttttttagcttttaagttcaagggtacatgtgcaggtttgttacatggataaacttgtatcatggggttttgttgtacagattatttcctcacccgggtattaatcctagtacccattagttatttttcctgttcctctccctcctcccaccctctaccttctgagaggtccccagtgtgtgttgttcccctccatgtgtccatgtgttctcatcatttagctcccacttataagtgagaacatgcagtatttagttttctgttcctgtgttagtttgctaaggatatataccatggaatagcatgcagccataaaaaagaatgagatcatatcttttgcagggacatggatggaggtggaggccattatccttagcaaaatgttttccctttttgtgggacattatcttgaatttctcagaaatcaaccacaaatttaaagagtgaacactggatatctattgcaaatttttctaaaataacatacataaatctagctatgagaaaaacagctttcaatttttattttgcataagagtttcttggaaagtttcttaaaatgcagattccttgacatcagaagttctgttatgatcaatttgggactggactccagctggtccatttcatccatcccacaccattatctgattacagggcagaggatccacaagctgttcaggagctcatataaatttctgcaagctgaaaaggaaattattgactcccaaagtaatgatgtaaatactcacctatatatctaaaaacatagcaagtgccaatttcattgtcaactagtatttttaacaatctcatcacatgtaaaaacaattcgtaatgtacattttgttctcttaacaagtattcctgaacacgcacaataattacttaaaaaatcacagccaaacgagaatccgatgaattacttattgccaaatcatgtcaaaatcaaaattgtaaaaattcttgataatacaaggagatgaacctcaaaagtaagtgcttaaaatagctcagagctcctggaactcacttttaacaaaaagtaaccccaggtgattctgtatttgatcttttgcccacacttggagaatctaaggtctgtgtggggatgcttcatatcatcaaagcgtacttgtcttccttcaatcatttatcaaaattcttagcacctaaacctagcatcttagcatgatgctagattataaaaatacagtgataaacaatctttctaattgtgaagcctccagcccagtaagagagacagccaatagacaaatgcacaaacaagtaaaatcaattataggttgagataagtgctaagaagaaaatcaacagtgtgttgagatcaagaagccaggaaacattaatatcagattggggaagtcaaggaaggctttttgagcagatgatatttaagcagagaccagaaaaaggaggagccagccctgtgactgacgccttaggaaagcagttcaagcaaaggaaacagcatagacagaaacccctaatcaggacccagcttgccttgtccatgagtgtttgaagaacaggaggaaagagaggaggcatgaaaggtgaggctaaggaagttggtccagaccctttgacataggcaagttctatgtggatggattttattctaagtgcaatggaagcccgttgatgatctttgcttgcttgtttgttgttatttttttaaggttggatatggtgtggtactttgtgtagcagttgaacacataactcgagccagactgcccaggcaggaattctggctttgcctcttataggcagagtaaagttgagcatgttctaacctctcttcactcacttcctcattgtaaaatggaagtaataacagtacctacctcttaaggttgtttagcagatttaataaatatgtgatatgctctatgtatgtctcaaaatgaagaattgtctttaagaagattactgttatttcccccatgaacaaattgagtaaggacaagagcagatggctaggttgtctggaaggctgctaaatttgtttgggagaaatgtgatgggggctggaattggagtgatgaaagtaaagatggagaggaggggtcagattcctgatttattttggatgcagagttgacagaagttggtaatagattaaaagtagaacatgcagtgaagaggagaataaagaaaatgacttagttcctggctcaactaactgggtggataaaaataatcattatttaataataataataatcatcatcatcatccacaacaacactgattaagcgagtgctgcataccaggcaggcattgtgataaatgctttgtaaacacctctaaagatgtgggaggctaggataccaaaacatttgccagaagagaaagtcaagagttcattagtggataagggaagtttgagatgaccctgagacaccaggtagaagggtcaagaaggcagctggatagtcagctccataaacacaaagatgattggtttggagatagtatttgagagtcctgaactttgcaatgggatttaccaccatgtttttttgtataatggcttgggctgttacgataatatttttgtcttttttggtctaattctttttagttcaagacctgctttgtaaaaaccttagtgtcaatcaaattttcagtcagttctccatagtgtaaaataaagtattgcattaacatttctgactctgaaacaactctactgaactaaactacttaatctgaagtttgtgttgtgtgtgtctgaaacatttcctcatcaaaattcaaagaaactttagttcaagttatggcctgaaatcaacagaattatattaattcatatggatatagaaaatcatttatttacagtatttaaattgacatttaaacagtttttccaatcccacacagttagtggcataaggtcttgagaaagcatgaaacattttttttttatcagcctcatatttcgttgagcttgccaaacacagttcattttccatagaaatttgcaaacctgagtagtggccaaattttcagagtcgctgaatgtaagccaatgaataaaattgttaaaccctttgatttccccccacttttttcccttaaaaagtaacatagcgtgtgcctgagttttattttttgacatctattacccacaacactcgagtgtgtttcagaatcagcctgtatggacatttcagtacaaaatgaacacagccggcgctttggggaacgttcatttgcagctttgttatccttagacaggaagccttctcctccacactttgatcgacatttttcagaaggcaatggcatcaacctttaaaaatggatactttcaagggtttaaaggttgagatttttaagacaaacccagaataggcaaaagttacatattggccaaaaatgtgactccagaaaccatgtgttgtagctaactggggccactagcaaatctttcttttgagacttctgtcctgttagcagaatgcactgatcgaactaaaccttgagcatgacacaggatagaactagttattgttaagaaaataatgttcaagggcattggtccattgtacccaggaatagtttggaaagatgaaggatatggaaacaaacaagcaaaaaaagaagaattaaaattaataattaaaatgtcagtaactgtaatgtatttctcttagtggatgataaaattacataagaatgtcgaccttttctttaacccaatgaccatagtggcagtctcttcattggactgcttccttcattggcatcgccttctaatttcatttttacttatgatagtgaaaatgcacaatggcccctggaggcaataccctaatttttttgtttaagtgctcaaaaaagtatatcctttccctgcgaaaaaggcagagggtcacaattaattactgaatttcagctatgaaaaacccactgaactgtgagagtccattgtgcttaagttgcatttaatctctttggagatgccaactacctgatatacaagagcaactgtaagttccaaaaaaactctcacagataggaaccatagacatggagagaagggagccactactcagaaatgaaggagttggggaggagtggggctgaaccatgaagccagaacagaatttttgtcagtggcctagaagcaaagctgagaagaagggtctgaatgtgctggggaccagtggttgtagctccacactgagatggaagcctcctctcactgtagcttctgccaaaacacataggtaaatttgcaggagtaatggtgacctcggaagagcctggtgtaattggggaatgattgttgcaagggaataagagccagtatttcatttggtcttttgtgtctggcatttttcactcagtataatgtccccagggttcatccatgttgtagtatttatcagtacttcatccctttttgtggctgaataatattctattgtagggatatgacacattttgtttattccttcatctgttgatggattatttgggttgttttgactgtttgactattaagaataatgctgttaggaacattcatatgcaagtttttgtgcagacttacatgtttttcatgtccatatttcttgggtatatacctaaaagttgaattgctgagtataatggcaaatgtatgtttaacatttggagacacattctcaccagcactatgtaagggttccacatccttaccaacagtttttttttttttttaaagctatcctagtgggcgtgatgtgataattttttttttttttttttttgagatagagtctcactctgtcacttaggttggaatgcagtggcacaatcacagttcacttcagcctcgacctccctgggctcaggtgatcctcccacttcagcctcccaagtagctggaactatgggcacgcaccaccacaccaggctgttttttattttattttaatttttgtacagacgaggttttgccatgttgctcaggttgatctcgaactcctgagctcaagtgatccgcccaccttggcctctcaaaatgctgggattaccggcatgagcctcactgtgattttgatttgcatttccctgatggctaatgatatcaagcatcttttcatatgcttatcagccatttgtatatcttcttcagagaaatatttattcagattttttttcttatttttcaattaggttgtctttttattattgaattgtaagagttcttcagattctggatacaaatctctcatcagatatgtgagtgagcatttttttcaaatgattttttccctccagcaatcatactgcatttctaccatctactgtaaactgccatatgtctacctcatttatctcaactttttaactttttaacttttacacttttcttcctagtgggtgcttgggggctttcagccttctgtgcctggggaggactttcagaactaagagctccccagggtgtctgactcagaggatcacagtgacccaaggctctctccctccgagatcctctagttgtgcattccagacagggagactgcctggccggctcctctagcactttgagcagtgtccctccctgcctcctgtctccttctctgttcccacactgcacaggggctctgcgtggggagtatgggggctcgctactgcctggagctgctgctattgctgaggtgtaagaaccctggagaggtaagaagatacggtgtgtgtatttcaggctctgtgtttcgtgcctactgctagaagcaaggtaggacccaagccaggaagacgtgaaagattccatggggtaataatcccagagcagcatctggaaaaggtgaacataagtaggaaagaaggagggaagtaatagcgttggagggatttgctcaatgtgtcctggcgcttgagtctcttttaacatcaaagctcaggtggttcaaatgacagtcacactgcctctgcctgttgctttaagagtaaattcagagtcttcaaaccaggcttattggaatattacataccattgccaagacgtgtatatttttattgaaagttcagagcaaatcatagtaaggacccaccatttcttctgcaccattccttttggctattttctcagtatttgaaaatcaatggaatttgactttaacatgcacattggcttataatgttactgttgcatgggtcttaatgttactgttccagtccagtgtttttgtgctagaggtaaggaaactgaagttcagagtgaatcaggcattgccaggatcaccagactaatccaggatgagccaaaacatcattgctatggagtgtctctttgggtctcaatcattgggtactatataatgactgacgactggggacaagggcataggttgcccttttccttagtatgatgaaggatcaagattctataacatcgataactgattagggtactaatgtggaaccacaaaatgtggttcagctctgtcctgtggccactccatgcagcaaagacagatggctggttcagaaaactttggttttgttgtttgcatacaataaaggtagcatctggtgcaaattttattttttttaatgattccagggttttttctttaatgatttcatagaaagaaccttaaaactcatcttttcagaatattaatttagattgttaccgaagtgttcacagagcctaattaaatacttgctggtttcatatagctacaagtaaaagctgctttgaatccttcctaaacttatattggtttatttggtgaattgtgtgttaacaccaagaaagtgaaatcattggcttttctacagattggtgatctattaccttaaacaatatgatcaggccacatcaattcatttgcaaatttcttcctctctctatcatgtgcacatgccaccataggtataaagtaattaaaatatatacgaattatttagtttgttaaaagccaagttgcttttgaagaaaatttgctgctcttagattatgattatttacagtttgttaagtgatttcattttgtaggcatagactttttattgtgattctgattatttacagtaatagcaactatcaaatcaactaatgtggtggtgattgcagatttttggatatctattactgtttatcgggaacattttttcactaccagaacggggaaaaaaaagccacaaaagcagtaaatcccattgctttccaagtgtcattgtaaatcctgctgataagaactgcacattttagcaatgtttaataagtactttaaaaattgagaattgtctcaaaagaaacagattttgaagttcctctgttgtacctacttccagattaagaaaaatcatttgtggaaaacaagttgatcccaagttcctaatcacagggagaagatgggattttgtaaacctgcagagcctgaatttgttattgcatgcagctgtgcaaatttgcaaacatttccttccctagtcaggaccctatggaaggagccagtttggactgctgccttgatagctaacatttgtagaggctgcagtgcaggaagctattggggtacctgaactttgtcatctattttaatctgggcattagatgccaggtagagagagtatgcaagccaattagttctgcttcaatgtcatggtagggatatatcagtagccttattattcttgtcattctcggtgaatttcagaatgctgcttgaaatgggctttctgtatgcgttgagtgtgtgttcagtgggctgtctgggaaggaagatagcggagggccaaggcctgggtctcctaaaacacatgattatttcattgaactaatcagtgagagaaagacagggccttgtggtttctacgagcactggacttgcgtttctttgttttccatccatcctttggaaccagagaaggcatgaggaccatccatgagcaggttcacactcaaagctggttgcccttaccctggttgccatggcaatgttgtcctagcgtaggggatacttgcctatgtttgtagctgtctcctccccatctttggcagtttagcacaagaggcaactccctcatgcaactacagagcatttaatgagttagggattcttcattttgagttacagttagctctctagtatatttttgggaggacaaatgggcaggaaaaattaagtcacaggagacaagcttcatgactctaatggagttgaatttacatttgccattaaaaatagctatagattgtttaattagaatcctagaggcggatgacgaattagtttatctttcaaatggtactcataaaaaatggggcagtgtgtgtgtgttttaaaagagcctaacttcttgttaaaatttaaagttcaaaccctcatttgtaaattggtgatagagacaattctataacgttgtgagaattaaatgagctaatacatgtcatgtgcttagaatagtgcctgaaatataataagcccagtaaatgttcagtgttattattatcattacttttatatgacagcatcctgggtgtttaatgctaatgatggctcattgagcagatattaagcatactgaccagtttccaggtatttttccaaatctgcctcaaggagcttgacagctaagggggagacaaaagtagaaagaagcagttgtttgaaatagaggcatggtcaacatatcctgggaaacctctgagcctgtgcactccagccctgtggactagcgagagaggtttctagaagaggtgacattgaggtgttggtcattgatggctgctcccagatgtgtggatatgggggcaaggagacaggggaacctcacttccaggagtgccagccaacgtagagcagtgagagaagatttctagaagaggtggcattgaggtgagggtcactgatggctgctcccggatgtttgggatacagcagcaaggaggcagggagatcctcacttcagaagtgccttgagttggttatttggacagatagggtgttcgatggcctgggtctgtcagatattctcagctgcccaaggtcagtgcttaatcatcttctctccttacaatacactgctttatattctccatggctgtaggggttttattctgtaacaattttgtaacaaaaacttcttaatcaaaagaatcattcttttggagagtggtggttctgaaaatcatgagaattaaggcatcttaaattactgcccactttatggacagaaccactcatttctcattattctgccagatccaagcaaatctcagaacagaacttatcccagactaattgaataaccttgaattcagtagttacactcatggctaaatttattattttctcctctttatcactcgggtagacacaatcactttcagaggttcttcagtctgatttacaattagctccttagcacatctttggaaggtcaaacaagcaggaacaattaactcacaggagacaagcttcttgtaacctcccaagaaacaaatactcacttctaagtaagttctgaagaagcaaataactattctaacttctgtcggacggtttttaaaaattttgttttaatttactttttttattttatagatttagagggtggacatgctttcttacatggatatattgtgtagtggtgaaatctgggcttttaacaggatagttttgatttagagacattagctgacttaatcacgggacagcactttctttattttgcaaattctccttaacacccctaccactccccaagctgttttgatttgtttagatccctgttgtgactccagacattgccaaaggtcccctaggagacacaactgtacctgcttaagaaccactcatctagaggaaaacggtttggtaaaggccgggtgcagtggctcgcgcctgtgatcccagcactttgggtggctgaggcaggcagatcaggaggtcaggagattgagcaatcctggccaacatggtaaaaccctgtctctactaaaatacaaaaaaaattagccaggcatggtggtgcctggctgtagtcccagctactcaggaggctgaggcaggggaatcgcttgaatttgggaggtggtgattgcagtgaaccgagattgagccactgcactccagcctggcgacagagcgagactccatctcaaaaaaaaaaaaaaaaaaaaaaaaaaaagtaaaagaaagaaaaatgaaatccttataatgtggaattagctgaattgtgccaatgccagagtgacaagggaagggtctgagttgggagtcactgtacacaaaggctcagccctagaaagaaggtaaaaggaagacatgcagagagaggtggtctcaagttctagcctccacttagtggagcgcccccatgacacttgcctggtgttgctctcctgttaccctcagagtggtgaattgaggatgaaggcttgtcttggaggcagcaaagaacagtgtctggggatatcaggtaggagaaggcaaagatcatttagggtcacaatcagtaagggaggtgttcaggtggctacactgtcagagtgatgcactgataaatgacagacatgggccgggcatggtggctcacacctgtaatcctagcactttgggaggctgaggtgggcagatcacttgaggtcaggagttcaagaccagcctggccaacatggtgaaaccccgtttctactaaaaatacaaaaattagctgggtgtggtggctcactcttgtaatcccctctacttgggaggctgaggctggaggatcacttgaacccaggaggcggaagttgcagtgagccaagatcatgccactgcactccagcctgggtgacagagcaagactctgtctcaaaaaaaaaaagacaaacgtgatgtacttcagtgcctgtggcatcaaaaacttccatgtcatatcctaattttgtatcactcctgcttccaactgggtagtgttctctttgggagtctacagaggcaggacaaagctctctttctgattacaagaactgtagctaacatttattgagcttggggctcattaacatgaaaagactcagagcagagcatgatattagtacattttatagacgagtgtactgagccatagagaggccaaaaaaattgtccaagtttccacagcagataggcaatggtcatgattgtgaatcaaacggtttggttatggaggctgcaccccctaccatcacactggaaagccggctttgtgcttctgtggacacttaactgacacccccagagcctgcacattccatggccaaatatgaagcatggaaaattatttggagaggcaaacaaaatttggctgtttggaggaattgagattttaatatcgttcatttttaaaattaatagtaaagtgaattctgggtcctgtggtgttttttgttgaccataggacaatgatatttgcaaatgggctttattaatttagattttgtgatagaggattcaagtgtgatttattgaggtaaatgtttcgaacccaaatgaccactcctttcttctctcttcaaatcctcaccactcccagcccaatcttattcctcaataattatttatcgtctggaagagtcaggtgtttcaaatgaggccagcatggacttttcccaacagggaggtattttttaatatctaaatgtcggcctatggcccttgctgttaaggctccagatcaaataggggcaaaaggaattgaaagccaaatcacaaaaataagtaaaaactccaactaacaagaatttcacaacagacataagctgatgactattttattaaagcaatgtggagtactactaaatgctactatgttctggaaatgtaggaaattggttgaagtcgtttttctcttgttagtctcatgttaagctgttcatactaggatctcttgggttattttttcccaattaatacagttgtctactaatttattttctttttaaaagtcttggccttaaactcagtcttggtattttcagctattgtttactaccaaaggaaaaacttcggatttagagaaaagtctgtatttttattttgtgtggagttgagaaaggggatggtaaacttgacattgcttggaaatgaaatgcacagcttgatctttttttcttgatatgatttttgtattggaagaactgtagtatgtcttggtggtgataatgaataccataaccacataatcattctctaaatgattgtaatggaaagaagttttatttaaaatttcaagttactcaaatggcacatgtctccacatgtgtctttttactacaggtaaacccagaaagcatgcgtggttatgggtgtgtgagtgtgtgtaacgtgaatgtgtgcctccctctatgttatgttgcactattagtttgaaccacaaaatagaaaagaatgtaaatatcttctgaactctggatttatctgttctaaatgaaagctagaggggaaaccattttagtatgtaaagtttggcctgaggaagagaatggcacttctacagttcttagaaaattctcatagaggatcaggattactggcatgcttggggaacaacttgctgtgggtagctgagattttcagtttcaaccagcaaatctgttttgtttcatcttttgtttaaaatatttgaattaataagaattatttttcaacttcaagaagtagtacatagagcaatgctgtctgataaaactgaatggtgatggaaatattctgtatctgtgttgtccagaatggtagccactagccccatgtggctatttagcgcttaaaatgtgtctactatgacggaggaattgaattttaagttttatttaattttaatttatttacatttaaatagccacataggacaggactaccatatttgacagtgcaagtattagagtataattaccagttaatgtatgtctctggtttgaaacattcctctgtattatcacactacgtatctgaattttgatttggaaaccgtggctgaatgctgggattgattccagctctgccaacaggaaaggagtggtgaggaaagctgttggacagctagccaaggatatttgccatatttgccagagtgttttgactgtacttctgtcatagtattaataccatttggcctttttaattgttatttgtgggcttattttacccctttggtagattctagattccttaaggatggggccttgctcttttcaccagcacatggaatagtgccttgccctagagtgtgcttaataaatattgactcaattgattagaattggtccatgccaattgattaaaagcttttctacctttaaaaaattgaatctaaattctttaaaatcaagttatttgtttgaatattgacaccctcccaataaagttatgtttattcattccagaaaatgattaaggggccttaatcataaaggtactggaataaagttaccatgggtttgtgtaatataaaccctgcaaagactgtttacaattctgtgtgggtgtaggaagaaaaaaggattcaaatataaatatgagtgagaaagaaaacttgttttgagtccattttatgcatttgttaacattttgaagactatacagtacaatttatcttaaagttatgaggtgaaagaaatgacttgtgtttaaaatcactgcaattctctatttgaagctccattgataacattttttgaggaaaacaaattacttgaataactttaaattcagtacattattatgcatatcacataatttcatttaaaaatcttttttccatagaatgagatcaaaagaccagattttgattgccagtgtggtgtgaagtgtaaagccagtgttccatgtcctattttgtttcataatataaacattcttcaaaagtttatctttcttaatgtaaagaatttttcatataaacttcccttcatttggttcaggttttagttattgtacatattcataaattttcattttatcaactgttttaactgatgtataaactttgttttttaaaaaagatttgagacagtataatttaaattttctctaaaaagaaatatattccttatttgcttgccaaatggtgaatttgtatgactaaatgagcagttcctacctgattcaagaatactcattcataatatatcatctcaaatgataggaaaatttaagtttcattcaacacaaagacatgaatgatttttaatgcattttattgtctgctaatggtacttttttagttacagaatttgctaagtaaagtgattataagcaaaaatcattgtgttcttgtgtcactcctgaaagcatctgaagtattcattcccctctcatcttctgatcttttaatcctgaaaaaaattgcaaaagaacagttaaaataatttacaaatgttcctagtgagtaccatttacaataacatgtctggcttcagttttgtcaaaacaatgtacaaccatttaagttgaactctataatttctgaagtttctttgttatttcgttgtcattagatattaggtgtccatgaggactgcttccaccttcaggacacttaaagcctattattttataataaaataacaattgctacctttttggggggtacgtcttgcatgtcaggctccaagcttatcacgctattttgttttccataaaacaactctaagaaactatcaatgtttatactcaaattttacacaaaaagaaactgagttttaaagagttcaaactatctgcccaaagtcacctttccataaatagctttgtcaagatgtgagcacattataaagttcatggtattaattattcataaagaagtaaatgcattttctatgtacagagagaacatgtgccttggactagaatagccaatgataggcaccgattacttgggattcaatcaattttcaaaaaattctgccccatattttccgtaaacatgctcacaattatgaagccatttatgacatatattatgatttttttaaattcagaaactatggtatttataattggacagagacttgaaaataatctgatttcgtcattttcccccatttaaaagaaaataaaacaccgatacatttgaagtaacttttacaatactgcctcgtctttgagggcaaagccagaattggaacctttgtgtcctggcttcttatcctggtcatttccacctcacttctctcttcttctcagtagcaaatcatcaataacatgtataaattggaattacagttggatacatatacatgataggatcacataatctcgtatacatagaagtaagactttatggatgtagattaagtttgttttgttgactattcccattcatttgtaagagctacctgtaatggaagatttagtgctaaattgcagtaacttcttgctaaaagcttaatcatctatagaaccccagtacagaaaaggaatctaacagtatgtttagtttagccgcctccaagttagattgaaaactactggaaatggggaatcttcctgtaggtttttgaagagatttcccgtctaccttttgtagcctgttcagatatttgcactctcaaaattatccgctccctcttgtcttaagccttcagtgcaactctagcctattcttgctagtcaaacctttgaaatataaggagaactgatattcccttatactgttgcccttaaaattcatggggtttagtaatatatatttctattaatgggttttggtaatacatattctggtagaaattcagtaatagtaaaattgaaacctaccataaaaactgtggtcttaattaccaagccatttagaggaatttgtctttaacataaaggtatagcatattgcttggactaatagaatcatagacctgtaactactacaactctagatccttggttgtcggagaccttagaactctggggcctattttgctgcaccattttcacaggatttgcattgtagtggcttcaaaatatactcaccacttcctcccgcttggtcttgtctgttgatggccaagcttccagagtcagatcaggaagcatgggaggcaggggctgcatggggaacatcggaggcagaggtggctgtggcggcaggggctgcatggggtgcacaggtggctggggctgcatgggctggtgaggctgtggctgaacaggctggggctggtagggctgctgggcgggcggagggaggtttggctggtggtgttggattggagtcatggagtgttggccaggaacgggcatcattggttgctgggggatcacgggctgctgagctggcaccactgggatgtggtgatgaggctgcagggtgtgagtcggggggtgctgttgggacagcacggggatgatttggtggtgcagccatccacccatgggctcgtaaccataggaagggtactggtgagaaacagagaggcaggtttaccattggctcaggtgactccaaccagagaagcagcagtgttttctttgccattatggctataggaatattttattcatttttcctttgcaaaaatttgtaactgtgtacacagatatgattttttacaaactaaatttcccattaatgtctgcatgtggagtagacatgatatttcacttaatatgggaattttaatgcatgcctaatattttcagggaataaggaacaaaatgtctacataccggtggccttatgctctggtaccacttcaaaggggtaagcaccttaagagaaaaagatattagaacccatttgatttaatttactttcatccaatatagaaactcactgatgcagtaggaaatatagactcactaatgcagtcctgtcaacattgatagcctgagaatgtgagttctacaaaagaaagaagaaggtaaaaatttgttgggtgcttcctgtgtgacaggcactgtgtttacatccatcacacacattcttcatcttttcttatatgctaggaggcaagtattattactctcactttttagataaggttatggggagttaaagagattcattaacttgactgaggttacacagggagtaaatctgtttaattccatagttccttcttttcattgtaagagcaaaacaaacacaaaattatgacataataatatgacatgatgttaatttcatttttttctttgatgtcacaatgggaaaaagagaggtgcaaacactgtccctcatcctagaaacacagattgactgatcagatgtgtcaatcttttcggttcaacagaaaatcttgcctcaaaatcttactaacatttgtcttcagcttttataagtaaataaactcatagattgttacctgaacctgtgagagaagtaagaatcttattcctttctgaacagtatatatacttggttagccttaggtttgaggattcttcatatagtaatacggcatttaatcgatacaaaaaataatcagtaaccttgctcatattatacttgacaaagcacttttcatattcattaactatattactctccaaacaatattttgaaatatggttattataattatttcctttctccagatgaggaaaccagggttccagaaagaggaaatgatttgcccaaaatcacaaagttagtaagaggttgaggagaacctcaaacccgacgtccaaaactcatgcattccgctgttctgcggagtctctcctataccacttagtcactaatatttcagcagaggcaagcaagagacacacatagagtgtgactatcttagaatcaggagttttttgagctggaaagagttttaaataacatcttacctaatccttacattttactagctgggttagaaccaagctggtcagagtttactttttgccctatcatggagcctccctgagtagtggttcatgatgggtaagcttacggccatatttaggaggacagactgagtcagagtggccaggcgggaggctgctgggacgacacaggcttgaggccaaccatcagagcttaaactgggaagctggtggtaggaactgtaaaatcaggaccacttgagaaacatctgggataaagaatcaacacactattctttacagagcccagggcattgttaacgcaaacaatggtcaaaattagtaaagagaaaaattacctcatagctgaagttgatataaccagggtgcccaggatgaggtggtagcttttacagggaggaggggaggagaatagaaagagagaggaagggagagagtgaaggaagagaagagagaggaagagattaagtcagtatgcaattgttcacattaaaggagactgaagctactttaaaaaaatctatatagtgcagaatatacttgaggtctgtttttagtttgaacaaatgtgctgtatagaagaggagaccttttattttaaagaggttcagaacagctaaatgactgttcctggggttatagccttatggctggagacctggaagcagaaaccagcacacatttattctccagtgatctttggacagcatcccacccccacgcccagtgttttcaatgaatcctaccctatcctgcccaacagtttacttgctgataaaactcaccccataatggggagagaagtgtgtttctctttcacaataaagaaatatcaacaaggagagaattgtctcacgaatgttcccttgtagatcaggaggtggtcaagtacttttaagtatcaaagggatttctcataattgacatgcaaagtaaacaacacttccatacaacaaaagaagccacaaaagaaaccacaaggtgggaattattgatgaatgccagaacaagatgggtggagcaaagtggaaacattataaatcccatggaaaatgaaagagttgatttatgacgtttaggccgatctttttttattattctgccaacggttttatggcagaaaaattttcaagttaaaaataaaaggccacctgaatgatgatctgaatcaggactgtctgtcctctcaaaagtggggcccaagtgtctggtgcctgtattgtggaactctggttgtgcctggggtccagggaggagagacggtcatgcagaaaatctccctcagacattggcctcatttaggattggctctattatattctttaaaaatgctcacatttcatgggaaggtttattctctctcatctggatgtgaatggttttagtcaggtcctataccctcttgaacaataccatcttagagagtgggaaaagggctgaatttgtaaggcagggacccctgaggaaactaggaatcgctgcaatgcaggatttcaggaagtcagagcacagaatcttggttttgtgggtgagagaggaagagaggaggcaagggtgcaagcttgctggcttctggttgtatcaactgctctttattccaccaaaaagcagatgcagcctgcttggcatgcatgtgatctaagttctctgcccttatgcacctgtgtccagacagagtgggtctaatgtcctgatctttaatacatttgaatataaaatatatcactatgtattgggtgtaggcaggatcccgggcaaccacaaaaaagtcacgtactcatcagatgtacccaaaggggtggggcctctgagaacaggaatgtggctcaaaaagtggattcctaacacaaaaatcttaccccctgaggggtaagagcagcaatatgtggagggcaggaagagatttggaatcttgagaggaattgggttttagacaaaactggcatctctgtaatatttgtccaaagctggttaagcactttctctggagacctttcaagggtcccttccaaaagcttcctccatctagagatgggtggtgatatttacaagctaacagttccaacagaatctcctggggtgcttataaaaatgcagagtcctgggccccgccccagctgtaccaaatcagaatttttggtagcggcatttgagaatatacctttttaaaacaagctcctgaagtgtttcttcaacccagagacatatgaagacatctgatctcatactgttttaaaccctaatttcaccaactatgagcagatttttatgtccaagtttgtgaaattggacactgacttatgcaaggggtgttttactcacaggcatggcaaaagctgctcccaggaggcaggcaaataaaatccaggtccccatttcttgatggttctgaaatgtaagtcaacatccacttttcttatctcttctgaaacatggatgtaatgaatgctccataaaacacacataatctacattagtctattgctagtaagaaggatggagccattgtttgtgaatttacttcagtcatatgtgatttccagctctcagcctatttcattgtttctggagtcacagtagtgataaagatgcatttaatttaggttgagggctaaacaagttacagggacatgaatgatctatcttcatatgactttgcatgccattttcctatgcctatacagcccttagtcatagaagctaaattgtatttataattaatgattaaaggaataaagttggctctaaaggttgggaagatcatcaaagtgcacagtattttataattttagaacaaggaggcacagaaatgtctcgtgcacagtctacctggacattgctactgttaaaaacaaggactaatcatttgagaaaatatattaatttgccaagatagattttagttccagaaattcctatctacagaacttcaggcaagaccctccagtaacatctctgagctccagattgtggagcaaaagatgtggctgaaccaacaggagaggatggtacgaattttatgtgattcttcaatgaattttgaatactttctccctaagaggtttcattttctttcaatggaatcttcattttgtttgatgttgcactgtaattattctataaataagacccttgggacattaagcaaaacaggtcctcctaaaatgtgcacattgatttgtggcacaaattactgggaaaactgtcagaagaaagaccttaaattttgtataagaagtgaatattacatgtgataatgctgtctatgaaaagtacactaaagttttctaactcctaaatttgttttttgtttgtttgtttgtttgggttaatgagaaaaaacacttcatggatggttctattttatgtaattaaataaaaagcttttcaaagtagtagatcacagcctgtgaatgtattatttttactttaatcgataattaattaaaataaatattttactgtgaaatgtggccaagaaagacctttggaattagacaagcactttgttgcattataaagttaaaaatcatttcagtaatcagagtctaatttaattatgggccaactaaaaagtaactattgatggcatatagtattagaaatgtagaatacatttatatcttttaaaagaaatgcagagaaagaaataagcacaataaaaaggatatcaaattataaataaaatccacatacctttgaatgtattcagtgcaagtttctgtttgaaactcagggatgcttgatcctttagatttcttccaactataagctcaatttatatcattcatggcatctgtaacaaccaatccagtttctaaaggaaaaatgtgttgagtataactaaaaatccctgtatcatgattttttagaagctatgatcagacataaggctgtatgttgtgattagtgcatatggaatctttcattatgggcaataataggtttaacaggcaaagagtttcatcacgctattttgaagtcagcaaattagttgactgtacatgttgatatattcagatttatttttaaaaagcttctctgccatcgccttttcctcagttctagcaaacaacgttgttctttacaaaaatcaaggtaggtggttgagattctctagtgtaatctggatatcctccaggatttttccagccctttcagatcaggagaaattgattcaaattcccatttgggtaaaaccccaaagctctctctagtttctctctgaggaattataattttgggatcaccactgctctattatctgcttccattgaaggtattttttctctgttccccttggctactcctttatcacccctctggtgtccaccaaaacaggggacaaagccccttctcggccccatgctgaaacccatctaccgtaaaaacaatcaggaacttaaggttcttgcagtagcaaagcttttactgatgatctatactacaaggcaaggagtgcacaccagacagcacattttaaagtaaattttgttttttacaagcaaactcatgtcacaggggatgttgtcctttgcctcccatctcacagagcagcttggcctctcagtatggcggcccttctttgcccatatccttctggcccaatcccactttctcatacaggcaaacccaaattcctctctatttttcagagtctcttaactgtctggctagctactttgtttccatgttctcagcagcctcccctttccctaagcaatgaccaaagctattcactttctaaaagaacctctgatcatctacctattaaattcatgtgtgttttacccctctaccttggtataacacatgggctttttctttcattctggaatttgattagattgatctaattgagcaaagttgtaattagtggcaggagctaactgacgagtcgtccatcaatattagatcaataaaggagatactgaatatctacccagatacagttgatgttatacttggatctctttgaatacacaagtaatacttataaagtttgtatatatacatatgtttatacgtatatatacaaattacttagcctgtctgagcctcaatttcctgatatgtagaatggaaataataacagaacctagctcagggaattcatgtgaaaagtagatgagtgacatctctggggaaatggaagtctatttattactctccccaaccctgtcagctggcatacagtaaatgtttaaagaatgctaataaacaagattccaagatgatctttggggataaatcagtagggatgaatattgcaaagaaaggtaagaccttccaatcagggagagagagattgcaaagaaggaagtagaagattataacaggtaaaatgtatgcatgaaaagaaacatagaatatgattctaaaagccaaatgtccccaggatttggctttatttatgaatatatttattggtgaattttatagcagagacaagaaggattccctttgaaggaagttggaaaatggaccttaggaggattggcaggggtgtacagcaaggtggtaagggagaggaaggaaaatgtggatcacattttattcactttcaatctttttcccccattttatataattacatatattggagtgtctgaaaggattcaggatattttttttttctacaaagttgtgggtaatctctactaatgaagtcaatgatgaattactagtagccttgtagttttagaaagattgatcttatactttttctcaccttctaagaatgagaggatgatatatttggccataatgatcaacaggatgctgccttaatgtggcattaattcctctggaccactggatagtgagttaccgctaattcaccatggacagttgaacaagctttgatggccgattccatagaaataattgattttcccctactgcatatcctgaatcataggacattaaaatatggatctctgtttgaaatctcttccactaatttaggccccacttacacagcttaaaaattggtaaatgttttgaggaaaatgaaatttcaattgaaatatttttcctataagcaattattttatttatgaataaattgactgcataaaatagttcttttgctcatttttttgtagtaggtattctttttcttgacttgcagcccagtacgttttgctgttctcacaatgcttatgttagcaacttccccacttctaatttgctgcttctaatttacagtatgctagaaaatcatatgcccaagcttgttaaaagtatgcgtgaactgaaagtaaaggaacactctaagtggggctggcctgggagggcctcgcctgtgagaaaagcaaatgaatttcggttttgtgacacttatttttgactgctgggagggtgtttggtttgttttggggttcctctccactggcttactgcctgggtttcaacagcactcggggtatgagggtggcctttggataagtcaggtattatgagtttgcaaagcctttcctatcatctgtaagagttcaactcttgagccttcttttaaagcatccccagggttatccaatattctggaataatttcaacagtgagtcttcttaagtagctggagccaaagctggcttttaaatattttctctgtagatgtttacttacaagaaaacatcattctctaggatagcttttttttttttttttttgctggggtagagttggagttgtatgatcttcagatcttaggcacaaaaccaccgatgaattccgatacacatcgtaactttgaccccaccgcaacccttagaaatcaggtattgtgtcttatactttcttgggagctccttggtacctagaaaaagctcttatacaaagtaggtgctagataaatgtgttgatgaattaatgaaaatgtagaaaagttttccatgacattgtaaacatagaaaatgtggattctgaaagaaatcctacagtgatttagatggaccttttcaatagctaagatggataattcagcattgctctcaactgctcctgtggacttctgtgcaaatgacctctgataagtatctgaaaagggagatgctgtaaaagcgctagaatctattatcctaacagtctcattacatttggctctgacctcttagttcaaattataatatactccaaacaaatacactatgatagataattttttgttgttgtttttgagacagagtctcgctctgtcgcccaggctggagtgaagtggtacagtctcggctcgctgcaatctctgcctcccgggtttaagtgactctcctgcctcagcctcccaagtagctgggattacaggcacatgccaccatgcccagcttatttttatatttttagtagagacggggtttcaccatgttgtccaggatggtctccatctcctgacctcatgatctgcctgcctcggcctcccaaagtgctgggattacaggcatgagccactgcgcctggcctatgaagtaacatttaaaacaaaatgtctaccaatagcggggctggttcaaatcgattatggcacaaatagcattcaagatgaggatgtcactctgcgtttgtcaacataaaaagatgttggtgatacattgttaagtggaaaaatagattttttaaagtccccttctctaatttttttctccctccctccctgctctcccttctctccatttggggagatattcgccaaaacacagtagttatctagggactccttgaaaatctctgggtagccgaggtttaaatttatttcttttaaataatctgtgaatgcaacaaatgcaggggaaatacgagaagtttggagtatgatatttctcactcatgttcagcaagagagatgagtaagtgatagtgctacttgcataggccctgggtatatccaatgttcattcttagggggaaaaaaggttcaacataaaatccaagacaaaaaaaaacacacgattttttaaagtgagagagcccttttaaatcatgagtaggaaatattttaataatataaacattcacagcaagagttcatacagcttgtaatttgaaaagtccgtaggcatttgctaaatatcaggtggaacaattttcaacaagggaaattatatgcagttgaagagtgtgttgtttggattataattaactggtaactgtcaggagtgaaaatggtacatctgtgttaaaagaggtaggacagtaatgtaaaaacaagcatttttattcctgtttattgggtaaaatataccaaagtaagttcaactttcctgctgaggttcagtggagacatacatagattagtagttttttaaaatattgttcagccataaaatggaatgaagcactgatccatacagcaacatggatgaaccttgaaaacattacattcagtgaaggaagccagtcataaaataccatatactgtatgactgtataggaaatgccaagaataggcaaaatccatagaaacagaaagtagattcatggttgccaggggttgagggaagggggaaatggggagttactgctaatgagccccaggtttctttttgtgatgatagaaatgttctggagttagacagtggtgatggttgcacaatcttgtgaatatactaaaagccactcaattgtacactttaaagtggtgaatcttatggtatgtgaattatatcttaatttttaaaaggacacatattatatatggtatgatatcggccctcaaaaaatgtacagcctttatacattatgtaaaatatagattaaaaggctaaacacggtgtaatggtacagaacaatagtgtaagtgttgccccacgatgataaagttgatgatgacgactatgatgaagatgaaactaacctttattgccagccatggttctaagcatttaacatgtttaaatgtttattggtcacctcccgcatgccgggtatattctgggtttatgttttacatcagtgattaaaacacacaaagactcctactcacagtctcacagaaagcaactatgaacaatggatataataaataaggacagcagaagagaaagcctatggaaaaggaaaaagtagagcagctaagaaggattagacgtgctgagttgcacgtttcaatagggtggtcagttttaaacaatttcttgaagaaggtgaggtgttcgcctgagcatctctgggatcagcacaaaggcaccagcatggaagtggcccagtgtgttagctagctggcaggaacccagcactgctggtgtggtgcaaggtggagggcataagaggagctgaaggccaaaaggtgacatcttctcatgcttccatgatcttagcaattaaatgtagaattccttgcctaaaataattctattgttcattgtgtgccaggggcttcaggctttggagatgtgaaggatttggatagacatagaggctatttcctcacagggctgagtcattggaagaaagagaaacgggaatgggcagagcatgcttggtgtgcagaaaaagaccagctaggcagcagcagaggttttaggtagaaaaagggcaatggcagatgggctgttgggaacagagagaccctgaatgttggacagggaaatccacttgtgtcccctctgcagtggcaaagcactgagcatttgtatccactgtccttgcttgctagggtttctacaagaaagttcgtctggaagctcagacttgtgtcaagaatgagaaggtagaaacacaaagcaatcagatgacttggctgtcttcacatcacattgagagtcagagcagacgcaagacccctgggctctggccctggctcagacactcttcacccacttgctcacagatgaatgaggcataccttggggccccagatcaaatgataacattataagaacaactggaaatagataagtctttaaaaatacagaacataatgtttttcctgtgaaatatagggttgcattcaaaaactgttaccagagaatattctccagagaaacctacagctattcaaaactgctctacaatataagctcttgtttagtaagaaataaaagctatttaatgaaaggtctataaaaacggatttaataacttaatacataattatatgctataaagttcatgtgttgaaagggtacacttgagtgggttttagtatatttttaatgtatttacaaagtttgccaccatcaccatagtctagttctagaacattttcatcacctgaaaagaaatcccatacccagtaacagtgaattcccattctcctccccttagcacaagacaactaccaatctatttcctgtgtctatggatttgcttatttggtacatttcatagaaatagagtcatacaacatatggttggaaaatgtgtctctgagaacctctacaaaaaggtttgtcggtgttagcactcttggcatttggggccagataattatttgctgagggatgtttagcagcatccctggcctctaccttctaggtgttagcagcaacaaccctcgctcttaagttgtgactaaccaaaagtgtctccggacatcgcatatgtttgatgggggagtgagggggcaaattcgcccctagttgaaacccacagatttacagttacctaagaactgagctgggtgtaggggtgtataaagtgaggtgggtgcctggacccagggtgctgttgtggaaagacaactatttcagggtctgtgaaggtccaaagtttgtaccccaagttccaaaactctgtgattcattttagcaaataggaaagagatgactaggggcaagaggcacaactgttatttagatgaagttattgttcaaacaatagctggtggggaaaaacactcattttttcggtcactaaaaaagatagagggtgatgggtgcaccaaaatctcacaaatcaccactaaagaacttattcatgtaaccaaatatcacctgttccccaaaaacctatggaaataaaaagacattttaaaagatagaaattgttattttaaaataaaattcaatagtatatgccagtggtctttaccttccttataaaggactggaatcatggtgtcaataattcaaaaagtgtctaaatttggatttgggctgttttatgttacaacagtaagaattaatggttctcaaagagccttacttaagtcagctttaacattactctgcagactataaacaccccttgagcagcaaaaggaagcatgaaatttgatttataccgtagctaacgaaaacaagtgggcaatcacaatttgatcataccctactaatctaatttagtctcaggaatggactaaaaagaggaagcttgtggactttagaaatatgtacatttcagaaaatataagtgtgacctcttttcttttcagaattgtgtaagtgaaggaagctgtcatcctccctggtaaatccatttgtaaataaacgggctaaagaaatcatgactgtggtcctttctagttcttaggatctgtcctgctcagagtgggaatcacaaagtgattgaggtaataactggtatctttgttgttctcagtttaaaggaagtgttctctcaaactgccttagactgcgcagccttgaccctctaggacttgatgccctgtgtatggcattgttatcagatgcaagttagtaaacccagattgtgtttacaagtaggttgtcattatacagtggcttctctgtaagtacaaaatgtatatttcctttttatttatcatggactatagcaattacagaatgtagctcttgtttttatcagggatattactgaggcccttaaactcaagctgacttacatttattttaaaatacatgttccaaagatgtttttaaaattttaaatatgcatatttttaagattttcccctttaacctgttctcccatcctgacatttaggatggggaatagacagaacatctgagggagtttgggtctcacagatcggctgtaaaattgagtaagagcaaaatgtttggaaaaaaaaaaaaaaaacaatctgtgtggttgttcatctggaaagatctgttccccactcagtagcttacagaaggctcaacatgatatggatcagctcgaattcattatctgaccaaacagcaactcaggaatcttatgtcctgtccaaggtgtgctgtgggactcaataatctctttccagatctattatatctacataaaaatatgcatgagaatcagataaactagtgggcctcaaccaggaatgattgtgcccttcagggtacattttataatatttggaagcatttttggttgtcacaattggaggatacggatgttcctggcatctagtgggtagaggccagagatgctgttaaatattctacaatgcacaggaaagccccccaaataaagaattatccaaccccaaatgtcagtagcattgaagttgggaaatcttgttcaaggaaattcccagtgcctcaggttgtcttatgagatgtggagcatgtcaatatccacagttgccagttgtgccatatggaatgctgcaaggagaaaatatagatacacatgaaaatgtgtttttgggatttggggaaatacatctatggatttgatactttggtgttccaaagatgtggctatttttgcccacaagtgttgcccaaaaccctggggctatgtggtgcctttttcacagagcaagtacataaagtacagactgttaaacagatcactcacctgctataaaatgtcagttaataatgaggtcctatcatggatattagttgaatgataagtgccacttctttcctcttacatgtttattagtgtcatctaaagcaatggctctcaaaatgtggtggctggaccagcagcattggtatcacctgggaacttgttagaaatgcacattgtcagccccctcccacacctactgaatctgaaacttttggggtagggcccagcaatctgtgttattttaacaagcttccccatgattctgatgaactttaatgcttaaatcggagaactgttggggaccaccagcacctgggagcttgctagaaatcacatgactaggccaggaccttgttgaaaggcagattctcatttagtaggcctgagaaagggatcaagatttgggactacagatatgatagcttgggtaaaaactacaaaatttctcctttttgagccttctatttccctcttcaaaaattgggaagacattgtattggttccctgttgctgctataataaataatcacaaacttagtcgcttaaaacaacacaaatttattatcttacacttccagaggtcagaagtctgaaatgggtctcactgggctaaaatcatggtacctggtgactgtaggggagaatcatttttcttgacttttccattttctagaggctgcccacattccttggctcatgtttccttcctccatcttcaaagccagaaatggcctggtgagtctttctcatatcacatcactctgacactgacccttctgcctccctgttccacatttaagttgctcctgtgatgatattagtcccatatacataattcaggacaatctccttattttaacagcatatgattagcaacattaatcccatctgcaactttaactcctctttgccaggtagcataacatattcacatattcttgagatttggatgtggacatattttggggggcattattctgcttcctacacaaataattttacctttattctccagcaaaatttgtgtcatagagaaaaatcttggaaggaatccagtcaggaccaatctcctaccaattcagaaatcttcctgcaaaatcctccaaacttggccatgtgatactagcttctcagctagactgtaagctgtatcctacagaagaccctatcttatagttattctccatctcctcagtgcctagaagagaatttagctcataatagatacttagaaaacattctttgattggtacactgctttcaggcacatagagcacgatatgactatatagactgtggaatcttgactttgtgaaactgagggattgatgctgaatctctgtcaagccttattaccctcctgtgtaaaatggggataatattacattctgtataggattgttgttggaatcaaatgaaatgttgtaaatagagcacatggagatatagatataatttacatgaaacgtctgaaaccataacatggtagaatactaccttgtgataatttgctaacaaaactgcacaagataaggacaggtggtattgagtctctttacataatgcttactgaagtgtcgcctctggcttcatttataacatcaatttagaagcagtgtttctcaacatagactatatttttgaaccattcgtgtagcttttaaataatatttttgcctgggttccattctacctagtttctgatttacttggtctaagcattggctccaactcttgctatgtttttgaatcccctggggaagcttttataaatatcgatggccaggtgccacctccagaaattctgtttcgatcaaatataatgtgtagccatggttgagatccattgaacacaacttattctaccttataaattgttacatctgccagacctttactgtatatgagaagttgtagttttatcaactttgcctgaatcagtggatgtttttctaatttccattcaatgtcattggtggaattaagaacactcaacataatgacatttgcaattataaaggtggtatcacatccccagagttttagcaggatggcagaaccacagtgagcactcagaaaacgtttgctaatgatgggccaaaaaaaagtgtcttttatggtctcttgatttattcaggaatattgcattgcagttgagtctctcacagagtccacttgaggctgctaacatgttgatttaatgaatgggtgcatttcatgaaccacccatccgagtgaattactttgggtgtagctgttttgatttttccttcctctgagtatatggttttgttaatttaaacaaattcagttgttttaccattttgtagacacattctttgtgtggccaagaatcttgtttgtggtggccacaccacaactggatttgaatgtagagcaacccagcaaagaagtgctaatttgaagcaattgttaacattgccagcaacaaaccaaagtgacctccatcaatgggttcagttagcaaccctgaaggcaagacactctgtttattccattatcgtttccttcatctatcagaaaccctaatcttcatggatgatgaaataataacaatctcaaacttaagatatattttgttcatcttaattttctaaatgtccttttttcccctcagtacaaacataatacatgtaaataaattccaacactataaaaattcattaggcagtgtcaaagtcccacaaatcccatcctccagtgatggccactaataaccatttgagaatatataaccccagatctccctgttaaattataataaacatttatgtccataacttgtgttctgcaacttctttgtttaactttacatatagtggatatctttccaaatttattcagagagaactactccactttttttcatgactgcccagaattccactgaatagataccccgtagtttagttagccagttgctcactgatggacacttaggttttttatgtttctttaaacatatatgcatataactaatatataataaaattaattatatataagtattaatatatatattttggtagattataatacacatgtagagaagtgcacataagtttacaacttaatgaatttctgcaaagtgaacacacctgtgccagatggagaaccatccctgaccagcacctcacagggatcccttggactcccttccagtcacttctccccaaaggtaacccctattctgtatttttgtagcatatattggttttatctggttttatagattacattactggtatcctacagcatgttattttttatgtcagacttctttcgctcaacgtgatgtctctgggattcatctgtattgttgtaggtggttggagtttgttttttcattcccattactgcatagttttccattatgtgatataccacaatttattcagtctactttcacgaacatttggataatttacagttcggggctgttttgaataatgctgctatgaacattctagcacacatattttggtgaacatatgctcacatttccgttgtttttattggtgactgggtttttttgctatcagatattgtactgaagtgaatgtctttgcaaatgtatcttgcacattttgcaagtattgctataaagtagatattagaattgctgggtcaaatggtattcacagaactgctccgaaaaaaattttgattttttttttttttttttttgagacaaggtcttgctctgtcgcccaggctggagtgcagtggtacaatcatgtcttgactgcagcctcgaaatcctggactcaagcagtcctcccatctcagcctcccaaagtgctgggattccagatgtgagccaccatgcctggcctaaatattttgacttttaagctaggtctggacctcaagtaacctattgtggatacacccctttgctattaccattatctgtgacacagacgctgctattgtgtcttcctgactacaaggcaagactaacaaaaaccagaatcttctggctcttttcagtcacgctctagtgagctagtgcctctttcatgtatccactgagggacaaaaagataaaatgacctagtgtcccaggatgccagcttaaacttttgagtacattgatgctatgataatatacaccaaatggactctgtggctctaagtaccatccactccagattgagataacctcctttcccaagtagagaaagaagattctaacctggaggtgagagccatttgcatgtcttaccaaaaaatgtcccattcagaatgagctgacattgggagacattaggttagagcagtgtttcccaaccttggaactgttgacatttagggtgggatcattctttgctgtgggggccgttctgtgcactgtaggatgttgagaagcatccctggactccacccatcacaactggcactttcctcctcagttgtgacaaccaaaaatgtctccaggcaatggcaaatgtcccttgaggggcagaatcaccccagtagaggactactaagctagtgcttatagaagaccccagctctaaatcagattatgttcagattctggctcagccactttttatgtgacctaggacaaagtacctaagttctctgcctcatttggctcatctgttaaatatagatattaatagtaatatttacctcaattggttgttgttgagattaaatgagattattaatgtgatgcacttggcatagtctttggcaaaaaaataagtgtcgaaagttgttaggtttattagtcataatctttattattattaaaaaaaaatggaggggtggaagaaggggtcccattgtgtatcctggaaaaaggatgaggataatgcatatctgaaaaaacatcaaaggacaaggggctcataactcttggaacacaggcaatgggaaatggaaatgtggagaaaacattaagtgctatgatggaagacaatggcatttggttgtctctctctgttccttctcaagttaacatttggaaactagaatttgtggaaaatagactttggcagcagaattaggcatttttaggaacaggataaatcactgtggggaaatattttattgtattactcttgttaatatgaagttattaaactttcaatagtgtgttgaatgcttttatcttaaataataaaatatattcagtgctaaagcagctgtattgtttttgatattattaagtagaaaaatttatctgttaggagctttgttgggttgattttcacctgataccctcttctcccaccaaagatctaactttcataaattctggcaatagaaaaacaagtcatcatgttaagctaggtctgaaccttaagaaacacactgtggctgcatccctttgttattgccattatctgtgatgcagatacagcaagacagagtggcatcctggacgggactccagatggagagtatgagtccagggttatgtctttgtgttgccaagctgcaccttggcttgtcacttcttcccattgtgcctcaggttctgagcagatggaattagtttagcatgtcccaactatattctggggaattcgagtgatatggagagatggtctgaaaattaaaaaaaaataaaaaatagaaggaggtgagattatagcaagtgtatttaggaggtactccgagttatgatttcccctctgcaggacttctctattattcttattgtttattgtgactacttaagttgaagctaccatgcacaactttttcaaatatatttgattatggaacagcttggaaaatcctgcattaaataatgtatgtgtcccttgcaggcataaaaatattctgatttcttttgaattaatctgtcatcatggctgtgacaaattaccataaatttagtgccatgaaacaatacacatttattatcttaaagtgctgtaggttagaaatctgacacaggttgcactggacaaaaatcaaggtgttgacagagctgcatttcttctggaggctctaaaaccacccacactccttagctcatggcccccttcctccagcttcaaggccagcaatattacatctcttagatcattattctatagtcacatcttcctcaaactctgaattctgctgaaaggggttgtcctattttaagggcctgtgtggttacgttgggcccacctggataatctagacttctgtccccctctcaaggttattaacttaatcatatgggcaaagtcccttttgccatgtaaggtaacacattcccaggttccagaaatcagggtgtggaaaccttaggggtgagagatattattctgcactacctatcctagtggcttcttccatttctcaaccctggagggtgtggggtcgtgttctgtagagccaggaagaagttcagcatttgttcatctgcttttgaccctagcaactcatgaaatgtgcaatgactatcttgtaaggggtattaaattcttctggcttttcctcacccagtaagcaataaaatcaaagaggacaagagtaattaaagcaagcctattgatctattttgtgtagcattctttttagcttctcttctgatataggcaagaatatctccctgaaaggaactaaactctgaactgtactttaacaagtaaaattgccatgctggatatcaacaattagtctttagagttaaaatataaacataaatgattaaattagttaatctactctttgtggtatagccattacagggctaatttttttttaaaaaaaaaaagaatactagaaacctctaaatttttcaagacactcatattcatcagactgtaaaaagcaaaagaaactgaaggattgtgttccttatcacagcttggaaaaagctctgatggctgatctatatgaagtggaaacattgcatgagttttcttgtaattgttgatatctcatgtgaatggaatgaggcggaaaacaagttttgcactaaaataagtgtttgaatcttgctatttggagtcatgttgtctacgttttttttttttgtttttggctacatagttaccatatgatccagcaattccacttctagttatatacccaaaatcattgaaaacctacgttcacacaaagtgtgtatgaatattcacagcagctttattcataccagtcaaaatgtggaaagaacccaaatgcccatcaactgaagaatggacaagcaaaatttagtatatctatacagtgaatattatcctgccataagaatgaatgaagtaatgacacatgctacaacgtggatgaactccaaaaacatgctaagtgaaagaaaccagacacaaaaagcccacatattatatgattctacttttatattaaatgtcaaaaacatgcaaaaccatagagacagaaagtagattagtggttcccaggggctggggtgagaggggaatggggagtgactgggtatgggctttccttttggtgtgatgaaaatgttttggaatcagtgatgatggttgtacactatctatgagtatactaaaaagaaacacagaactatacactttaaagtggtaacttttatggcatatgatttttatgtccaagctcttctattattttactataatttatttttgaaaatgtaaatttcaatatgcttcattgctcagagaaagcatgattttctatacatcagagcaaaagtatttacacaggtctgtgaaatactgtgtaatttatcattttaaaagtcgtatattgaggagaaaacatttttgaaaaataaatctgaaaagtggcagctagaaaatcagatgtgaaccagtaagtgcagatggcttgttttcacgtcatacctgcatttggtgtcatacttcatgttggtttctcccttttcaattttcccttttacatgtttgtctcttaatactaaaagtcaggaagcaagattttcttttttttgcatttttactggaagtgattttagctactttaaaataaatgtcctaaatataaatattccctgctggtcttgtttccatgctaatagacagaaatgattttctgtatagacagaattgctactctccttcaaattttctttcaaccagcaaatatacaaaagcacaaaatgttagtgctgtttctattcttccagaacctacagtctagccagggagaaaaggcacaaatatagataatcaaatagctttccaatgtttaaataagagtcaagaaaatagctgagatggggcagggtcggggggagatgagtgtgatggttacataggagggacgtatcggtgacgttagagttttctggaaaaatagctgacatttaaacattcccacccctcctctttcctccctcaatgagacatcacaagtgattgtctagacatctcaagtgtctaggtcatttggaaccttgaaagaagcagattcgccttctttaacaaacataaggtgaatttcctttggtcatgttttggtgttccttataggtccatagtaaacttgtttgtgttttagatggtatgattttcttgttaatgtgatgattcatttgtaatgtccctgtagggggacgacagggcttctcagaggaggtgatgctcagtaagcattacagggtgagtaggaaggcatggggaagccatttgggctgagagcacccctcaccctaaccatgaagtcctctgggctcttccatgtggctgaaattaagggatgtgaagtaagtgaggcttggtgaagcccaagagctaagcagtggccagatcttgagcgatcttgtgttttcacctcagagttgagaacttcatctggaaagctaggagcctcaatgatggctttcaaaagggaagggacaagatgagttttgctttgtagggagagacagcctacaagagtgtggaagtgctggtggacattcccagagaggaagtgttaaaggaaaggacagtttttaatgaggtgggatccacagaaactggtgactttctgagtgtgagtaggagagacataggaagcaatgttaaaaatgattttgcttcagttttcctgggtcactgcagggaacccatactgatgtatttgaaccacagaatcattgcccctaattttattgtgtgtattttcaaataattggtttacttaaagcaagatgcatttgcatacgtaccctttacccactgtgtattatcacatacctattataaatatttgtctatataagatagaaatatgtcacatatataattcatcatataataaatatataatagtcaagagatacatatagatacacatagatgtagagatagttaaatctatttaatatggagacaaatctataatgtttgtagtttttaattacaagtttctcaggccggccatagtggatttgataggcatcactctagtatgaatgtcttttctttcgagaatacttggaagaaatgctgattcctaataagtagctcataccaaatactaaagtccatgctactgatttcactttttctccctgagctttttctcattatgtgcgtaaaagaaaattagacattgagtgatctctgtggacccatctgctcatacatacagagatgtcacaaacatagttttaaaaacatgtggttcctggacacaggaaggggagcaacacacactgggtcctgtccggtggtggggttgggggagggagagcatcaggataaatagctaatacatgctgggcttaatacctaggtgatgggttgataggtacagcaaaccaccatgtcacatgtttacctatgtaacaaacctgcacatcctgcacatgtaccctggaacttaaaattaattaaaaaaagaaacagaaaaaaaatgtggttcctttgctgtttgaaatagtgaaatgctccaccatgaaatgtgaacattgtcatcccctatgtcatatatctggtgatttcttttcagtgggtccagatctggggtcggcaaactttttctgtaaagaatcagatagaaaacattttaggtgttgcggatcatactgtctgtgttgcaactactcaactttgctgttgtatcggaaaagcagccacagacaataggtaaatgagtgggtgtggttgttttccaataaaatttgattacaaaaataggccttaggctgtcctttgctgaccctgctttaagtcaacagttgccacctcaaggtcaaggcatgcctcagtcaatgtgttagaagtaatttattacctataataattaagttacaaactttagaatatttgtaagaaaactaaatgagagagaattagagatgagcctagaaccacctcatacagttattttgatgaattttcttgagtaggagagcaaggtgcagaaaagtagcataggatagtggttaagaccacaaactcaggactaaggtccctgagtttgaatttcagccatgccacttgcaatatgtgtcctgggacaagttacttgactgccctgtgctttgatttcttcatctataaaatgggcatattaataaacctcacattttaagattgtttaatgattaaaaccatgagtacaccataagggactggaataataatgggtacacactatatgtacaagagatgatagtcattccccacatatctaaatcttttggatttagatccaggacatagctctcagcttattttatctgtgctgtgagtcactgatgaataatccttactgtgcaccactaattagtagttgtggtgactacaaatttttatgttgctaatgggttgtaattttgtagtttctgaggttaaaaaaaaaatctacccatagatggatacttaacaagaaagaagcagcaaaactctgtgtagaaaatgtgaacgtgcacaaatcagtaatgcccatgagtgaaaatgacatgggaacatgttgttagggtacaacagttaaaattaccaaaaggtcaacaaagcgattatgtacttgaacattggacatcatgttctttatgttcatatcactgaattctggaattctgagtctactggttttttttttttacaaatgaaataaaatgtagctatgtttacagcatacccttccttgtccatcctattaatattaactggtggcatggaagtcaagaaaaatgactcattaaaataaaaatttttaataatttttaaaaatcagattaccatataattgatttttttgtaactgttttcaaaatggtcttcatattgccacgttaatttatcaaatacttggaacatgcttttagggatttcatgactttctccttcaaaagttggccccgctatttgctttatttaccaaaaaaaaagggtgaggtttggggaggggtgtagggaaaaagcaatcaaaacctgggtctatcagcgcatgtgacacgttcatttatcataagtgttacatgcatagctctctcctccctacaggactattttatctccactttacagagcaggtaattgaggcttaaaagcgttggatactcacatggctagttatatgctgaacttgaattcaaacacaggcagccagaaggagagtcctccctgtaaccactgtgctataacactgcatcccatttgaatgaaacagtggcaaaatgaacagataagatgaaagctgcttaactgtgctactgttcaaaatattccccatcacatctatggcagagctcatggaaagtgacatctggatcaagcctgtgcacgtgaaaaacaattttaaattatggatgtatgtgcttggagacttaatctcttaattggtagcattgttaagttttctttctgctgtcaatggaagagaaaggaaaaaaagaatctgagctttgagatgagggcacgttatgctctcggtgtgggagaaatctggcagaatcagtcaatgaaggaatatatggagagtgcagtcatcacatgagtatgtggaagggtgcaagaaatgaggagtggaggcaggagggagggaagcaaaggtacatgacaaattcttagtggaatttggagaaaagttatggatcctggaaaaagttcaaggaatttgtcttccctgatagtttcattaagctctggccattacaatggttctcaacctggactgcaccttagaattttggggaaagctttataaatatatcattgtctgagccccaaccccagacagtctaattgacttggtctatacctgtgctgtccaatacagtagccactatccacctgtggtaatttaaatttgaatcaattaacattaaatacaattaccaattcaatattcagtttctctggccatatctcaagtgctcattagccacgggtggctagtagccaccttagcaattagtactgttaacaaaaatgtccattgttatagaaaagtctattggaccatgctgttcttggggagagggacatggtcataaaaatttttgaaaactacagcaagtaattataatgtgcaatgaacttagagaactgttggtccttggagaatacatttgttctaaaatgtatcaccacttgtatctgaggtcattttgctttggaagatgattctgaaaatatcattaatgctagactttttctgcagcctagaaatgtagccgcatatatttttatttaaagcagcttgcttgctcatttactctacaagatttagatgagttaactaccagactgcaactaaaaatgaataacttgcttttccccacttagaatgaagtggtacaacaattcatgtagattttgaattacttattaaaagagtttaataggataaattatcttacagtaaaaccgagaggctcattgtccacagctcacattttaggcaacagattagaagcaacgtctatatatttgatgatatccaaaattaatttattaacttaatatgtttatgaagtcgcatgtaattttgaggaaattgttttcctttctcattagagaagaaccccactgagaagagacttttgcaaagtgccaaagtgcaattgatgaaacacaatgtcaccaaatatagcattgaaatgagaaagtggaaaggaattcactttggcattttttattttgcctagtttgtttggcctaagagttttcaagctcctaaatacgatattcttctatccttaaggcttgttttatatcctgctgatttgtaaatatctgacttgggattgggttcttcagtttgaggtgacagtacttcagcatccctgtatcttttaggtaatcttgctctgaaatccattccatgtttaatgagcagtgaatatacccataacagaataaatgacctgccctacaaagagttcacatgacatcttacctagaatgagtgccctcttatctgagtttccttcttatttcaagaaacctgaagcatccaaccttataactcagcgttcctcactacatgagtagaaggagcagctacaaaataagtaccattctctgcagtgtggtagaaccagcgatatacagatttctccataagaatcaagataaaatgcttttctctaggtcaaccctcctgggcacctaaaatgagatgcaaatttcacactctgtactcaaaggtatttctccagctataatcttgggcttaattttctggggatccatatttattggaaaaagagagggactctcataaagaaagaattcctagagtcagcttgttttattgctgcctagactcgcttcttatcagttcattccacaggtagagcctccgtttaccggttacattgtagactcagtttgcttcctctctttatccccttcctatcagttctgcaccactcggcctcattcatctttcctaaaacatctctttcatggtgttacacccctacctaaaactgagagtggctagttctacttgtaaaggatctggcatccaggaggttttctaacatggctgttccttttttctttaaatgaaatacctgtccctctccttattcctggaggtcattgccccatctattggctttcttttctctgtttcatcctggtgccctgcctctgtttctgcatatttctgtgtctcaattccacagggctttgagccctgagctgtcatctatgtatttaccaaaattctcccagttgcagagaggccttccagtctctgttggatgctctgtgtcatacttactttgtttataggtcttccaaggaagtgaataaagaaaaggttgctggcatgctgtgatattgcctaggggttaaaattattgcatttgaaaacagactgcctgggtttgagtgccaactctttacttgccagttgtgtgacttctggcaagctctttacgctttacgctctctttgtttcaactttcttatctgcaaaatagagataattctagtgcctgcctcctagaggatagcgtattcatggagacaataagtactcagtaaattttagttgttctttattgtggttttgactgtttcagattcatggtcttaaatagctttccagttactagatttgctttgatggtagagtttagatctgaaggatccaaaacattctctccgtgcaaataggtcacagtagcatcagaaggacgctagcaattagaccaaggtcagggtgctaggaatggggaaaggacggacagctacagttaaggaagcaaatggcagcaatgagagaatatacattggcttatcacctagcccctggaagttctgagcaatacaaagatagagtctgatggttaaactgatggtaccacattttcactgagcactgtaaggcagcagatgaactaaaatgtctctcacaatttgcatttttatatatagtcttaaaaaatattaagaccttacatgcgaactctatgctacactcaaaaaaggttaccaggaccaatggaaggtttatcagtaatgaatataatctaaatgaaatttcactgtgccattttatgagtcagtcatgattttgaaagataaaagcattacctatttctaaccattggctatatattattcaaaatctgaaggatgtcattagaaatatatttgtcttcttttatattaaagactttctacatgctcagcaaaacaatatataaagagcaatttttactttaccatccagttgatcaactactctgtttccaagtgagaatgtaggaagggacgaaatgagtcatgatgtcgttcagtggggagaagtataggaggagtttcaagcgcaagggctccagatcaggctgcttagatttattatctgtgttcatatgggaagttcaggaaagtgaggtcagctgctatatcagatacatccccaaatttcacaacataagtctatttgtcattcatactgttagattggccacaattggtgggacagctgtgctccaagcaatgattctgaacctgggctgcttcttcctttcattcagctggaggtagggtgggctggatttaggttgagacattggggcaactaaacctttcacgctggctatattgcctctccacgtggtctcttcaacatagtggctacacctatgtcatgggggctcaagggtcctatgaatgcaaaagcagaagtttccatgccttcttatgtctcaggtccagaatgggcttggcatccccttctgccacattcagttggttaaagtaactcatagagccaggcgggcttgaagggcaggggactacactaggcaaagaacactgaaaaatgtggtccactcctgggactaccacacatggctatgcaggttgcctggatgctgtctccaggtttttatggactggggctagaaatgaagcttgtcacttcctctgacattccattagctagactccagtcatatgaccactattaactgcaagagaggctgggaaatgtagactagctgaatgcccacgaaaaaggggctacgggcttcatgagcagtcagtgttttcctcactgtgcgccatccatttctgtgcctccatcacttcctctataaaatgaaattgttggaggcagtgaatacatggcacacatgaagtgcttagcacctaatacatgctcagtaaacttctactgttatcattcactattatgtagtggctatttgattttattccatctaagtaaaagcacaccgcactggataccaggctaaggaatttggactttgtcctggagctaaggaggagacatcaaagggttttaggcaaaagagtactgtaatcagaaatgtattcactcaaaaagtttgacagtgattctatgatatttttgccttaaatgtgcaaaatatcaccagtgatataaacagaaataatccagaataagagccaagaagaaggtggaatgaatgcttaatggcatagattcttaggctataaattgtttcttggtatgcttagatatggagggttaaatgggaaaaaaatgaccattgtgctctcagcactttttgtgattagcgaaactcttccacagatggaaccttttagttgcttcctgatatttatttccaaggctctttcagtgactctttggtctcttattggttttacttaaagagttgttatttaaatcttaaaaaggattccttatctttatgttttgtttttctggtttgaatgcattttccaaagaataccaaatatacacaccttctccattatttctgcacttcctcttaaggcctgccttgcttccactcttaaaacagactaggaatttcacaagatgttgtctctcgggattatttgagattattcacttagtcaccttcttacgaaacatttattgacctgacagtgtatgtctccatcaaataattgatttaacagaccactctagtgttaggtaaacattcttatttcatcactgtctcttccttattagatacttataacatggctcctactagtactgactctgaactgtggttttgtcttccagttaatttgtaagctcatagtggttgggatgacagccgcattacttatgagctgtgaatctttgagcaagtcacttaactcctctgcgcttctgtttcctcatctgtaatatgaggataataatgtaacctactgctaagaattattttgatggttagataagtcagtgcccataaaatgcctaaaacaatgcctgacacttagtaagtgctcagtcagaactacatgttgctgtcatctatttataaactaaaggatcatttgcctaataataaaaaatgaattacatatttatcaatttcatgtgaaataatatattaagatattagatatattgatattaagatattagatatctttaaatgaggatgtaacttccattgatgagtatccagtatgagccatgttgactgtctactggaataatgcgtattttcaacatcagtttttaggatagtggtggtggaggtatgtgcagtaacaggtagattttactctgaatctctgtttaagtttaatcattctagtaaagaaaaccacctggaatattttactgctttaaaattccttccttagcagcagcagcagcagaggctatgtgtggcttacatgattagtttcacagaatcctagtaaaagcataccgagtccttaattttgaatcagtaagatcttccatgaaatcatttcccggtttgtaaattataatcacagtgattcttttgttggaattcacttgagacccatgagagaactataacttcctattgactgggaaacaaagatgtcttttcgagttgtatttggttcagtgccatgtggaatgcatggagatcaaggtaattcgcgattggaattaatcttcccttttctctctgctcttcatggatgccacccccaacccccaccccaacctgaaccctcttagatatggccatgtgggtatattcactctgacctccacaccctctgttcaggaaatgaacaacttctcaaggactgctgtcccacaaagaggataaaatacagagcatgtgttatgcttcagtgtgaaagagaatgaaaacttttgctttttagtgtgtgtggctagtgttagaaaaatggagtcagtagttttaaaatataatttaagaactgagaatttgtcctaaacaaagaaggcatcctatgtgctttatcttgctctcaggggtttcaccagtggcttccaacattctttggttgattcctaataaggacagtttgcacagttacaatccaattaccgtttgtagatccctgtggaaaagaggattttttttagaggaatccttttctaactcgagtatatttcttcaaaatactctcattctttttgtcccttccctcccctctttcctcctccccaactctctctctctctcaccctctctctctctctctctctctcacacacacacacacacacacacacacacacacacacacaggcacacacgcatacaaacacacgcactcactcatttgtgcacttactcagggacacagcctgcctctgttctgaaaggacaggaacttctcaatgatccgatgaaaagattgcatatttttggtcccaagattcacagtagcggaggtctctggcaacaaaaggtatcgtgggagtcacagctatgccagctgggccatttctcagacattcaatatgatctgccatttcaggatgcattttttaccaaaaaaataatttttttaaaacagactcaacttcctactgcaagcttagttcagttagattagagaggacagcaaagacgcggctgattataatttatgggtaagcaatataaatatctatacttacactactttttcagaaaataattgtgataaagttttgtgattctttcacatccatcttgtgatttaggaagaaaactggaatgatcagtgtctgagatgtgtgacagctaaaaactgtctgtgtcaatatggatttatgagaaccttatttttagattaatgatgtggcagcttgaaatgagcaaactcaagcaggaaaggattgtgtcatgattaacagaacagcataattgagctaatttctgtaaaagattcgggcacaggctgttttgaagtctgaaagggtaaagtggtttatctttccctcttaacttcttgaatatgggtgcaacattttagttgctgtggctgtgataaatatgggtttaggggaacagtttggatattaaataaggctaataatacatcggatgtgcttgtgctgtcttttacaaaagaggaaactttaagcctctgaatttttaaacactgtctggctttcattattataagggtatgtctcataatgaaagggcttggtggtggaaagaggggaacatgaccctgatgtcccagatcccattatgccactgcagctgctttgctcatttgtaaagttagaggtttggattggtttatcatgaaatgttatgaaatacatatagtggttatgagtctaaattctagaacctaaagcctggcttcaaatcctaactctgccacttaattggtgtgtgctcttggcaagttacttaagttctgtgcctcagtttcttcatctgaaatatgggaataatgatggtaacatagtccttaggttgttgtaagaattaaatgagataatataaataaaaggcttagaacagtaactagcagagagcggaccatctataaatgtgagcagtatcttcaaggtctaatctatctccggaggtcgttctaatttcagtgaactaaatttaattagagaaagacaagtagaaccatcagctgctggccctgtcattaagaaatttctaattcatgccagtgtttccagtttttgcaaccctgagatttgtgcaggccatcttaccttcttcctcccatccaagactcgagagaagcttagaactgagaattaaattgatggccattagaaaagtccacaattcaactgggactacacagaaatgaaattgaccttttgctctgacgtttttgcccttgaggacttccagtatgtcccctctatgctaaccactggaaaggttctttccactggaaacaagatgtaagtgacatttgattttttagatggtgttagcccagccctgggtttgacaatgttcatttctacttctttagtttatcggtaacccaggtgaacaggccatttgcagataaccacttctatttcatgctagcatttgcatattttctaatatgctaaattatgttgtttgatttttttttttacaggctctctgggatgtttctcagagacaaaatcttaggagaggaggaaaatggtgatggcaaaaggcagatcctaatcatagatgtgtctttacttttagtccagtccaggggtcagcaaactttttccataaagggccagatggttacctttacggaagggcagcttcatggactgtgcagtctctgttgcaacaactcaactctgcaattgtggcctgtaggctgccacagaaaataacaatgaatgagtgtggctgtggttttcataaatcaataaaacttgatttatgaaaacaatcagtaggcagtacttggctccccggctagtcagcttgtatcagcaaaatccctgtcatcatccccatttcatagatgaggaaaatggggcatggggaatgtaagtagcttgctaaaaagccacatggctggctagtaagtggcaaaactgggactcaaactcaggcagcccagcttgccaccccttgcttttagccaccaggctatgctatacctatgtcaaccagtctctgcctgggctgctgggctcccaaaacctgcctggctcattccctcacctccttaagggttggtgcaaaaatcatgttctctgtaaggctgtcctggtagctcatgcagcactcctattcccctcaccctgtgctacctccttctctatctcttatcaccttgtaaaacttgctgtgtaattcagcacacatttcttaagagtttttggtgtctctaatacttccaagttaagatgctgtgttaggtccttcttgtatcaccataaaaatacctgagactgcgtaatttataaagaaaggaaaagaggtttaattggttcacagttctgcaggctatacaggaagcatggtggtgtcatctgctcagcttctagtaatgcccttgggtaacttgtactcaggatggaaggcaacagggaaccagcctgtcacatggtaagagcagaagcaagagagagagggaagaagtgccatgcccttttaaaaaaccatatctcacatgaactcagagcaagaattcactattgcaaggacagcaccaagatattcatgagggatccaccctcatgacacaaacacctcccaccaggccccacctccaacattagtgattgtatttcaacatgagatttggaggggacaaacatccaaaccacatcagatggtgatgcaaatttagagtggtgatgattaatattaattataacttaaatttccatttattcaggtcttgtgggagcttataagccttccacaagaaattcatttgtattgtctgatattatccctacaaactgagagttaagtcttgttcttttctccatcttaataatgagaaaaccgatgatcagagattttctgaatcttaccaaagaactgccatctatctgaatccaagtcttcaccaccatgccagtgagactcaacttttattatgcaaaaagtaagactcatctggggatgctgctttataatggaggtgcttgggacctattccctgtgactctaattctctaaatctaccttagagccaaaggaacctacgtgtttaacaatgatcattctgcccacgtgattccgatgccttgggtccacaaaccacattttgaacagccctgcctcaccccttgtttggccctggggagtttacagttggatgagattaaagagatgctgcagttagagactagccccaaggatgtaataaaacaatgtggtgtagaacaaaaccaaaattatttcaatcaattttatttcatgggaaaatcaagtctgtaaaggtgcaacttagctcaaaagaatgactttctgaataaagcatagatattagattgtttgggttttagtttgtcttttgcttctttttttctaaacatagagacatatacttctggtgggaaggaaatctctttagttaacacttttggtgagttgttctccagttaatcaagactctattgttttcaaactttttttggtttgcttcttttaattaggtttgtagtgtttgtacttattaatactagcttaaaataagccctatgattctgtttatgtgtataatacgtagaaaaatacatgtaaaatacacatagtaatgcatgatatataaacgaatatatagtacatatttttatgataaacaaaatatataaataattgttaatatttccagcaccatcattttaaggagattatatgtaatctgggcttaacagcagacttatttatgctaaaccaaggtttctcaacttctgcactgtagacaagttgatccagatagttgttgattttgggcagtagtcctgtgcattataaggtgcttagcagcatccctagcctctatcttctagctgccagtatcaaacgctgccccagttataacaaccaaaaatgtcttcagacattgctaaatgctcactgggggcaacattaccccaccaaggaccattatcctatatcattttatcatattgctgccctttattaatgctgtcacatagtaccctagaatagaaagatgtttttacaactgccaaggtctttagtctatccagagacattggatgaatttcaatttcatctacatttataaaatctaaacaaatttgaaatcatccattttcaatccttaaaaaaattccatgatgatcactcaaaagactagattcagaaagccttcaaatgagtcattcatttataagataaacagtcaccaaagaaaaatgctggtctggaccatgcatgtgagccttgagaaaccaccagaaacatattctagactgtgctggtaggctttggtgcccttcctgggtgcttgtttatcactttatggtccatgccatgagagtcaaagggagactatgacctttgtgttcatgtcttactgctcctatgaagtctgatgggtgggtataggtatcacggattaactcttccccgcgtcacctattatcacatttattttctcccctcatgtactggcatgggtttttcttggcttatcaacaggctatttcaaaagactgtctcttaatggtttattcgaatccagaatacagtttcccacatatatacaacattgtatgggttggttaggtttccaatttatttaactcatgatggggctggttcattagtccctagattgacaaatatttattcagtggctgttaagtgccaggtactgccttagataccgagaacatcaaaatgaataagccagacaagggtcttgccctcctgaatctagctgttgtatatggctgataatgcaaggccctaggactgggttgctggaatatggctgtagatgctacacaaatatgtgtagggcactacatgaccctaatctccatatcaggggttggcaaacaacagccagtgggccaaaagcagcctgatgcccgtttttgtatgacttgcaagctaagaattatgtttacatttctaaatagttgaaaaaaatttgaaggaaggatattttgtacacataaaattatatgagccttgacttttcatgtcatagataaaatttttggaatatttgtttatgtagggtctatggctgtttttgccctacaatggcaaaagttgagtaactgtggcagagaccataagacccacagagcgtaaagtatttactatatgtaattttctataattctattttatgggaaaagtgatttcagaattccagtcttgggacctctccagcacaaatcattggtgatggtacctgtagtatgaagcagcaccttagcatcaggtagcagggagataagaatctgatggaaggtcaaaacctacttttttaagtgtctgcgagcatgcccttcaccccaccaacttccttttctaatgctcccccttactcttgaattcatttcctattgctgccataacaaattatcacaaacttacaacacaaacttacataagtctcatgtgggcctcactgggctaaaatcaaaggccatgttccttctggaggctccaggagagaatccttggcttttcctgcactagaagctgtgtgcatttcttgtcttgtggctcctttttccatctgtaaagctagcagccaagctctttcaaatctttctctctcccacctctgcttccattatcacatttttgtctcgcttctgcctctacctctctccttgtgatgacattgcactcgcctggataattcagaataatctccccatctcaataatctgaaattaatagcatctgcaaagtcccttttaccatgtaaaataacatactcacaggttcctgggattcgggtatggacatctttaggggagacattattctaccaaccacaccttccacctgattacgccttactgtacttctctctacctccacagaacaaaatgtgggcagaggggcaactcacaagcttgcaacaaccagccagaatattgtagtggctaagagtggcttctgagagtgtcaggttcaagttaatttttttgttgagtgaaaaaataaggattatgtcatcacttcatttgtttaataaaagaaagcagggtcatgcttactctcagtttcagaaagtaacgtccttactattatgactgtcatagaaatagctttctttcccttggtagatttgtatctttctttgacaatggaggacttcttggattttctagacttactacatagcacttattatagcctaactgaacaatgtggatgcacactcaaactagaatctattcaagccttgagctcagtggttctcaaccctggctgcatgggagaatcattagggaacttcaggaaaaaaaatggacaaagaaaatgtggtacatatacacaatggagtattattcagccataaaaaagaatgagatcctgtcatttgcaacaacatggatgaaactggagattgtcatgctaagtgaagtaagccaggcacagaaagacaaacatcgcatgttcttacctatttgtgggttctaaaaatcaaagcaattgaactcatggatagagagtagaaggacggttaccacaggcttggaagggcagtgtgggggatcaggggaggtggggatagttaatggctacaaaaaataattagaattaatgaataagacctaccatttgatagcacaacagggtgactatagtcaacaataacttaactgtacatttttaaaataacttaaagagtggaattggatggtttgtaattcaaaggataaatgcttgaggggacagataccccattctccatgatgattattatgcattgcctgcctgtatcaaaacatctcatgtaccccataaatatataaacctactatgaacccacagaaatttaaaaagtaaaaataaggaaacaaaaaatacagatattgtcttggtcactgggtctgccataacaaaataacctcagatctctcttttggttaacaattccaaatataacaaagaagtttaaaaatccaagaagttaagaaccgtgggctgcaatatataatggactaaagtaaacttgaagcatcgcactttactttttattatgctaactgtagtcatttgtaaacagtttgaaaaaacatatattatttgattgtgttggaactgttttaattgagagtacaaaatcaaagctcaagaaaaatataaattggccaggttctgttttgccagacttagtaatgttttaattctgttttttcaaaagaaaataccattttcaccatgtccaaaactgggtgatcttccttctccccctgcaaacataattccctctgccattccccatcttggtgattagtgttactgtctgcccagttgctgaagctagaaactcaagagtcatcctagattaccccttctcttcccctcactgcatccagtttattctctagcatctatgtggttctaagtttctcccgtgtctgttcaaattggaatcagcatcccacttagcacggagtcttttctcatctccacatctttgacttgctctcccctttaattccttaggaaacttgtttccagtcatcttccctatatttcaaatctgctcatgttcctctctagctcaaagttcctgaatgactagccatcgtctatggaggaaaatctaatctggtttgcattgccaacagagacagccctacagaatctggccctgacttctgcttggcttcacctcttgcccttttcctccttccagccttgtaattccctgaacaagcctgttttctcaaactcatttgcctttgcacctgctgctaaagttgcattgctactgggcgaaccctgccccctcttactcaactttcaagcctccattgaaacactaccttctctataaagctttccttgatcctccagatagataacaaagccttgtctcctaggcattcattgcatttagtacttacttctagtaccacaatctctgtgttttatggattgtttgtgttcttcctacctgaaggttaactctgaggacgaggactgtgttgtcatcttaatagtcccaagcctaccacagagcttagcatctcatctgtgcttattaaatattgtttgaattaattaaccaggaggacttagtaaataagaacaaaatgtcccttctaggaattactttatttcagtcataagctatagttcacaggttgggaaactctagcccgccagccaaaaccagcctgctgtttttgtaaataaagttttattggcatatggccacactcgctgatttataaattatctgtggctgctttcatcccaccaagccagagttgagtagttgtaacagagatcacatggctcacaaagcctgatatattttctatgtggtctttacagaaaaagattgtcaaacccctactacagataattaagcccattggaggtcacatctttgattgcttttaaagaataggtatgtaattctgttttgacacttcaaataacagtcagctcccgtaggtacctaagcttgatatctaaaatttataaactcatctggggactttctatctgggagaaaataataataaaaaaaattccccaatagtgttccttgtagttctctaagcttagagggtgtgagtgaggggtacacccaaggcctgagtccccaaccataatgtctatatgtcctattttttcttagtctggttataccaaaaacataaaagaaagaaaaaattcaaaatacactggccccagaagaattttcttctgttcactgaatgtgactgcagcctcctcactttgactagatttgctcactcactcctctccccacatcccctcctgcatcaccctccctgagctcctcctgggttcctgctagtcttcatcattatccactggatataattcatacatgtcaaggcaaagaaactaaaagccataacttctttaacacttgctcaaattttgccttctcagtgaggtctttcctggctgctgtctctaaaactgcaaattcctttcttctacttccccttctttgcctttttctccttcctagcagttatcattatttcacacaccattccttttacttaccccgttcattttctgcccctaccagagtataatatattcatgtattaaatgagtgaatgaaatcccagataaagagggaaaatatcaaagaattaacatcatgccattcacttttggaatgaatacactagacaggaatttgtcaccagtgtgaaacaaagtgctatggcactttgttgctgggaccagtctttctgtctcccttctttaaggtgagtgacttcttttttatgtttttaagacagagttttgctcttgttgcccaggctggaatgcagtggtgtgatcttggctcactgcaacctccccctcccaggttcaagcgattctcctgcctcggcctcccaagtagctgggactacaggcatgcgccaccatgcctggctaattttgtatttttagtagagacgggcttttgccatgttggccaggctggtcttgaactcctgacctcaggtgatccacccacctcagcctcccaaagtgctgggattacaggtgtgagccaccacgtccaggcgagtgacttctttaagatggtgaagtcttatgggattctgttaagtgttccatttattgcaatgagtccctgcgtgggccagtacctctccttccctgatagaacttttctttcttgatcattgagcaacagtagctgcctcctcaaatctgttgcagcatgcctgatacatgagattcacaagaagtctttagtaaggagacactgggtttcagaggattgtaaagtactttttctttggacgtcactttcttactgtctgcattgagggtggagccatttaccctcagtggcctgcaagggtgtgcatgtgtacacatgagtacacttttaggattgtggaaatctttgctttgactctttgatgtggagtattttagcatcaaatgtctctataaatactgaacatcttcctgttgatcataactctaagcttattgtgttcacaataactcatgagagtgctacaaatagaacctcagtggttacaatattagcatagagtttaaagccctacattcttagcttgagtccttattccaaatcttataagttttatgatttggggagaattacttaacctcctcaagactcagtttcatcatctatattatattggtatatgttactatactattcatataatatgtcataagtataaactttactattataatatattctcatatattatactagattatattattaaattttacatgagataggtaaaaaatgttaaccacttcataaggttgttggagggattaactaaaaagcccttgactatggttaacagtaatatatgatctcaaatagctagaaggaggatattgaatgttagcaaccaaagaaataataagtgtttgagattagttactaattattagaaatatatatctaataaccatatgtatagaaatatcaccatgtgccccatgaatatgtacgatttttatttgccaattttaaaaaatgcccttggtgcagccgctggcacatggtaggctctccatacacactcatccccctatatctgatgtgtgtgatggcaattagcagcagcacagtgtttcacaaaagttagaagttcccatgtgttcccataaaaaggaggaagtaggaccctcacagtatctttctacatagtttcctcaggcctatatgcataatgagataagatcatgtgacccagcagatacttgagattttgacatttgcaactaactgagaaaatccacagtgaactaaaagaggatttgactttgggaattgagacccaattttggaacacaaaggtggtttgcttgactttattactaagagaggatgagatttgtgagaggtaagtgaactctgtaactcttgattttttttttttttttttttttggcctacagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaaggtaaggcctcttctgcctttctgccggggaacactgcaagtcaaatattggctctgccaaagccgtgagctgtgaactcttctcacacctaatattcacacaggaaggaaactacagcttcttggttgttggctggcattagtgtccatttgaaggacatgttcaagagggacaatttgcatgtcaggtaatacatttatttaaagggaaggtcaacttggagcattacaaaggaaagctgtgtgtatatcaacagtctatatggattctgaacaaccaattaaaaataattttcaggaaggtcatcttaaagggtcagaagaaaagctgtgtctatctcagtttggtttcaaaataacccatttgaaaagaatgccttaacactctgttaaacttgtcgtttgaccctatgccaactcagaatcagggattttaccgaacctaactcctttttagccagtttttcagctggtgtgttgtatgttgcactggagccagtgcacacctgattggctgatgtttgttttttaaacagatcctgattccagtaaagatgagacacatgtacttgaattccttgaatccataaaactttgtctctgtatgtttactgttgtctataaaggcactttttttttttttttgagatggagtctcgctctgttgccaggctggagtgcagtggcacaacctcagctcactgcaacctccacctcctgggttcaagtgattctcctacctcagcctcccaagtagctgggattataggtgcacaccaccacgcccagctaatttttgtgtttatagtagagacaaggtttcaccatgttggccaggatagcctcaatcccttgaccttgtgatctgcctgcctcagcctcccaaagtgctgtgctgggattacaggcgtgagccactgcacctggcctataaaggcactttttaatttgtattagtatgtagcagacagctactttgaggcagaatgaaaaactatgatgttatacacataaagtaaatctgccatgaaaagcaacattgggcagggtgcctgaaacttaaaggaaagcagaagagggataggaagcttctagaaactagaacatttccacggaggattttggtatctgcaaaacttctcttctactttgttttcttttggaggaggtcgaggggatgcttcatgaatatttattcataaatagttcatatatatatacacaacatatgtgcatatatatgtatacacatatacacacaaataggtggttctcaagcagggttgattttgctccccatgccctggggacatctggcaatgtctggatatacttttggtttttgcagcttaggggatggatgctcctagcatctagtgggtaaaggctgaggatgctgaccaacaccctataataaataggacagccccctgcaacaaaaattatcaggccccatgtgctgaagttgacctaccttgctgtacacacatacattcacattctgtcacccacagtgccagtggtgcagttctcttggctcagctgtggctaacagaaagaatgctggcttggaggtctaaagactaggacttgtgaactcatcctgtcactcctcacacctgtgagcttgggcgacttgcctctgcggtaggaggctcagttctttgaccagaaagagtagcacaaaaacactgaccagagtttttctttggatagtgagtcttagggccacgttttttcttgaagcagaacctgagactccattggaggttatgacagagttcagaagagagagatagacaaggccaatgggctgacaagacatgcatatttcactggcatatgccttgcacctttggctttcttgtcacggtttgttcactaccacaaccacagcatgttgtttccaagaggaaatccccaccctgttttattttttcatgctaatctcacacatagagaccctcagctcaaataagaagaaaatcacttaggcaattgtgaaaaatgaatactagtgactgtcaggccgtgtcgctcttatccttgagaaacgccctcctgccttacctggtattggtttggttgtagggtggagatgaggcctgttctccctccaacataactcacaaagtggcccatgtggggcccgggccaagagttttgtctccctttaataagcacagacattcttttcattcctaaggaaaaaaaaatggcaatattgttagcaaacttaatttgtagtgaagagaatgatgactttgaaaagtttttgaaacttggtttgaatgcacatcagataagatatcagggaacagatactctctgtggctttgtttttaaatccagttgatttttttctttgttcctgcttgttaaagagtccactaaacaaataacctttaccaaaaacaattttataaaacttgtctactagaggctctgtctccattaattatttctgaggctgtgtggttatccgcacatccagagaaagatttgtgctatcgaaatgtttgaagatattcccaggccacagcagttattttcatattttctgtcaaaataggaactaatgatttacaaataattttctcatttatagaggagagagggaattgtgtggctggtgaaagaaacaggcatcgcatgagggtttctgaagctactgaattgggcatatgaatatagacatcaaatatttactgagatccttggaatgtgtggctggtggcaagctctatgacagtagctttggtctaaatgtggccacttgatccccatgcaaaccttcaaatggaggttctcaacagggtcagattcactgtgtgaataattttcacaggaaaataaatactgtagccaggacctaaagcctaaagaaatgatgccaaacctaataggatataatgaaaatcatgatacaatgaaaatggacacatagtcaagctcacatttctgttctctgtcacattaggatgatcatagggatttatttgtggttatctatttgtagaaccctctcctgtgagtctggtgcttccagggttcaaatgaatgctattataacatgatcatcagctgccagaatttaccatagagaggaaagaattgaggatgggggagttgggaaattactgggtgatttcctagagtagaccacaagggtgggatccagagcacaagtggagggtttgaccttcttttacactataatgatagatgggcattagttatatggacactgatgcaagtgagttagaagatggtgggagggcacgtgggattttactccagattgcgtctcagcgtccaacaaaataggaagcaatttaatccactaggcgtgaggatggcgaagaggtcctggaggtttgaggaaagaggagaggagtggaagagagggcagctaacgggccagcaatgtcacaggattgcaggacaggccaaaaggtccgtttgaggttagtagctgggaattttaaatgaaaaataaacatcctggtatctaaacactgttaagctaaatacaccatatcggacttttaattccccagccttagttaatccaaatatcctcttttgagttaggacttttctagttcaattcaatgaaggtgaagagggacatggcagttgagaatatatctgtagtaggcaaaataatggacccccaatgatggccacatccacatccctggaacttgtgaatataatacctcacaggccaaaaggaactttgcaaacgtgatgagttaaggtccttgagatagggagattatcctggattgtctaggtgggctcaaactaatcacatgggtactttaaagtgcagaaattctcccagctgtaatcagggagatatgtgactatggaagcatggtcagagagatgcaatgttgccggcttcaaagatggagaaaggggccatgagccaaggaatgcagatggcctctacaagctagaaaagtcaaagggacaaattcttcccaaggggcctccagaaaggaacaaagctctgctgacacctcaattttagcccagcgagacccatttcagatttctggcctccagaactgtaagatgataaatttgagttgtttaagacactaagtctcttgtcattagttatagcagcactaggaagctaatacagtatccaaaggaatgattctaatcccacaacacagagtctcaactggataagaaaggaaattaggaagtaattcaataatataaagctgtaaattttgtcattaattatctataagctgaatgtgattccaaaataaagtaccaacagaatttttctttttgatgattttactaaattaatctaaacatcatctgggaaaataattaagtgaaggtagtcaggggaaatctgataaagagataaaatggagattaaccctgtccatttattaaaatgtgtcacaaaactgaagaattaaaaatgaaccaaaatacatatgaaaatttattacgtgataaatacggtatttttgtaaagggaaaaagatgggttattattgtatttgagataatgagacaatcatcattaagaaaataataaattgatatggaagaaagatttaaagattaaaaaatgaaactataaatgatgcaccagcagaaaacataggtagatatatatttttttacactagggaaggcctacccagaaaacataaacaaagagaggaacaagtttcactacattttaaaaaaatagaattatctctgacagataagcaaataactaaactttatagcacatttgacaaactaaaggctaacttctctattgcataaaactttattacaaattaatataaaaagaaaatctaaaatatagacaaattacaggtggctcacagaaaaatacaagtggtataaatagatttgaaaagatgctctccctcacattcattaaagaaatgcaacctaaacaccaaggagattttttttttctctcagagtggcatggctccaaaagttggatgatacacttcgtggggaaacaaacactctcatacactgttggtagaggtgtaaattgttgcaacagggtgcaaggcaatttggcaacatttgtctaaattgtatttatttatttattatttccatggttttttaggaacaggtggtatttggttacacgaataagttctttagtggtgatctgtgagattttggtgcagccatcacccaagcagtatacactgaacacaattcatagttttttatccctcacccctttcccaccctttctccctgagtccctgaagtctattgtgtcattcttatgcctttgcatcctcatagcttagctcccacctattagtgagaacatacaatgtctagttttccattcctgagttacttcacttagaataatagtctccaatcccatccaggtcgctgttaatgccattaattcattccttcttatggctgagtagtattccatcatacttatatatataccacagtttctttatccactcattgagtgatgggcatttgggttggttccacatttttgcagttgcgaattgtgtggctgtaaacatgtgtgtgcaagtatcttttctgtataatgacttcttttcctctgagtaaatgcccagtagcgagattactgggtcaaatggaagttctacttttagttctttaaggactctccaccctgttttctatagcagctgtactagtttacattcccaccagcagtgtagaagtgttccctgttcaccgcatccacaccaacatctattattttttgattttttgattatggccattcttgcaggagtaaggtggtatcacattgtgattttgatttgcatttccctgatcattagtgatgttgagcattttttatatgtttgttgtccatttgtatatctgcttttgagaattttctattcgtgtccttagcccactttttgatgggattgtttgtttttttcttgctaatgtgtttgagtttgttgtagattctgtatattcgtactttgtcaattgtatagattgtgaagattttgtcccactctgtgggttgtctgtttattctgctgacttttccttttggtgtgcaaaagctctttggtttaattaagtcccagctatttatctttctttttattgcatttgcttttgggttcttgcatttttctaaattttaaatggcccaaccattctacttctaagactgtatctcacagatacatacttgtatttgttggggtaggctaaccactcagtgccttaacaccactacaaaagtatatttcttactgaagcactatctaatgcaggttggcaatggggtgagaagggcaaactctcttccaggccgttattcagggacccaggcttcttgcatcttgtggctcctccctcctgtatatccatttagcctggagatgtacacactgaataactaataagataaaatagctgatgagcttaatttgttaccccttctaaacttaacatggttcaaaaagagacttttgaaaatgcttttgagaatctggagacatttttagtggttgaaatcaggaaccaatcattttccctgtgagcccaaaattactccatggaggcaagcatggactatctgattattcaaatggctactcttggcataggctcttggatcagactatctagtttgtaaatggccaactcttagtcacagaaccaggaaacaaatgtaaaaaatagtcaagaaattaagcaaaacctaatggtctacacaaacttttcacttatttaaaacacatccaaagagcactttttgtatatcaagtagtatgttaggtccaattaatattattttggtaacattttaatacaaatggtcaaaatcaggggttagcaactgaaccatggccaaaccaagcttaccatctgtctttgtaaataaagtcttactgaaacacagccatgctcattcatttacaattcgtctatgcctgttttcactcaatgtcagagttgagtagttgtgacattgtctcagaagtttactatctggccctttacaggaaaaatttgctgatgcctgatctaaggtaaaatgaaagaaaataacttattcctgccacaatcactatagcacgttagtgtaggcattatggcttaaccttattatattgtaaaccaatatttacagttgaatggttctataagacagaaatgcatatttgtgttttctttagagctgttttcttcttgtatcagttcatttctgatatcacaattgagaaaggctttgtttatgcattttgaaaacagtatcatggaatgaggaatagctgatggtttaagaaaatatggagaagagtctcataaaagagtaccccaatgcctcaaaattgctcaattatatggcttccttataaaatgatccctcgccattatcccttaggcaatgtcaaatccaagtacacaactcaatgaaataaggaaaattacattcttgctaggccaacactgcagctgtcttcagtttgtgatttaaatgttgatttagaaaataaaagtaacctggtaggcaaggaaattgagattgggtgtttatataacaacccttgacagaaaaatttaactgtcctatttctgttattctttctggcaatgcccagttgaagaggtgatgtgctagaactgtctgccaaagccttttgtgtaagtaaaaataaggttgaaacctggtgcagaatccacaaaatccactgtaggtagaaatgccaatgggaagcaaacaccaccaaatagggatgatcacggaataatgagaccactgtgcccagaggccctcaacaaaggtctctattctgtgaactgtggagctgattgtaccttctgtgtgtccacaatcaccttttctgtgatcttcacacaaaggatggtgacttcccatggagtagggctacgtcttattggtctttgatctggaacatcatctgtactgcctaatacacaagtggccctcagcaaatctttgagatgtgaatggatgcgtgcaggcatattatttaataataagcttttaaattaagctctttctctcactcttccccatatctctaaagagcatcgatcacctttctcccactgtccccagtgtctccagtaatgattttaaaacaacctcaacacttccttactccttcacttcatgctcagtttccagctttcattgatggtctcatagggttgatgtgagatttaaatgaaataataaccataatgagcttaaatcacttcctgacatcttatatactctccataaaacttatccatcaccatcatcatcatcatcattgtcatttttgccatcaccatatcactttgtcctgtatctcccctcaaccctatgtcactgcatcattatgcttgattttaattatagtcatagaacccctacctactttcctcaattcagggcttctcctctattctatctaccacacgtaaaatcaccagagtgaaacttcaaccacagtggctactcctttgttggaaaaacaaaaagcaaacaaaaatcccaaggctccctattgtctactgatcttactatcaaagccattttatatgagatactatctatttcatataaaagaagaaatccatttagtttgcagcctgttctcagaatgcaccacagacttttatttgtttacttgtcttagaacagcaggttgcagattttttgtccacaacctatctgcagtgagaagtacattttacatctcagcccaggaaatgcatgaagccaaacagcttatctttatcagagatacatttggatattctttataatattctctcctatcctcttctatctgattctctttcattttcaaaatatgttttcatgatccactgaattttcttgatttattaataggttataaaccactattcaataacacagtcttggaaggtatatggaatagagaacagggaatcacaaaggaagcaacaaaaatatcagtatggaaaaattagttgatctttgctgtggctctcagggccttgataaggtggacgggaacttctttttccatagggccatggtgatgaacctaaggctagagccatacctgagtatcttatgccttctctctctagagccaaactgagggagtgacacccagagggcttcctacaaggcctcacagctctttcctcataataccaagggttatgcaacctgaaggagatacatatgtggggctttaaggtctagctgcgatagaggattcaacactatgtcaaaaggagttcctatcatcgagtagttcctagtcaatagacagagaaaacacagatgcatcaattatattaaaagatagagcagtggagatgatctgtccaagttgactttggtgaccctttagatagaagctgcctcatccacccactctggtaaaagccaagaatgacaaagacattatcctgcaggttattttgtaattttcttcttggatgctcttcctagcaccccagggtttttaccatgtaaagttctcaagtgtctgctgccactatatgatgctatgttggtgccaagcaggtgtgggattctttaagccatgtgctttgtaccatggtattcacaaattacttcctttatgttctcagacaatatcgttttctatccaaggtcttgtctcaactggtcatatttatacatattcgtatgtcttgttggagcagcaaccactattgcacaagactttggcatcttgaccaaaacttctgtcactgcagtttctgaaatattctggcacctttcaaagatttcaagactgcactatattctcttttgggatcatagcccaaaataaacttgataattatgaagaatatcccatccttcaaacatgaacattttgccttttttcttggtttccccatgggcaaaataaaagcaaatacgtatacgttgaaatttaatgctgagtgtattttttaaccaatcagcctttttaggtcatttggaatcaagccctcaagattacttaaaaattcaactagtgggtgttactagagctttacatatggaaagctctggaagagtagtttaacaggttttcacttaagatagatgtgggcaaactaagctcatgggccatagccagtccattgcctgtttttatatttttattaaaacccagccatgtccatttctttctgtattgcctgtgactgctttagtgctacagtggcagagttgagtagttttgacagagaccttatggcccacaagatcaaaagtatttattctctggatctttacagaaaaaaagcttgccaacccctaatttgaaattaatattatagtaattcattgttattttttatgcagttgttcaactatactattcctgttcatttcaatttcttcattattttaatttcatgatgtagtaattgtgtgctttttaaggatcagacctttgttattcttagatgttttagtgcttatattacagtcatgcattgcttaatgacagattcatactgagaaatgcatcattagatgattttgacagtgtgcaaaacttaatagagtatacttacacaaacctagatggcatagcctactacacacctaggcgatatggtagagcctactgctcctaggctataaacctatacagcatgttcctgtactgaacactgtaggtaattggaatgcaatggtaggtatctatgtatctaaacatagaaaaggcatagtagaaatattgcataaaagataaaaaatagtatagctgtatgaagcacctccattataatcttttcagaccactgtcttatatatggcctgttgaccaaagcattgttatgtggcacatgactgcatatgtgaccaaatattttttcaaggtgagatgagttcctttggtggcattaagcaaaaaataaaagtcaatatttttatgactggtttaaacaactgatgccaccatgcagtctatagacacatgagttatgcattaaatgggtaactttaataagtcaatcttcattacaagttattactttcactattactatcttgtttgatgactgagaagttagcaatattcccttctcatgtcctagaattgcaacacctgccagtgcccaaatcaatactgggaagtagaaataaatcactgggattggcttgaactaagggttcatttcccgagtttggggtgataactcatcccaggatgagttgcatggaggatgagcaactgacaaaatggagcaaggaagaattgcagtgagtaggtggaggggagcaggatagagatggatttagattaaaaactactggtatacggaagaacattgtcatcttctgccattgcagacaagtgatagagaggaaaccattcttattttatttgctttagcgtctagcacagtgccttatacatacctacagcacaataaatatttgaaaaattaaatgagatacattaaaaattcaatcatagcacatttatgtatatagtgtttccatagcatatggaattgttttgaatggctcaaaggataatcaaaaacatggaatggataagaaaaggataggtagtataatagtttcatttaattgcatcatcttttcaggtactgaatcagagagagctgttttcatgggagcaactggcaggaaattctaggcatttccaagactttaacaagtaatgataagactcccaaaatttgggttttaattttcttgagttaaccacctagaatatttattagggaaaaatgatttttgtatttttgttctcctgcctacttcctttcatttacactccaggaatgaaatgtagcttaaaaaaatgacttggcaaaagccattttccctgccccgatatttggaaactcctgtctctacaaatacagtgcctacctagactaaactaaaagtattgtcctccatttaaggactgttcaatgaaagatacaaattcaggagcctggaaggacatactagctcctagatcatgaaaagtcagcagcagagctgcccctttgagacatgtgctgaaagctttgaaaaaaaaatcttctttaaaaaaaatcatataacttgactgtggaaaaatgaaagcaagtaaaagatccttctagggcataatttgatcattagcagttcttacagcaagcagtgattacaaagaacacctagttaaggaaaaaccatagttgagcctttaaagctatggcatctaaaccatgagatcagcttccctacctcatgttttgacggaacaaggagacgtgttcaacaaatcaaatatcttaatgatttttctgtaatagaaaaccacttgctttgaggttcgaggatccagaagttttttttctcctcttgaagatgatatagaaaaattttagaactaatcaccctgccagaataatttacacaaaacagaataggtttcttcttagtgtttaactgaaggcatggtgacctccaagagtcgactttctctacagcagtgagagactcacagaatgttcttattttctgaccacacctttgataatttcaccaccacttcaacatgtaaactgtggggattagtacatttcacaagtactttggggagcctcagccctaaggagaggcatcgctattgcttaagaataccataaaacattttcttctccagggaaacatagacactttggaaagagattttggaaatcctagcccacaaagtgctagcaggaaaaagaaagtgtttaattcactgggacttataccaacaaaagtgaaccaatcaccctgttcctatctgcctttgtctatttcaattaaagttagtggaagaactgttaagtataagttaataagcaaaaactttgataacatgagtttggttaaataaccaacaatctagggtatgaaagatttcttgaagatgacacacgcgcacacacacacacacacacacacacacacacacacacacacacgtatccagcattgcctgaatgatgggaccagtttgggcttgaatacgttttccattattttccatatagattgttttcttccacaattattattttcccctctcttgaaccctggttcccacttaagaaactagcaatccactcctgaatttgcaattttctcatctttttcaccaatagaatgcttagttggtaaagggttggattataaggaatcaaacattaaaagggatagggtaatcagaaaggaaggatgtcctaaactaagctggtggaaacccccaccaaaattcaaagaccccagagagggataacttcatcccttaaggttgaactcaaacattagcctttgcaagcagaactggaagcagtcttctctcttttgtcctggcacctagtaaatgtcttctcctcactgaagcatttcttcatattgcttttttttttttttttgtcgcccaggctggagtgcagtgacactactctgtcgctccggctggagtgcagtgacacgatcatagctcactgcagcctcaacctcccaaggctcaggcgatccccctgcctcagccccccaccccaccccaccccacccagtagctgggactacaggcacgtgccaccatgcccagctaatttttgtatttttagtacagacaggatttcagcacgttgcccaggatggtctcaaacttcttagctcaagggatccacctgcctcggtgtcccaaagtgctgggattacagatacgagccaccatgcccggcctcattttgctttaattaggtttccacatgtctatctctagcactgaattttgaatttttcaaaggcagagatagcattcattcatctgggttcatagcacctagctcagaatctcacctattgatcaatcaaagggtggatgggtggatggatagatcagtgtatggaagatgacatttaaacagataactattatattgtaaataatattcccaagccaagaatagtcatcatgttctatggtacaacatccctgggcagagaatacttgcttaagaatagggaagagatccctgttttggctcccttcctaaatctctgggattcatcccaggttaactcttaaaccagagcattgcattggtcccactgttttccctttcctggtcccactggtttcgctttcctagattactattcctcttttctatcagagctgctatccattccatttcttgggatagactttgaatatgaagcaggcaactcaaagtagaaggagcaattttgaattcattccactcggggtggcaatggcagtaagtggatcctttgtccagcctgacttgtcctcaggtaacacctgttttcctatgtaaacttactgggccaatttaacttatgttgctgggattaatcattagaaagcaccaaacatggagtacaggcacaatgaatggctcccaagtgccaggggtcattaataatattgttacttctttaacaaacctcctgttccaaactggaaataaaatatctggttcagtctttctcttgccttattttttgggaggtctgtggcttgaaagccacaaagaaaagccctcaaagtgagaaataatgagatgaaataatgaattttagttttaataaaggacaaaatatggtattactaaacctttttacaggatatccacagatcatataactcaattcacatttatatgtacatatatatgtaaagagatgttatattttattttaaaaacaatattttggtttacagaataggcattggagcttaaaaatagatttctgtactaatcaaataatcggtgttcatgaatgcaaatgaaaaatactgtctggataacttaagcagaaaaaggatttagagaacctaagatttagaatcttacaacaacctaataagccacctatgaaaaaatcaccagccccataaaaacaaatctggtccatcttgttagctgtccactccctttccagcaaacaggctccaccagaatggcaaacataatagatgtttcatgtcagcttaggcacatgttttctttcagatcaaggagatgcaaataggagattatttcactagtttcagcctggcttgtgagtcacctcccttcttgtcactaaactgagctttcagttctgtggagcacttcagtgagcaatacaggcctccattttctcacatgcttgataagtgagtttccaacctttgcttgaatacatctggtgcctgggagaaaggacttatttttttttaattttggaataattttagaattacagagagttatgaagatagtatagagttcccttatgccccttacccagtttgccctgttaacataataacataacctcaatgctattatggtaacattaataccataaatgtattaccttggtacatttatcacagctaagaaaccaacattggtgcattgctatcaacaaaactatagacttcactcagatttcaccagtttccacactaatgttatttgtctcttccagaatcctattcaggataccacattgcatttaactgggcatcttttcttatctttttatttttatttttcaaataacaaacatttatcttgtaaaacagcttctgtgaatagcttagcttgggtgttctggttcaggggctcctgtgaagttgcagccaagcaaagatggggctgcagtcatcttagggcttgattggggctggaggagcagttcccaggctcactagtatagctttcagctggagacttaccccttagctttttgcatagggctgctcctgacctggtttctcacaaagtggaggggtgcaagacagaatacaaccaaatggaagccacaatgaatgatgctttgttttgaggcagctcattccactggttccatttgctggctagactgtcttcctatgatatcttcctgaattttcattctggcccatggagggctggccagtaagtctcttcatccaccatgtttagtcctctaaataaaaggaaagaaccacaatgtctcctgagtcttctctaaatgctaaacatccattcatacaactgttgactatcagagggtgttccatacctgatcctgccccacccaaggagaaaaaaacagttcatataaagaaatacaaggctatttcctcaagaaacttggcttattcccccatctgtagtcctagaaatttggtagaaagataattatatgcagactcccatttcttcgtaaattaaagaaaattgctattgtgtcccaaagtcagtgtgatacataaaggcttcataatttgtaaacacttttacattgttctgtttaaaacagaaactgagataaagtataacttgagcattgtgacaagtgggaaaatgtgaatgttttgttcacatttacatgatttgggttcatagctgctctctaagttgagttatacatagaccagtggttctcaactggagtaagtttagtccctggaggacatttggtgatgtccagagacatcgtgtgtggtcacaacagtggtggggtgctctggcatctagtagataaaggccagggaatgctgctaaacatcctacgaagcacaggactattctccactgaaaagttatctggccccaaatatcgctagtgcctaggctgagaaatcctggcacagattatatgcagtttctaaagggccacttccctactctgccacccaagtgtatctttttaaatcattttcccctcactttttcattgagctctcctcattgcctatgaatttcattggtttgctttctccgagagtcaattttattggtccaaatacatagtaaggcagctgtggctaatgaaacaggagatggtgccaaaaagcattccttcagtcttttctcagcaggatttttttcaaagctttgaataagctaggaccttccttttaggctagggtaggttcacaaactctgaggcataccaggtaatgtaagtgggtacagtggcccagggttgggtgcctatgctgccttggggcacatgtgaggaatgtgggacccagtgttgccagctcttccactttcctcaagaggctggaactctagatatgtatgtgaactttccaagattttgcattaggacttaactttttataaaactttgtgtgggctaaaaaccacctgaatagtaggggactggatatggccattttgcacccatgaggctggaaatttgcctgtgtgtgtagcagcaccagaggaggtctttgtccccagcagacatttagattcttttccaccctcatgtcatatttcagtgcaggtgatttcctttcctttccagtaatgtaatctttattgagctctgcaagtgaagaaatttaaaagggcttaaacattgatgccatatcccacattcaggtgcacctgtgaattgaggctgtttacactcattccccatgattgcctggatgagaaatgagccttagcgcttcttgcccatcatccagacttctgggagggcagagtctaaatgcattgcacaaatggatgtccgctgttttacaaacacctcctggataggagagccctgaaccatctctcatgttgcaaaggcaaagtgaccttaaagaaggacttccagcttctcctcataggcatctgggttctgctcttagccacacctctcaagacagaactgcgcttattggaaagaacttgaatttggcattgaatgtcagccctgccacctaccagttctgtgattttgagagaatttgcgttaattctctgattttcagttctctcaattgtaaaatgaataaatcaaaatgctatcccaatggatcgtgtgttgacacgtattaggtatatgatataaatatttcatatcattaaaaaaaagtacttcttccagtgccagtgcatatttagagcttggaaattgttagtttttcattcccctccctctctaactctatgttaccttgggcatgccagttcatgtatctggctcttactgtcacatccctgaaataggcaccacatttcctccactacagcgtaaggtagaggttagagcatgatatggtttggctgtgtccttacccaaatctcatcttgaattgtagttatgggaatataatacccatgtgtggtgggagggacccagtgggaggtaattgaatcatggggactgttacccccatgctgttctcgtaatagtgagttcgcacacgagctgatggttttataaggggcatcccccacttcgctctgcaattctccttgctgctgccatgtgaagaatgacatgtttgcttccccttccacaatgattgtaagtttcctgaggcctccccagccctgcgaaactgagtcaattaaacctctttcatttataaattacccagtctcagttatgtccttatagcagggtgagaatgcactaatacaataaattgataccagtagagttgggtgctgctataaggatacccgaaaatgcggaagcaactttggaactgagtaataggcaaaggttggagccatttggagggctcagaagaagacaggaaaatctgggaaagtttggaacttcctagagacagagggctcagaaactttgaaacttagaaagtttgaaagtttgaaacttcctagagacttgttgaatggctttgaccaaaatgctgataatgatatggacagtgaagttaggctgaggtggtcttagatggagatgaggaatttgttgggaactgaaataaagttgactcttgctgtgctttagcaaacagactggtagcattttgcccctgccctagagatctgtgggactttgaacttgagaaagatgatttagggtatctggtggaagaaacttctaagcagcaaaaccttcaagaggaagcaaagcataagagtttcgaaaatttgcagcctgatgatgcaatagaaaagaaaaacccattttctggggagaaattcaagctggctgcagaaatttgcataagtaacaaggagccaaatgctaaccaccaagacaatggggaaaatgtctccagggcatgtcagagacctgcacggcagcccctcccatcacaggcccaaaggcctaggagggaaaaatggtttcctgggcctggcccagggccccccggctctatgcagccttaggacatggtgccctgagttccagctgcttcagctccagctgtggctacaaggggccaaggtatagctcaggctgttgcttggtgcaagccccaagccttggcagcttacatgtggtgttggtcccgtgggtacacagaagtcaagaattgcagtttgggaacctccacctagattttagagaatgtatggaaacacctggatgtccaggcagaagtctgctgcaggggcatagccctcatggaaacctctgctagggcagtgtggaagggaaatgtggggttgaagtccccacagagagtccccactggggcactgtctagaggagctgtgagaagagggccacagtcctccagaccccagatgtcatctatatagcaggaatcatacaggctgcagcctcttcagattggcttctttcacttagcaatatgtatttcaagttcctcttgatcattttgtggcttgctagatcatttcttataatttctgaatagtattccattgtatgaatgtaccataatttatttatgcactcacccattgaaggatatattagttgcttccaaatttttgcaatgatagataaagctggttaaacactggcatacaagtttttgtgtggacgtaagttttcagttcatttgggtagttaccaaggagtgcaactgttagattgtatggctcagctatgtttagttttgtaagactatgcttagtttttgcaacatttggcaaccctattctcaatgagttgcacctcttttgaagaggtaaagaacaagcatatacttcaatgagaaaagccataaaggacatctgaaagtcatgttcattcattcatacattcattcattcacttgatatttgagcacagtcatgtgctagaccctggaaatacaaacaaacattggcaatggaaaaaatgcatgctgtaaaacaaagcaaagcagcataacaagggcagtaggaaaggctccaaatatgcaagtgacagaacaaagatggagaaattttccctgcagcagtttcaagagaggctcagagaggtatgaactagtgaagtaacacattttttacccttctcctacactgggtctgaggacacagctatcgtgaaacaggtgaccccacgcaggatcctacagaaaaacaactaaatcacgtttgtgaaactcagaactacaagctcttcctcatgatttggacaatagatgctttcaaagagtggttatttttcctatattttccttcccttctcttaatggagaattccttcttccaccctgaaaaggaaatacgaccatcagtttcccaaataaaaagagggaaatacatatgtgtataaacggtggtgaccacctagtagaattttaagcctttgtttaaggatattttccccctaaggactgcaatttcctaagttgagtcaacattcagaacttcagttaccattgtcctatgtgagatttgtgtgtcttgtatccaatgtactagttaggtatttctttataggctttttaagatttacaggtgtacctgatcaaaaatagctggaaagatctgagatggtttttactggataatttattccatgtgtacccaacagccaagcacttggcaaatgaccaaaaaatatgattttaaaagccagaatagctcatgcaagaaataagtagctgagagataaagaaaaaatggcaacgttatgctttaatggcaatgtaaactatctagaagggacatttatcagttcaacaagaattaattttcttcactctcaactcctatgaacaagccttctccttctaaaaggtaggaatgtctgccccagtaattaattgtttatgggtaactagtacatcacgaaaatctctataagacatctttctctggcacatattttatctttatactagatggaagataacaaccaagtgagctgtttgttgaatagggcacacttcaaagccaggtatggatatctgatttaatgcgcattagcaggacatcagtgcaattgttgtgtgagtactgaggcaagtaggcaaatggcggggtgaacttcactccttaaaatagtgagctaaacagacgtgaactacctaagttgtttgaatttgttccacatgctcttttaaaatgatataagacaaaagagatttaactggttaattagtgaaaatctagtaacaaaaaatgtctggttaattcatggaaaatgggaactttgaataaatttcaagataacgtttgaattaggccaataaagttaattcttgtgtttgcataaacacaaagattggagaattgctgtgtattcaccatttactctttcaaatgaccattactttatttagtacgtgtgtattgtgcacctcctgtatggctgggaacataccagtttccaaaaataaaattaggactatgataaagtttttacactctagggtaacagttcagtaaataacagccacaatacagggtttgagaggtacagaaccactaaaagagaggaaagggggcacaattttgtttgagaactaacagggtccagaaaaggtgaagaactaggtggtctttgacacaagtcttaaaagagtaagtaggcacttgccacacatagaggaaagaaagtgtagcagacaaatagaccagtcatgattattaactatcaactagttcatcttttttattttttatttttttgttcctttttgagatggagtctccctctgtcgcccaggctggagtgcagtggcatgatcttggctcactgtaacctctacctcctgggttcaagcgattctcctgcctcagcctccctgagtcactgggactacaggcacacgccaccaagcccagctaattttttttttttgtgtgtatttttagtagagatgaggtttcaccatgttggccaggctggtctcgaactcttggcctcaggtgatctgccggcctcagcctcccaaagtgctgggattacaggtgtaagccaccacacccggcctgtctttaccatttacttgcttttcattcctggacaacactgatctcagggaggtagtgagtagaacggtggttaccagagggtggaaacagtagcagggttgacggggataaagaaatgctggacaatggatacaaacatacagttagagagaagaaataagttctagggttcaatagcacactcgaataactgtagttatcatgtatttcaaaatacctagaagacatttgcgatgttctcaacacaaaaaattgataaaagtttgaggtgatgaatatcccaactactctgatttgatctttacatattcatgaatcaaaatatcacatttactccatacatatttacaactattatatatcaataaaaatcatgaagatattggtaactaatagctaacatttattcaacatgtaccatatgtctaaccttctcaccatcattgtttcctgtgacacagtaaccctctgacacagataccatcatcactgttttacaaataaataagaaaaattatttcaatgtgctttgggtgagcagcactgagagagccctgattcacctggataagaatgcaatgtgcggcctggctcaatttgacatctcagagcttttgtactctgagtgcaataaatcaggtgtatgcacagaaatcagggcagacttaagctcctcctaaggagtgagtcaagtattttgtgatttgactggatcaccttaatttagatatcttcacaaagatataagcctaggactccaagatgaaattttaacatcagggaaatgagatggtcctttccctctgctatcaggagaaaccctctccaagaggcagggaggcaaaagactgtttctcttcagtttcagttgctgaaataaaggacttgccactggtctgtgggcaaaatttcttgggcactgtctttgcatatgacctctgaattttgttcagtacatcactgctctaaggatatatttagtgcttttactttgcattttaacattcagctgctgagtgagacaatattaggagacatgatgctcttgatatcagccattcttcaaagcgggtgtttattatggaataaaagaaaatacgtgcttcagtctagaatttaaaagcactaactgcaatttttcaagcatatgtatgtaaattaaagttacctgtcttaccattttcttgagaaaagtgtatctttacgtttgttttagtgcgacttgtttctgatatcctaacctaaaatttcatggtcacaaatatataaattaaacgttatcttaatgaaaaaataaaacaggggctatagcacaagagatgtgaggaaaatagtcacacacacacaaaaagtaaccaagagtgaaccctgaagtaatctatggacttggggtgataatgatgtgtcaatgtaatttcatggagtgcaacaaaggcaccactctggtggggtacatggatagtggggaatgctatggtggcagaacagggggtaaatgagaaatctctagaccttcagatcaatttgttgtgaactaaaaacaattctaaaaaacaaagtcatatatatgtgtgtgtgtgtgcatatattcacatatacgtatatgcatatatatatgcatattatctatatacatacatgtatatgcatatatacatacacacacacacatatatacgtatatacacacatttatacacacacacacacacacacacacacacactcctaataacttttaaggtcaaaaactttcttcccttcagaatatctgccagagtgacttcaagtacacagttactcatttgaggtactaaggggtgacataaatatcaacttttggccgggcgcggtggctcatgcctgtaatcccagcactttgggacgccaaggcaggcagatcacgaggtcaagagattgagaccatcctggccaacatgctgaaaccccgtctctactaaaaatacaaaaattagctgggtgtggtggcgtgtgcctgtagtcccagctactcgggaggctgagggaggagaatcgcttgaactcgggagacagaggttgcagtgagccaagatcatgccactgcactccagcctggtgacagagtgagaaagactccttctcaaaaagaataaaaataaaaataaatcaactgttccatcactaaataccttgtggtgtctttctcatccttccactgtagaatagtcagatagcccagtatgtataatagaactctcacatggacctctgcagtgcttattttgcctctgtaactactgaaagagatctcaaataaggatcttcttagaaacttgaagtagtacttagacttacacatcaacacatgctttgggtaaaaggaaaatcctttatgaaaatgcaagctttaagaattaaatgctccccataaggattcacttattcctgtataagtgactgtaggcagaaaaacagaatctgaatgaactttttttttctttaacttggaaaaccttgaaaagataagagtggtatataggggccaattaaaatgaaaagaacaagggaaaatgagagtaagtctctcctctcctcccaatgagggtattgtgttctgaacaattcatgaatggaatttcagaaactcagcaaaagaatacatttaactgacttattccaaatatattctgaatttcatatttactaaagtgtttccaaatgaacattttgtatgttatgtgcaaaaactgcacattaaaaaggaaaggtaagagagttcatcatacaagattttagatgcatgcatacttaaactaacttccacatactccacaaatactaaacttaaaaaacaaagcaccctacataatttaccttgccatagatgtgaagtaattgttaagcatacataaatgttaataaaatactttgaatcaatgctgaggggtggtatcattgaatggtggaccaaaacaaactaaatggcattttgatgtctttggaaatgacatacccacaagccaatggctcagcactgacatttatatatcctgctcagttgtctcaatcatttatagtagtttaatttttttcaagaacacagatgttaaggtaagtttaataattttgaaaggccatagagtatatctattttttgaagtcatactttcattggaattgtctctttaacctaatgaataaatacaaagaatgcacagataaaataagttttgtcttcttttattagagaaaaatgtactgttccatgcctgtgctttctacagttttggaacggatacagatccacagaggccaaacctaaaactaaattatctttaatgttaaaatttaactgaccatgtatataactgtgcaattgctgctttctcacagaactgtctagggttcattcaacagatcacagtaacgaggtctggcatttaacaaacaaactaatgatagaggagatacactaatttatacgagaattaactaaatactgtcatgtggtttagtgtagctcaagttatgcttgtatcatataacataggttcaagttttttcatcagccatcagaataacagtggttaaagagacatctgaataagtgccaactcttactgcagttgtctcaaaaaaagaaatttaagtaattgcaatatacatttctacaaataaaatattccagtgcttacatcaatcctgagtttttaagattaaatatgcagtacttatggtctccgacacaattttattttggaacacggtgatgtattttttaagttgactttcttcaccactttcttcaccaaaaagagggctttcattatactcttccaagtcctcaatactctaaaacaaaaagtctagttcactgacaaaccatcactttacatctcaggttttaaacagggtaaattagatgtcaaaggaaacagcttttaatattcaaaggatgctggttatttatttcaaatttaaaaactgtaatcaatacatggagctccaaatacttaaattttttaattccagatttcagtgaaatattattatagcaggtccaacagtcatgtagtttgcttgaataaaatggcttgatgaacatgttacagacaagatggaccaaagacagaaaaagactgtcagtcttatatcatggaataccatattttttcaccaggtagtgaccatttgttatcactaatagtccacataacgtggttttcattgaagggataaaatggtctgtgatatgacctaatcaagttggggaaaacataactacgtatgaaacatatactagtccctcaacaaatagttcagcagttcatagtccctaaaatgttgtatgttaatactgaggaagacgtaaaaaatgagtacacaatctcttccgtattcctgtgacatgagcaaatgcacgaataaaaaaaaaagtaatacaaaacttgtgttactgctatggaagagcaactcactcggacatgtagccaaaaatggagactgatgtcgacttagttggcacaagatttcaatcagtcaaaaaaaaaaaaagaaaaaagaaaaagaaagattttaaaagcatttggagggaagggcatgagcaaagcatgggagtaacggtgagttccttcagggaaggctgtcaatctggagagttgggaggaaagacagagggtggcaaaacaagcctaagagggggtcatgtaaaggggagagtctctgaatatctaagaactgagacatgggcaccactgacaggctgggaagagggaagggctaggaagcattttagaaaggggagagtgttaggaagatagtattgcccatcagtgaaggatggctcagaagagaagagataactcagaaaagagcttaataatacaagcaaggaagaatgaggtcttgaactagggcagcctcagtagggatttaaagaaagaaattaaaggaccattacagcggtaaacgtgcctcgcaataactgcatgggaaggataatggactcagaggagtccaagatgataccaaagtttctaccctaaggggtaacatgtagcattaacattgacaggataacttttctagtttaatgttcataccaattaataaatagtttctgaggaacattatagcaacatgttctcttctcgtgacttctatgtaaataactgtttgtgtacagatcatccttaagttgcttgaaaattttattttcaaacgcttttcctagtttatttaacacatctcagttagtgtagaggagtgacatatgagcatgtcttttcacaaggttattaaaaagaatacctcccaaaagaaaattacattgtttcctaaataatatacatctacatgaagaagaggtcattgtccaataacgattagctaatatgctatatgacagcagataattcacaattcacaaagtgttaataatctgctggctttcacattctgttatacatctgaaccatctcttatgattacaaattttcatgtaaaaccattactagtcactaatagttttgaaagggaatatgccataaaacactcctacattccagcaggaaataaaagagatactcagtagtcaacacttgcctacttcctatttaactaaaactgtttaaacaagacaagtaaaaaagacatccagtaaggatttatggacttcctgcattccactaaagatctgtcgctgatctcctaaaaactgaatatgaaatcttcattaatgtattcataaagtatcaattttatacacaagatttatatttccaggtaaaatttccaatttaccttttcctgttttaaataactcccacaaaactattcatgaatcctaaaaatacacttaccaattatgttaaatctggaacaatacaaagtgaaaatggtaagtaatttataatgtataaccaaaaggtctgtccacttggaaccaacccaaatgtccaccaatgatagactggattaagaaaatgtggcatatatacaccatggaataccatgcagccaaaaaaaaggatgagttcatgtcctttgtagggacatggatgaagctggaaaccatcattctcagcaaactatcgcaaggacgaaaaccaaacaccgcatgttctcactcataggtgggaattgaacaatgagatcacatggacacaggaaggggaacatcacactctggggactgttgtggggtcgggggagggatagcattgggagatatacctaatgtaaatgacgagttaacgggtgcagcacactaacatggcacatgtatacaatgtaacaaacctgcactttgtgcatatataccctagaacttaaaggataattaaaaaaaaaaagaaactctcggggccaactgaattttataaaaatgaatttgttgtttggtgaaaaaagtaaaaactataaatcctagaagtcagttaaaggatacctgtaaagctctgtggaacaaatattaataaagtcaaactgatcaaaaaaaaaggtctttccatacattcagaaacaagcagactgtcttctatttttgttcatgagttgtattttataagaacgtattgtgttaccaaatagaacagacctttgtgaattgctcatgtggcggctcaatctctttcagttcctttcccatcttgttgccgtctcttttgttgctcttgaaatattctctagaagcacaaaactaaaaagtgattaaaatcggataaattttaatacttacaaaacataattctgcattagctttaaatggatactctttaaatcaatacttctgaacactattagacaacatttatgaccaattttaaacagttgtgttcaccactcatatgctaaaacaacataatctttctcatcagtcatggagtaaagaatattctttcttatatatattcaacatgtatgtcctaattcttggtttcaaatgaagagtatttgatgacccttcctacaatttgttgaccacagatagttaatttctaatacagatctttcttacctaagaaacattcttttttactaagattttaaacacttggtcatttcagtatgcacatagatgaaccttccaacaatgattgcctttctgcaccttgacctaatctccaacaacagtgttctcctctcctctatgtggcactcactcacacagtcatcccctagattttgtcattcccaatggctgcaacatctcccgtaataataataatagcaatgatagcaacgataaagagcaaccatgggtgagatcgcatcctgaaaattttaaataaacccattacataagaaccctttaatccttcaaacaactctgaggtaggtactcttaccatgtctcctttcatagataaggcaactgaggcacagagataaataatttgcccatatttccaagctagcaatggtcaaactggagttggatcccaagcaatgtggctgcagagtcccagcccctgaccactccactcagctatttctccatcttcccaacatacacagccactacctccctgtcactgtaggtcactcacttcagtactacagctcaggaatctgtagggacccaacacccaatggatggagcacttttcactgcccaatgcccacccccatgtgctccggtaactcagtcccagctgaaattccacagccagtcatcataaccgccccccctccaccaacatatatgccctgcccaactctccctctatcaatgtgctcagctacaccccaacccaggaaattccaaccctaaagttactcttgcacaaatatgccatctgggctgactttaacttcttaatccctatgacactgacctcagttggacccctaatgctgcatggcaattatattcccctagtccatgagtccactaatgggccccgctctctgggttcatgctctcttccttctttgctggatttctgcatgaaccattactacctgagacattgatacaataggttaattgtaaagctaagcctgataccaacaattagttcttctccttcttctctcttcttcatctttctgctcacctgtgatgtattcttcaagggtattcggctccttcttctttcttcttcatctttctgctcacctgtgatgtattcttcaagggcattcagctccttcttctttcttcttcatctttctgctcacctgtgattcaaggacagtcagcaacttcagagaacgtccataactacatttctgcctgtaacacataataagtaacacggtcatatgtcatagagagatgaaaaattaatcctattcaaaccaaaactgacttcacataatttatactataaagtagcaagggagtaatggcagctgaaatcttctttttgggaaaaggtgaaatgagttactgtcattctgaaaggatcccttcctaactgactactagagcagctatcttacattctttatgtgctgaaaacaaaggagagtttactgcactataaatttcccagaaacaataattttctctaacagcagtttacttttcatttcctcaaactaaataacatgtgggttctcataagtaggttcaagaatatcatagccattcatcccgtaagatttcccaaaagaaatacttcacttaactctctctccactttggtacaacaatgattttctaaaaggaatagtgaaaacaatttaactaaaatagataacctatttacgacataaggttgtccctttctacataacttaatattgttaaggatctacagactaaacgttgaagacatttatcttatatgcagctgccatatttctagaaatggataaaaattaattttacaggaagactatttttatctggaaggcaaaaagaggtcatcttcattggctttctagataatatacctcaattctgttaaacttaggttataaaacaaagaaacttacctgcttaaggaacaatcaagtaaacatattgttcactacagacaccaatatgtacaagatagtttttgaaattatttgcaccaatgaatacaaagaaatgatagaaatatccttattcaaaaaagccaacaatcatgcatttttagttgtattgttctcaaaatacgtttaattttgttgtttgtttcgttgcaagcttttgcaacgctttcaatcctttttctctttgcagcaagaccctttttaatgtcagctagacagtaaatgaaaatgcattaaaaattaatgttgaaaagtagtttatttgcagatattgaaatcaatatgggacatgatggttcagcaatatcagaaggatatttaaaatgcaaaatggaaagatcgtttcaaaaaagtaagatttaatccttttctgtaaaacctttcaggtattaataatagttttccaattccaattggtataacagcaaatcacttaattgacagatgatgaaaaaaagcaaataattaaaatagtttctattttttaaatgtgcagaaagggtaacaaacacagactttaatttctacatcataaaatgtccaacagttcaaacgacatgtttccatgaaatactgtcacaactcattaagtaaagcacataaaagtaagaccatcaaaagggtagacataacataatacacaataaagtatttttaagcaatctagtgattgatgctattaactgtattttaataaaagaagcaatgtccatgggtataaaaatttaggtttaagtagataaagaaatacacttaaaaacacgtttgaaatattttctgggagctttttatatgacatttttatccacaatgctgtttctgaaaactgtattactgcaaggaatgctttcctaaacatagtttcacatcagagatccaccatcaattgctaagaatagttttctgcagtcataaaagatctgcaccataatacaaatattttttacatacagtatccatctatagtggtcgatgtattaggcagctcacaaaaccagcactttgtcaccaccaagcagagcaaagctttccaaatatactgcttatatgaattattgctatagaagaactgaaaactaaagtaagctttttaaaaataagagtgttgtctccatcgtctctacagaaattttctcaaacttttttgaataaatggtcctataacagtcagtacaactaatatttcacatggcaatataaagtttatgagtttttggatccaattaattacatgtttctcactgggtagaaaagttgtctttacttttctactacacagtttattactggaataataatagaaaataatcattttagagaattcaattttttctcatactttaaagaaaacaaaatcagaaagctgtgacaatagaatagctaaattaggaacatgaaaaactcatattaaaaattctgagtacatatggacaggaagaggggaacaacagacaactgggcctacttaagggtggagggtaggaggggagggtgaggatcgaaaaccacccatcaggtactatgctataacctaggtaacaaaatacaaaataacaaaataacaaaagtatctgtataccaaaccactgtgacacgcaatttatctatataacaaacctgcacatgtaaccccaaacctaaaataaaagctaaaaaaactgatatgtgacttaatgtgtgtacactaaaaggaacgaatagagctgtttctcctccagtgtcctctaatatcccccaaacattaaatttccacgtgtatgaaagaaaagccatccctctcacttgcccattattagaagcattctcacattccacatcaacaataaaaaaggaagtaatacagatttatcaaacagactatgttaaatgctatatatgagaagaaggcatttaagacagtcttgtccactaattcgtacagcctattgtaacagttgtatgattgaaaacaattttcataaactacaaatagctcctaaaacatacctgcaatatcttctagcttctggatatcaaccctgtaaaaaaaaagttacatcagggaaatttatagcactaaatgcacacaggagaaagcaggaaagatctaaaatcaataccctaacctcacaattaaaagaactgcagaaccaaaggcaaacaaatgcaaaaactagcagaagacaagaaataactaagatcagagcagaactgaaggagaaggagacatgaaaaactcttcaaaaagcaatgaatccaggagttggttttttgaaaagattaacaaaatatatatttaggatagttagctcttcttgttgaattgatccctttaccattatgtaatgtccttctttgtctcttttgatctttgttggtttaaagtctgttttatcagagactaggattgcaacacctgcctttttttgttttccattggcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgcttgttagtcgatgcagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttggctgtaaagtattttatttctccttcacttatgaagcttagtttggctggatatgcaattctgggttgaaaattcttttctttaagaatgttgaatattggcccccactctcttctggcttgtagggtttctgccgagagatccgctgttagtctgatgggcttccctttgagggtaacccgacctttctttctggctgcctttaacattttttccttcatttcaactttggtgaatctgacaattatgtgtcttggagttgctcttctcgaggagtatctttgtggtgtaaaacagcatggtactggtaccaaaacagagatatagaccaatggaacagaacagagccctcagaaataaggccgcatatctacaactatctgatctttgacaaacctgagaaaaacaagcaatggggaaaggcttccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcagtaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccggaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaagtaccatttgacccagccatcccattactgggtatatacccaaaggactataaatcatgctgttataaagacacatgcacacgtatgtttattgtggcattattcacaatagcaaagacttggaaccaacccaaatgtccaacaatgatagactggattaagaaaatgtggtacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggaggggggagggatagcaatgggagatatacctaatgctagacgacgagttagtgggtgcagcgcaccagcatggcacatgtatacatatgtaactaacctgcacaatgtgcacatgtaccctaaaacttaaagtataataaaaaaaaaaacaaaatagactgctagccagactattaaacaagaaaagagacaagaatcaaatagacacaataaaaaatgatcaaggggatatcactactgatgccacagaaatacaaactgctatcagagaatactataaacacctccacacaaataaattagaaaatctagaagaaatggataaattcctggacacatacaccctcccaagactaaactaggaagaagtctaatccctgaatagaccaataacaagttctgaatttgaggcagtaattaatagcctaccaaccaaaaaaatcccaggatcaggcggattcacatctgaattctaccagaggtacaaagaggagctggtaccattccttctgaaactattccgaacaacagaaaaaaagagactcctccctaactcattttatgagtacagcatcatcctgataccaaaacctggcagagacacaagaaaaaaagaaaatttcaggccaatatccctgattaacattaatgtgaaggaaataagagaggacacaaatggaaaaacattccatgctcatggttacgaagaatcaatattgtgaaaatggccatactgcccaaagtaatttacagattcaatgctatccccatcaagctaccattgactttcttcacggaattagaaaaaactactttgaatttcatatggaaccataaaagagcctgtatagccaagataatcctaagcaaaaagaaaaaagctggaggcatcacgctacctgacttcaaactatattacaaggctacagtaaccaaaacagcatggtactagtaccaaaacagatatatagaccaatagaacagaacagaggcctcagaacaatgccacacatgtacaaccatctgatctttgacaaacctgataaaaacaagcaacggggaaaagattccccatttaataaatggtgttggggaaactggctagccatatgcagaaaactgaaactggatgccttccttacaccttgtacaaaaattaactcaagatgacctaaagacttaaacgtaagacctaaaaccttaaaaaccctagaagaaaacctaggcaataccattcaggacataggcatgggcaaagacttcatgactaaaacaccaaaagcaatggcaacaaaagccataattgaccactgggatctaattaaactaaagagcttctgcacagcaaaataaactatcatcagagtgaacaggtaacctacagaatgggagaaaatttttgcaatctatccatctaacaaaaggctaatatccagaatctacaaggaactgaaacaaatttacatgaaaaatgacaaccccatcaaaaagtgagtgaaggttatgaacagacacttctgaaaagaagaaatttatgcagccaacaaacatatgaaaaaaagcttgtcattgctggtcattagagaaatgcaaatcaaaaccacaatgagataccatttcatgccagttagaatactgatcattaaaaagtcaggaaacaacagatgctggagaggatgtggagaaataggaatgcttttacactgttggtggaagtgtaaattagttcaaccattgtggaagacagtgtggtgattcctcaaggatccagaatcagaataccgtttgacccagcaatcccattactggatatatacccaaaggattataaatcattttactataaagacacatgcacacatatgtttattgcagcactattcacaatagcaaagacttgcaaccaacccaaatgcccatcaatgatagactggataaagaaaatgtggcatatatacatcatggaatactatgcagccattaaaaaggttgagttcatgtcctttgcagggacatggatgaagctggaaaccatcattctcagcaaactaacacaggaagagaaaaccaaacactgcatgttctcactcataagtgggagttgaacaacgagagcacatggacacagggaggggaacataacacactggggcctgtcgggggtggagggctaggggagggatagcattaggagaaatacctaatgtagatgatgggttgatgggtgcagcaaaccaccatgacacatgtatacctatgtaacaaacctgcacgttctgcacatgtatcccatataacttaaagtataataaaaaaagaaaaaagttacatcaaaattttaacataatgctacacaaaatgccatgtttgtttaagaagaagaaatgtcttatgtgaaatggtgaaatgttctgcatagaacagtgattatatgatccaaagctgacttctctgcctcccagattcaagcaattctcatgcctcagcctcctgaatagttgggattacaggcacatgccaccacgcctggctaatatttgtatttttggtgagacagggtttcaccattttcgccaggctggtctcaaactcctgacctcaagtgatttacccacctcggcctcccagaatgctaggattacaggcgtgagccaccatgcttggctccaaagctgatttttcttagaagacgttatctgacaggcaaaactgacttaaacactttaccccttgtcttccgcatcgatttcagcaaaatggtctcttttccgctgcttatcaattgctggagtctttcctgcattaaaataaaaaagacacaccttttttttttttttaagaggaagacgctgttgtggacatttttttgtggagaaatgtactatttgtggacccttttggctctctgcccattaaagctttaaagcagcgctatacatggaatcactgggaccctgaccattttacagaggcatttttgcaagctctttgcggtttaagtcccagtaaacaaggcactacgtgtcagatcccttggacgtcaggaccgcatccatcgagaagagctgctctaagagtatctgtaaccctggtatgagggagaacctcccatgggaaacctaaggctcttgagcctgctttgaaaagcttgggcatcttagcacgtgcaaggtgaactccaaagcaacataggggctgggggcctcgggctgactgtctgctgcctgtgtgccccccgcgcagagagcagacaaaccgtccccttgggcgtgcaccttcttccggctcccctggactgtttttaactccatgctccatttcctggttggccgtaacctgagcctccactgggtgaggccttcgcaggcttctccatgagcttcctgcccacgggctccatggctggttgtcctcggatgttagaggtgactcctgaaccttgtgagtgcaaagatacagtaaggaaacagggtgtgtgaaaggagagctatcgggatggtgggttcaagaagcgtggggctggcccgccccgagtctcctgtgggagcaggagggatcgcggagaatatgtcagcatcccctcctgtcctggcctgtacagcctgtccctggggctggccgcagagctcgcagctgccgcgcacacctgaactccgcggcctctgggggatcctcgcggagccattgagacagagctcggccctgctcctgggtcccccagcgaccccgtgtggccggaagagctgtgggatgacagaggatctccccagctatctcagtgggagtcacccggtgtgcacctgtttcggacaatcaagggtgggcactgctactcgcccgcctggatgcccaggggacctccggtgaccccaagtgtcctgtcctgctgggcagccaggcaggagggacccacaccgactccccaacccctgcacatatgcacaggcccctggggctgctcctgggccctgggaaccacctgggcagctccagctctcagccctggcccaccccggcctgccctcagggccttgccctgattcaggccccagacaacgacactggggccatttcctcacaggtcagcctggggcagcccggtgcttcacacggtcatccccaaagggcctcatgccggctttccccgcctccccaccatgggcacaacacctgagggaccccccacattgctccctcagtggacctgcagacgctggcaccacaaggctcctctgagggcctgggtcctcggttctcttgagagcagccagcctgcctgcccgcactcctcgctgattggtcgactcagtgcacatgtgggtggtgggccgctggggccacgccccctgcaggcatgccctccccctcagggaccacccatggtagctgtggactcagggagagggtggctttctgaggtctctgtccccacgatattccagctcctcatcctggcaaaggaagcaaggacccaggagtggggagtgccaggggaccctgccctaaggaatggaggccaagtgaacggggcctaggaccttgcccccaggctcgttccagccacccctacccctttggatgcaatggccatcaccctgagggtggagcccaggctccctcccatgccctgtgtgcttccaacatgcccaactgcattctttttatcaatggattgtgcttttatgttttatctaacaaaattgaagttgcctttggagggtaaaaatatatatatgtatgtgcacacacacacgtgtgtgtgtgtgtgtgtgtgtgtgtgcttaagcaaaggttttccttttatattcatagattacattgcagaggtataatggcatactttttatattcatagatattttatatccttttatattcctttgtatttccttttatattcatagataaattgcagaggtataatggcataaaatgggcatatttaagcctttgggtacttcagttagagaatattcctaaggcaagaattaagatgtattcatgcatcatttctctttataattctgttgtcaagtattatagaaatgtttgtcggtttcatttttatcaccaggaatgattttaaccaaaagctttcaaaaaccctttaattttgacccagcaaaatcaaacatttattcatgtatttatttatataagtttaagggctacgagggcaattttggtacatggatctattgtgtagtggtgaagtctgggcttttagtgttcccatcacctgaataatgtacattgtatcctttaagtaatttctcaacactctcccacccttctgagtttccagtgtctatctttccactctctatgttcctgtgtacacattgctccgttcccttataagtgagaacatgcaatatttgtctgtgttttacttgtttcacttaaaataatggtctatagttccattcgtggtgctgcaaaagacatgatttcattctttttcatagctgaatactattccattttacatataaaccacattttctttatccagttatccgttgttgggcacctgagtgttgattccatatctttgctattgtgagtggtgctgtgataaacatatgagttctggtgtcttcttgatgtaatgatttattttcctttgggtagatacccagtggtgggattggtggattgaatagagtgacatatgctggggagaaacatttagtctatagcagggagtcaacaattttcttagataaaacataaaagcacaatccattgataaaaaggatgcagctgggcgtgttggaagcacacagggcatgggagggagcctgggccccacccacggggtgatggccattgcacccaaaggggcaagggtggctggaacgagcccgggggtgaggtcctagggcccatccacttggccttcattcctcaggacaggattccgagcactccccattcccggctccttgcttcctttgccaggatgaggagctggaatattgtgggaacagaggcctcagagagccacccttgccccctaggtcctcagctaccatgggcatgcctgcagggggcgtggccccacacggccccactacctgcatgcacactgagccgaccaatcagcgaggagcacgggcaggcgggctggctgctcttgcaagaacccgggactcaggccctcagaggagcctcgtggtgtcggcatctacaggtcctatatatatttttttatttaatctttattttatatatatatattttctcaaagtatgtaattttgtggctgaatttaattttatctttgtgcatagaaatctatagacaatcataatgcagggacactttattagcatgacctaacctttgaaatcttgtctaggtgagtcacgaatttagttcattatcagtcagttctctcctagctgggaaacgttcatgcagacacacatggaactcaattagactgggtcagtgtgatatctgcaggggctctagtgatgtgtgaaacacacagggagacggagatctaattttatgatcttcactgtcaataggagagaagaaaaggacttctgaataacatcaccgtcaactgcctcacaaaatctctgaaagcagtgctctaggagttacagtgattgcatcaggagctgcagttttgggggcaattgagaaggaactcctttctctgtataggctgcagagttcctgaaacttctccccaattagaaacatagaaaattattagccttacttaccagtgccatatgacctgggactactcagaggaaagggctgattagttaaagaaaatatgtctagaaagaaaccaaagaacattactcccaaaaggcaccttcaggaatccaactataacatttttgggtagattaatatataatacatatatagtctaatattctaataatatagtaaaacggatgaggtttagaacaaattaggagacacattctgtgtcagatgccaactgcatctgcaattttgggcaaggtaattaactacctggagtttctgctaaattgaggttggcaggggcactgggttgattaatttgatcttgaaagtgccatgaggtcatggactatcttcttatctttattagggagctatttcttacatttataagactcctttactaagttaaaggtgttttccttcctctaccatatacaatttttaaaaactgttcccagctgggcgaggtggcgcacacctgtaatcccagcactttgggaggccaaggtgggtggatcacgggtcaggagttcgagatcagcctggccaatatggtgaaacctgctatctactaaaaatacaaaaattagccaggtgtggtggcgggtgcctgtagttccagctactcgtgaggctgaggcagaagaatagcttgaacccaggaggcagaggttgcagtgagctgagattgcgccactgcactccagcctgggcgacagagagagattctgtctcaaaacaacaacaacaacaaaactgttctcataggccaggcgcagtggcccacgcctgtaatcccagcactttgggaggccaaggagggcggatcacgaggtcaggagattgagaacatcctggctaatacggtgaaaccccgtctctactaaaaatacaaaaaattagccaggcgggctaattagtgtggcgggcgcctgtagtcacagctactcgggaggctgaggcaggagaatggcgtgaacccaggaggcggagcttgcagtgagccgagatcgcgccagtgcactccagcctgggcgacagaggaaactccatctcaaaaaaaaaaaaaaaaaacagcagttctcgtaatttatctctatttctgttttgtatttgaatgaatgacacttaattcatcgagattttttaaagagcattgcagaactctcataagatgaggctggttgtatcatttataaaatatttacagcatctcagagagctctgaataataaatgacttccattcaaataatagacttttaacattttcaaactcggcttttcagtagatatcaacactctcaatctcattccatttgtgagtctactttaaaatacctttaatcaaatgtgtaacttaatagttctattgatagaaatataatttttctctatatgttttgttttgtttttcataataatagtagcaaaagatacaaaccaaaatcaattttctagattaatgttggaatctcctggtttcacttttgagaaaccactcctagtctaaaatgcattattacattgtttgtaatgatatttaaaagctggaggaacataaactccgcaataactgcttcatttttaaatttgacccatcttcggtttgtggaacgtgtctgaaattgcacagctgtttttatttatagtctaactggggaatttcacttgtgaaagatgctgtaacaaaataaatgtccctgtgtccgttgcattctgtggcattctaagccaacaaaatgtcaagaaataccattcaaatcctttcagctacaatgaggctgaattatcattcttttcaagttcttgtttttgagggactgttatagcagaaattcacatgcaaaagaattgctttaatttatgtaccatgctactatttttaacttagaaaaaaaagtcagactcctctttggacctcaatactgacaactttcatcagtaataataggctgtactgttattctgtactacctttattcagcaggaataacaggctgtactgatggatgtactacagtgatgcaaggactccagtaaactggcaggcagtgaagaggtatgcttcaggagtgtcacaaaagtggtgatgactttgcagagaacagagccacccgtttatcggcctgcctctgcttaatgcatgttgctcaaatgcctctatgaaaatactgccccaaatacaaaactatactattggactgcccttcctttataactttgagggatggtcattgccacttgctaattgccaagctctcttacaaagtacatattcaatttatttccctgcctgcaactgtatgatgtatagttgtttccaagaaatgatgactaagaggtactgagagatttttgtcattttttcttcaaaaaaagtcaactggtttcctgctcattctttccatttaagttggccatagaaatcccagtggtgaccctcaggttgtcaaaggcctttcttcttgttgctgtgaggttggcctgctgatagtaacagatacaccccactcacaattatttcaggatcaagtagatccattggccatggagtgatggtcttttcaagtaaggctattttgagaggtaataaaatattcatacacttaatttttcttttgtacttgcttgttttaaaatacagttctgtacataaatatttttgacaagatgagcaatagatctattttttcacattataaaacaaaattattataaagataagtcaaaaatgactaagtagaacattctatttggttattaattttcactggactttcaaaacacttttctgtataacatattcatatattttgaattcagcagtgcagtcagatgtttcatgtaagtggctgggcacagtggctcacacctgtaatcccagccatttgggaggctgagacaggcagatcatttgaggccaggagtttgagaccagcctggccaacatggcgaaaccccatctctcccaaaaacgcagaaaaaattagccaggcatggtggcacacatctgtaatcccagatactcgggtggctgaggcacaagaatcacttgaacccaggaggcagaggttgcagtgagcctcgattacgccgctgcactccagcctgggcaacagagtgagactctgtctcaaataaaataaaatatgtaagtgtaacatgtaagagtaaacataatcttacgtagtgattatctgaattattttttctttacttttattctacatgggtattataaagagttgtgtgttcataataaaggctcccttttctacatagttggtcttcccttcttccctcaacattttaaaaaaattctacagaatttacacaatcaacattcttccttttaagctacattattaatttctccccaaaagaattacagtttttcagcagctgggaaatggaaccaaatgatgtttaattctcccagcagtgaggtgaggaaacatgcacagagcattgctgcccagggagctcccccaaccctggcatccagtatggttttggggcgtgtagtcatggcagactgtctgcatgactgaactcagttgccagcccctccagaggtcaagactgatacaggtggcccaaagcttccactataaatcacattgttagcattaactatctagcataactcaaagctccaggtaaacaaagacattattatcaggcaggatattccaagggcttagaggttatctcctggaaggctgtcaaagagcagatgttctttggaaagtgcagggtttggacaacacagatctgctgagctaacctactactgcactcttattcagctcttattctgaattctctctctctcttcctaaaatgtgcagatccttacggatggatgggaaaatctgggaaacacagcactcactgtaaacacaccatgcctagaatttggctcctcttcaacaacccgggcttttgaactgggtcgaagtcactatgccaggatgacatttttttacgttagaatgaattcccccctggtggctcctcatcctccaggtatacaaggctcctggatgacccatggcctccacggggcacaccacagtctgaatcacagctgattttctggattgcccttggactcagcaggatgattccacatcttccaaattctagatatcctgatatcgcaatattttttatccctgtttcttaatgaaagggtaaatggaggtagaggtgtttctcaacaacctgcaacaacacatgtttctttcaattattcagtacttaattggaaatcaaagcccctttctaatgtatcgataacattgggaattgatgactattgtgtagttgtacttaatctacaccatgctaattcctaacatgggctatggaggcagcagagcggcaggtgacaacatatgcacttctctccctctctgcccaaagctcctggtaactgtcaaatgagcagaggacggggagacaataggaatattttaaaactgtggttttcaggttgggaatatattaatatcatacaacctaattatttccttactttgtctatattgttgtatattacccaagcttcagagctgtcagagcaaacctcaaagatgaggagccagctggcaggtaaaaagcaaaacaaaaacagcccgttgctcaatgactaggatttttagttcaattacatttccttgccatctaaatagccagatgcaatgacccatagatagagccagtgtagaacagatgcagtgacccatagatagagccagtgtagaacctaacataataatgtctaaaggggttagtaattgttctactcaatttgtttcagccattctattggaattcctattaattggaattgatggtaagtatatggaatgtcatgtagtgaaacaaacaaacaatttagagcacaccaagtttcatggacaacaaataacaaatcactttttaaaaatcaataccaaccaggccaggtgtgatgactcacacctgtaatcctaacactttggaggctgaggtgggaggattgcttgaggccaggagttcaagaccaacctggccaacatagtgagacccccatatctaaaaaaaaaaagaagaagaaaaaaatgaataacaacgagtacagtgagatcaaagaacactagctaccatctacccttggtttaatactcttgagaaggctggcatatgtggagtctctccaggaagacatttgaggcagaaaaccagaataggggcaggaaatgtattatttcatcatctgaaatggggactttattaactctcctgagtataaagtcaagaaagaaggtatttttcaggactgtttaattaaatgtcattctgtttatcaaaacagagaaacctggcaggcatttctaaccatatgggatttttggaaatacatgagaaacatgtgattacgtgtttagctgaatattatttaaaatgtatgcaaaatcctgagagggcttttgaactaagttcctaaaatcatcctctgatgcatcctatttgatatgctgctgtgtgcctaaaattattccagtagaaataaagcagagcctcaataaaaccagccccttttaatgagctgcttcttgtaattataattatccataatcatttattttgactgtaagtaatataacaaggcaaaacctataattttctaaagtaatataatcaatataaaaacaaaggtgtttcatactactaacggaagataaatgtatcctgcaagctgaatgttggcagatcagcttgtgctcttctaaatcatctaaatatcatcagtgcctttgattacagcctcgtgcccagtgctttaaaaatcaaagtttgcttttaagaaatgtaatttaaaaactgctgatcatctaaatcttgggaggtcaagggcactcttatttcctttatacttacaagtttaatttgatgttttccaaaatagacttgggtataaatttcacatcaatatgctaagcagagccccatgcagaatatttctgagtgggatttattgaatataaggttatttttatgactgggacattacagttgcaatcatcaatgaataaaaaataaatttaaacaactgtctctagcatcaagttgaaactcaagtctcaatagagcaagtttcaggaagaggtgggatttcaggtaacatggagaacagcagctcagatccttttcttaaaggacgattcccccttgacatgaagccagcaactcactctgcatgcagaacatgcaacacatttccatgccggggagagaagcatgtgacgtcattcattcactcattcagtcattagtcattcccttattcgtctatctaatagctgtcaatactcctagtatgtgttgggcattgtactacatgctaaatatatagaatctcttttctaaactcaaaaagttataagtagatggtagtagtggtcagggtaaaatacatttgtgaaaggaagaaattacagtgacaagtcctataatagatggcaagtgatgtaggatccataaggaagaaggacaaattatttatagtatagatagggaagactttacaacaggagaaattatctgagattagtttggaaggataagaacaaaaaggtactccagtagaaaattgggacaaaaagtagaaaaatggggcactttagtctgggagtcataaaaggtggggtatacttggaaagaataaactttttgtagaactataagagatttcagggtctgtgtgagttatagtttcaggagattaagttgaagatatttgggtacaatatattgaggtatatcataagccaagagagaatataggttttatttttgcaggtcagttgttctcaactgggggcaactttgtgccccctccctgggatatttggcaaggtctatattttgctgttacaactggagaagggggcaggctactggcatctggtaggtggagaccagggatccactaagcatcctacactgtacaggacagtccccacggcaaagactctgccccaaatgttgacagtgctagggtgagcaaccttgctctagataatggagagtaactgaaagattttacatatgggaaagaagtaaagaggtactttctaggaaggtgatgcaacacctcctaggaggtttgccacatcacggtggtcatcaaaacactgggtgtcaataagagaaaaaatattcgcctgcagggagaaagatcaactaacttcttgagcatctactctgtgctggacattcaacgtattataccaatctccccatgatattggcaactgctactttctgcagcaatggggactaccagatgaaacaggatgagactagaggctgggagaccattatagatcaatgttcactctcacatggaaacagtggaggtctggactgtagcagtgtccatggagatggagatgtgagagcaaagaggaaggtcaaatcaaaaggagttttttaccaattaaatgtgagaagggtttaaccaccaaatggaaggtttacagaacgactttgaggtggctggttcagaagactaagtaggtagctggagagactgcaaaaggaagtctcagaggacaggtacagggctacccatacttgtgacctttggggtgcccatgggaggttcagatgtagatgcctggtaagcaaagggaaaaataagtctccagttgtaaagagacctcaaacagatatgtgtttaagagtttgcaacatcacaatggtcatcaaaacactgggtgtcattaagagaacaatatttgcctgcagggagaaagatcaactaatttattgagcatctactctgtgctggacagtcattatgttatcgtctcagtctccccatgatattggcaaggagactgaatgcagacaggcccagggaggtgctcaaagtcaggcagccagtcagaggcagagccaagcttggaatagtgtctcaccaaaaccaatccccatccattcattctttcaagattatttataaagtgaattgctgcgtggagaagagaagccacagaacaggttgagaaagaagaccctgagataggaaaagaaaaagtgaatgatatcatcaagtccaaaggaaggaagagcttcaagtaatagtttcagttctcaattgtaaaaagattcagagtcagaccagaggatgcttctgccataaattgctatccaaatgatatcaagtcatgcacacacacacagagtttatatcagagttagaatgtgtacactgcattagacactgagcatcatcagggtcttgctggagggcaaggagcaaaaaacagaccataattggtagaaaagtacttagagtttgaggaagtagagccaggaagaacagaaggaaggtagggtggttgctaaagggaagatattttacagatgaagattcagacttgagcgtagatgtaggctgaaggacttgagtggaaacaccaaagtttgagtatgtaggagtgagggtctaaatgagagaatgaaggagtttggccttggtgtggagaagggtccactgtttgtttaaaatagtggtcttcaatcttgttgggccagtagactctcttgagaaccttgtgaaagttttagatgtcgccccagaaaaacatctgtaaacatttacaaaactgggtatgatcttagggagttcttgctaaaatctcctaagcataaaatttaacaggctctccttgagagtgaagaggtgctattaatgttattacagaggacaacagcctccatctaagcttcaagcaatcccagattggtgaattggaagtggctggagaatgtgatgaactggatttcctctgtgccggcattgattattgtggcgtgactgaatcacagtaagagttcccctgaaaagagcagtttgagtttgttagaaaaatggcactctggaaattgatttctttcaaacaattcaaccctgtgaaatccttgcaatatccttgtgtaaagccagggttatgtggatgacctctgaaagccattgatgtggaaattcctaatttagaaaagttatcagaaatgtttctggaaatgtttacacctagaagagcaatttggtatatcccgggggaagtatccagagcgaggaaatcaacaggagcccaaagttttgcattctatttattgagtaaaaatatattgattgctagccacatgacaagacctgttccaagtgctttatgaatgaattcattaaatcttcatcacaagcctactaggtaggtacagttattatcctccatttcacagagagggtaatggaggcacagtgagatagcagggttgatcttggtttgggtcagggagtagatttggaacaaggctgtctgtttccagagtctgacctcccacttttactctatattgagaaagtttacatattataatatgttcacacatttactcagtcagttcttttttttttttttttttttttttttttttgagacggagtcttgctctgtcacccaggctggagtgcagtggaacaatcttggctcactgcaacctctgcttcctgtgattctcctgcctcagtctcctgagtagctgggattaaaggcgcccacaatcacacccagcaaatttttgtatttttcatagagatgggatttcaccaggttggccaggctagtctcgaactcctgacctcaaataacctgcccgcctgggcctcccaaagtgctgggattacaggtgtgaaccaccatgcccacccaattcttataagctttcaaatatcatatttgtttaaacacctgtattctttagtgttgtaaaggtaactatccatcctctgacagggactgtagatgagaggaaatgcatccaggaatctaatttatcacaccagggtcctatggatagatttagggttatgggaacagtacctcatcaccggttatagattttgagagccttcaatgagccacctctgaagcctttttaaagatggctggacatgcttaggcagaaggtctctgatttgtgtgctaaagctccttcaaatgaagaagtttcaagtgaacagaaattctcaggtgttaaatgctgctacaactccggaaagactgccaactcctgccaggtgaccagaaactcagtcaacttctctgctaactgacctccaagcaactttacccataatagctaagaataccagccaatacttgctgagtatttcctgtggaccaggctacacacacacacacacacacacacacacacacacacacacacacacacacacacacagatccagatgctcagtttgcacacagtggtacagtagtggagggtcataaaaataagcatgcaagttgaaaccacctgatatggttgggttatattccccacccactctcatcttgtattgtagttcccataatccccatgtgtggtgggagggacccagtgggaattaattgaattatgggggcagttacctccaagctggtattctcgtgatagtgagttctcacaagatctgttggtcttataaggggcttttcccccacttcactctgcacttctcctcgctgatgccatgtgaagaaggtagtgtttgcttccccttctgccatgattgtaagtttcctgaggcctccccagccatgtggaactgtgagtcaattgaacttctttcttttataaatcaccgagtccgggtatgttcttatggcagaataagaatggagtaatacagaggacctgctttgacattggatagtcctgtgagcaagttctgaatttatcatctcacagctcctgcccatgtacaagttacttactctgtcctaatctcagtctccttatctgtaaaatggaaagaataataatattggcttcatagaattgctgtgaggatgtaataggattttggatactaagcacttagcttatagtacttactcaataaacactatttattactactgtgtgctgtatcacagggaagttgtggtggtcagatgagatcattggcattcagatatttagaaaagttaaacacttcagaactttcttctgaaggactttgttgctgagttttcagccccattcagtgaatgtaactaactctcatattagtgcgtttctgcaaaaatgatgaggtcttttgttattactttcattgaggaataacatatatagtaatgtacataaatatgaatgtgcacaaatacagctcgataggtttttaatatgtgaatggcatgttactaccaaccagatcaagatgtagaacatgctcagcaccccggaagagtccctcataccctctttcaggtaatatttattcctcaaaggtaacccttactcttccttctgtcacctaaacaaatctttccttggacaatatttctattattatctctagaattaattgtaatatggaaaatactgttttataagcctcattctctgaatctgatcactttaaaattaggaggtatgcacttcattgctcagacccaacccaagagttccatctgacttcctggctttggacagtgctgacaagtcctcagggcatgccccatgctgggctattcacttggaaggagacaaatgcctaggaggcctggtttcaccctcagagagctagtctaactagagaaagaagccttaaaatggaataccatccctaacagcaaatgaatccataaaaatcatgtctcagggagcaatctcatgttttcttgttttcgaccgtcctgaagacactgtttggtattggtctttcccaagaggatgcccagattaaccacctcccacacagttgggtcctttgctttggggtcactaggatgtggaaagcttgctgccttgccatctgctattgtgtcacaggtgtctgtgaggtctctcatgtaggacatggtttcctcttgacacattagtgaggacttccacaaaagagggcaaagggaggccaatccctatgtgcttattccaagatgtattctatcaggacatgttaccccagttgttcctgcaggtcactgttgtctgtaagacagtgcacacactgggagcagttagcaagcatgcactcatcaccatatgcaccatgaaaacacttctgtgcagtattggtagttgtggagcttgcatttctttaaaagacagaatggcatttaaccacacttattgccatccaaggagctggtggaacataaactgttctgtatggttgcaagcacataagcctcttgagcaagttttctatgctttatgagaacaaaagatgagacattttattcttcaaaaatgggggactccaagacaaaccacagattaatcacaaaggagaagaggaataagcagttgcattgtgcatctctggtcattttgctgaggattttaaaagagaaaatggtgtgctaaagcaatgcttcatttcacattattgcacgtcatccatcattttgtatagttacctattcgtaacattcaccgctatctaattaagtgaaaaaattttgttgtaagtaattaagtgttttttaataggccagcattctcaaagatcatactttgcctgtaaggagacttcaagatgttgtctggagttttggagtttaaagtatatattatccttgtgagattatgtaaactctcatatttgtgggaatacaaatgagcaaaactattttgaaaagcttgattttaccaaataaagtctgagattgcatatacacagatccagcaatgcaacttttacatatacaccctggagtggtggttccagactttaatgtgaaccagactttaatgtgcaccataatcccctgaagggtgtgttcaaacacacattgctgggtgacaccccagagttccagatttagcatatctggagtgggaccatagagagtttgtacctctagcaggttcccaggcgatactgatgctgctggtcccagaactacattttaagaaccaccgtctcagggagacttgtgtacatacacgctcataagaagacatgagcaaaatctttcaaaaacattgttcctaataaccccaagctagaaacaactcaaataccatcaacagttcaatgaggaaatgaactgtggtatattcataccaaaaacccctactatatagcaatcaaaaggaatgatctacagctacctgcttcaacaggatgaatctcatgaagtgttggtgaacaaaataaacaaggcaagaaacagtatccataatgtgattccatctgtatgcatcccaaaacaggaaaaacaaaatcatattctttacaaatgcatgaacagatggtaaaactatgaataaaatctgataattgatcattgcaaaagtcagactagtaattatctggggctaggaggagggaagcatacaggtagtttctcaggtactagcaatagtctacgtcttaacttggcttaacttggctattagatatgttggagttggacttacgattattacttagacagaacatttgtatttatacacatctacatagaatacataagttttaagtatttaagaatcattttatcttttaaaaataatgtcctctatctggtatgtattctgacttttggcaacttgtttgaattttaggatctgcccattggttatgaaaaatcaaatcttttaagctttaatagatggtttagttattctgctgggtcaactattgaaatgaaagaatttttgttactgccaaatacatttgagatatgaactagctatgaacaaagtgttacagagtaaaagacctgtaaggcctaattggagaacagattagaatcttgtacagttagcatgtttatggtctgtgtaataagtcatgacaggccctagtagatcatcttttagatgttgttcatatctatgaacacatacataatgggagagattgacggctgttgccatcaattacattacattaaaactgatttacataatttccccaatacaaattgcgtgactacaagagtgaagattcttatgaactattttcttttggtggcaggagagtcatttttgaaatctttgaaaagaaggaaggattgaatgtgcctgttgattatattgtgatgttctttttccttccaaaaatgaggagtgggggacatctgtaactctgtgaggataccaggaatgctcatttctgtttcataatgcttactctgttttatcctgatattatagtcttgcttttaaatgtattgggctgaatctctttctttacatttttagtgtgtcctgtacaaacaattcttaatcatttttttcaccatatgtttccttgtggcatggtctgcatgtcccctatttgatcacagtgtggattctgaatttgcacctcccacatgctaagttgacagctgcataacctcaaaacgcattctggcaatgatgaatgccaatattttatgatgacagcccaagaatttgattgcagctgcccactgatataagtggtatctttattatttggtgagttaagcagacacattaagtacatttgttgcaaatactagactgtaaaagaatgtatttctgacttattatagtaaacagtaagaaacaaccaaaatgttcatcaatggaggaatggttaactaaattgcagtatagctataccatggaactccccacaaagaaagtagcctgaactgtgttagactccctatgaagagctttatatgtgttgtttcatttaattctcacaacaaccttgtgatattcccattttataaatgaggacacaaagacttgtccaaagtcacatagtaaattgtgcagcaatagttagacctaagttctatggacctccaaatccattttcttatccagttatactctcctagctcgtaaatgtcaaagctatacatgctgttgattctcttctcatggagattaggttcaagatgaacattaagttatgtaaccacagagaagaggaagagacttagataatagtaaaattaaacctatctaaatgtcaaagctaaattacttccaaatgaggtaagtttcctatcattccatgactgaaaggaaattcaagaatatacaccaaaattctggtaatatgtggtatccaagtcaggattttcatgtattctcagagctgttactctgcttaaaatgtcaaattataagtgaagtaagagaaaagccatgcttttgctcaaatgtaattatcgatactgtaaaatatcacttatatgtttatctttataacttctccttttaatatttacagatggacaaaagagaaagaaatctttaagaaagaaactggattcactaggaaaggagaaaaacaaagacaaaggtaaagggtaaagtacccaatgtaaatgcatcttccatggagcataatggttaaatttggtggggttattgaattgcatagatatacgtggttcaactctgttatgaaaactggatttctacagtggaatgtcattaagggctgttttggtctactcttctgtgtttgagcagccctgtactgaactgatgaattcagctggtttgaggagagtgtgacctcggccaagtttgtggttccaattattattttgaccaatcagctatacataaagaggacctgggttgagaagctatggagagcatctctaatgctaaccagctgtctggcaaatccagacaggcagggttagtttaatgagagtttgaattcacctaccaccactactggaaagaaacagtctcatcctcatgggttactgaagataggccattctcagcattttttttttcacccagttgaaaaatatttatttgcaactaacctgaatgcttacattttactttgttacattgcctcagccaagataggttaaagcaaatgcccttaatattttgggggtcacagagccctttaagaatcattgacaatgatgatgctctatcaaaggcctgaaactcacccaatgcccaccctaccaccccctaaattaagaattcccagattagatattcacttgagttaacaagtattttcctttttaaagatccaggaactttagggaatagtcagtggctattagtttttttgttttgttttgttttgttttgttttgttttgttttgttttttgagacagagtctcgctctgtcacccaggctggagtgcagtggcacgatcttggctcactgcaacgtccaccttccaggttcatgccattctcctgcctcagcctcccgagtagctgggactacaggcgcccaccaccacaaccggcttttttttttttttttttttttttttttgtatttttagtagagacagggtttcaccacgttagccaggatggtctcaatctcctgaccttgtgttccacccgcctcagcctcccaaagtgctgggattacaggcatgatccatcgcgcccggcctagtatttttttttaactcttgttttaggttcaagggtacatgtgcatgtttcttatataggtaaattgtgtgttgcaagagtttgttgtacagattatttcatcacccaggtaagcaccatagtacccaataagtggtttttcaattctcactttcctcccaccctccaccctcaagtaggctccagtgtgtcttgttcccttctttgtgtccatatgaacatgtttagctcccacttgtaagtgaattctcagcatttttatgttagatcacagtatactcatcttttgcttcatatgttttgggaattgtttactctcatcttactgttttgtgtccccttgtgcatatatttaggaaactaaaactttagccactctctgaggtatttatggtcatttaaaactgatattcaagctcacataatggacacctgagccccattgacgcagtccaattttttgtgccttttttttttttcaagacagggtcttgccctgtcgcccaggctggagtgcagtggtgcaatctcggctcactgcaacctctgcctcccaggttcaagcaattctcttgcctcagcctcccaagtagctgggattacaggcacgcaccaccatgctcagctaatttttgtattcttagtagagacgggctttcaccatgttggccaggctggtcttgaactcttgacctcgtgctcctcccgcctcagcctcccaaagtgctgggattacaagcatgagccaccgcactttttgctgcttatttttatagtctgttatgaagtggttgctgaatggtatggttgtatgcatttattttcactttatgtgacacagtcaacgagtcttgaatgagaacagccatacacatctcatcttggagtccttttatataatgatagaatttctgctttaaaagtaatggaaggcgatgaaaccaagggtattaaaacatgcattgggatcagtattggacaagagctattccataccattgatctcagtctctacacctatatcttgaacagtcatgacatttggttctttagactaaaaaaaggtgaagaattctaaagaatggaaaaccattgttttacttcctttggagtgaggttactcaaccttgctactgttgtcattttagactggataattatctggggtaggggctgtcctgtgtattgtgagatgtttagcagcatccctggcctctactcattagatgccagtgacaccaccctcaacccaaatatcttcagacatttcaaatgtttatctcaaattggaaaaaagaaggtgaaagtgtcagtgatccgcacccctgactacacaatagaatcacttgtggaacctttaagaagtccaagacccacaccccagggagtctgagttcgtgttcttcagggatacctcaggcatgggtgtttttaagagcgtctaaagtgcaacttctagataagaattttgatccatattaactaggatactcaccaggccacattctgtcacagcagaatctgctgctggaataatgagggctaagggttgtccagctagctattatagtctgataaattgtgttatatttaattgttgatatgtttgtgcccttatttttgtaatgacctaaatattaatagccagcattgctcttttaaactagagtttttgctcattctattcctgcagtagagcacttttatgtctccagattagagcaattttccatatgtatagagcatattaaagggatcactcaggttggtattagtaatgtattctcttttaaacttggtttattctaggatgatgatattgatattgggattcaaatacatctaatgtggactttaggtgatttttcagaaagtgtccatttggctagactaagcagaatgagcatttttgcaggaggttccctcaacagaatgatgagatgttccctcaacagaaggagatgtatgtttgcttgcatgtattatatatacaaagcagcaggaagcaagaatttgaattaacatggaaggaagggctagggaagtaatcgaacaatacatactgggccattatagattttttaaactaaatcatatttacataggctcagtgaaaactctgaaatgttctatagtgcctcgaaggtagctaagtgggaaaaggaaggcagatcctggtggttccaaagaaaagacatatcacccacccaactaaggggagaaatatcaggcttcatggcaaaacaaaacaaaaaaattttaagtagctttaatgtttaaaaacaaactaacctaggcttaagtgaaggttaattacatggcatcttttcagaacataaagccctgtccatgtcaacactgagagtcattacatggatatcctgggaaccagggtgtgaggaggacggggtgccggtctggcacagatgtaatctattcacattatttccttccagttgcgtattagcatttggatttgtaacagctgcacatgtgaaaaacgatcatttgaatccaagagtaaaagaaggaaaacaggaaactctaaatgatctcttgagttaggtcatctaaaaataaatagaagcagccttttagaatcgaattgctctcccaatagtgattcataaatggttgatatgctaccatattaattgatttcatcagaatgaatcatatcctgtatgttatttaattgccttgatatacagcagatcttgtgacactcctatgttcctcatgccacttaggcagtgcccatgtgacttttgatttacatatgggaactaattcaagattgacactgatcagaaaacatattttcatacagaataattccaagtccttaatttctcttagttatatttcttggcaaccaaaagtgtttttaaaactttcagaacttcagaaaatttctgtgtcaaaagtaattttaaaattaagtaattttaaaaatagctactttgttttattaatgtgcttcctaaactgagcacatggggaataggttttactatgatgtaactctgggagattgtaccccccacaacccctgccaggacattttcagattatgccatatatgtatctacatacaatctggaaagagttcaattctggcactgttctttttggtgaaagcatattgtatcatgttttcttttcctcactgtctaggtatgtaactgtatgtgagctgtgaagtaacactatatacaaatagctcatacaacttttaattttgctccacattaaatagcagaataatcaagttatcagttatcactatgtagaaattctcaaagaacatatattgaatgttgtcattgagtgctagtacttctaggataagaagagaagaaagaaccagggagtgtgtggtttctgagaaggttaggaaggggccagctcacacagtactgggccacagcatgacttctgatttggaagttcaggagaaagataatggtaccttaggctagggtgggagtgatcgtggaagtggagagaagtaaatggaaaaaagagataatgtgaaagtgacatgataaagatttgatgacggagtgaaaatgagatgtaagaaggaatgaagtatcaaggatgactctcagatttctggttctcccacatgaagaacaggcaaacttttggaaatctgagtaagacctgataagggaagatgaagaataagaaatgcctttgggacatccagatatgaaggtggaagaagtggttggtgctcaaggaaggggtctgagctagaggtagcaatgaggtgtgaaatatctatggatggaagtttaagttacgggcatcgtgctgtcacttacagagagagaccagagtgatgaggatggttaagattgagctctgaggaccttccacattgaaaacccaggtagaagatgataagccagaaaaaggggcaagaatgtagccagagaggtagagaaaaacccagttagtatatccaggatgcaaaggacagggagcatttcaggaaatggcgatcagggttaaaggctgacagaagggcaaatgaaacagagctgtcaaaaacactgaatttaatgaccctgaagacagcaatgatttagagggagctgctttagaatctaatggaggtaccagctagacgggatgaagtgaggaaagagtggtaggtgagaaagttataagctagaaagtaaagggaacactttagacaattttaactgtggcaaaaggagagggggtaaaccatggagaaaagaaaagagtgggtcgaaggttgtttatttttttaagaaatagctgcttgaataaatttagtacaaaatatctagtagaaaaaaagaggttgaagatacaggcacaagaagatgtaatttatagcaggggtggcccaccagccgtctttgtaaataaagctttactagaacacagccatgcctattcatttacttactgtctgtggctgctttcctgctaaactggcaggtcgagtagctgctacaaagactgcaacctgccaacagtgcggaggctggagtgagacaaattgagcccctaggctacagaattgaaagaaatgccaagtctgcatgctgactctgcacttgccccacgctgaatgcgagcaccttatcattttgcatcctagccattctaagccccagccgtatccacaaagcctaaaatatttactatctggccctttacagaaaattgctgaacgctatttatacctaagagtattaggataatttttttgagctcttgagtgcagtacaccattatccatggtttaaagttatccatagttgaatggcaggtgggaaagcatgggaaccagggagaggcagaaaggctggcaggatgccaagtcacacctacatctcatgcaaaggagggtggtggagggcacaggtacagcaggtgtgaagagttggagcctttgcacctgctggttgctcttctcctgaaacaggaggcagaattatttgctggtggggaagatctgccccagaggtataagaagtctctaaacgagtctggttggttttccttagatggaaaaaaatgactgggaaagggctcagtagtccctatcttatagtaaatccctgccatgcatatgcccacctgagcagacatgtcacttgctacatttatcaatgttcttttcactcttattatcccctctgtttctgttatttcatgtagctgtcagccttaccatccacatgtttccagactcttccaaccttttaaaagtaatatttgatcatttctacagacaagattatatgtatgtgtgtgtgtgtatgtatgtgtatatatagagatatatctatatagatatatgtatatatatatatatatatatctcctcagggtacataacaggaggtctggtactatcccctttggtttctaattttgctagtagtagacacagcctattatcaatagtgagaattacacctcactacactgtctaaattgatcactcaaaggagaagtacctaattattttttattaccatatatcacctagcttgttgctaaagaatggcaagcatcctctgaaaatcccgaaatactaaagttttgacttttttacttcaaaacaaattgcatgctttgatagaaccagaggtgcaggcttttcaagtagcatttctgcttttaatgtagacttggtcattagcccagtgatgtttgaaatattgccatggatcaaggaggaaaaccttttaaagtctctttctacctgatttaatgttagctttttctttcaaagaacaaccaaccttagaattattttcccttgatcattttagtttcattcatagggcttataaaaacaatggagaggttagattccaacttactgctgctaggagacctaatttggagtctaaaaagaataatacatttgattacattatttagtgcctttcagcatgaatctaaaatattgccaataaaactcctggccctaaggatccaaggtacatgtatacaaacagatttacgacagaaattcagaaaggaactctatgtatgtctccaaataaagccattgatttctgcactatgcccctttccccaaattctccttactaaaggatttaacaaattgtttcctgggcctcccaccagatatttagtggctgagtccactctgcatgtggccagtagaatggcttgagtgtagatcacgagagtgacagccccaacatagctggctggaaatagaatgtagggatgaggaacacaacgaaaacagagtggacttcttcccaaccagttcccaagctgctcctctgcctgtcaggttatcatttcacatgctaactcttactgggaacctcaaagtgtattcagttaactaaatttcagccttagtttcatgcatctctctaacacctgatactcactctgttatcatgatttgcatttctgattatccactccttcaccccaacccacactctgaacacctcaggagaaaggactgtaccttttataagctttgcgcctcccattgcctagcttgttgtggcatgtagtaggcattcaataaatgcctgttgaatgaatggatagacttgaaacatggagaaaaactagagacctaaatgtctaagatgtgtgtttataaatactagttttctttattgaaatggaaacttgggccattctgattaacacaaatgtcacctttttgattgatgagtcaattcttcagaaaacattcctttgaatatgtctgttcttacttaggtctgaaacataaatgagagtgttcactggaccagtcagtctctgaaagtgaatgtctgttttttgattccagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggagggtgaggtggccagtatttgctctgacaccagtgctaggaaaactgaagatgtacagttattctttgcgtttttgttcatgtgaaaactggatatgtagttggtgttcaggtatctgtcaacaatgccattaatgaagaatgtgcactgggcacgtggcaccttgcatagcctcagaccttgtcctgactcctcttgaagctgttgggtgtccctcctttgtcacatctttgctccatgctctcctaaacattcggcaatatcaccattaattctggtctcttgtaatctgtcagtcttgccatacttgcccactagactgtgaggctcgagggcagggcctggtgttttagctattaatactttcttcatcaccagtctgagaacatgcctggccaaatgaattggcggtgggtcttcataaacaatgagctttttctttatcaatggagcatttctttttctcaaacagaaccatagaatcctctatatatcctctttcaaatactctaactatatggtaccaattgttaagtactatgttctaggtactgtgctattatttgaattgttcatgcaaactggttggtgattggctgagtcagttgataagcatctctaaagcttccaggtcactggaagatcttctctcccttttgtaaaacaaatctgcattttatttttatcttttattttttgactcagggtcttgctctgttgcccaggctggagtgcagtggcatgatcactgctcactgcagcttcaatctcccgggctcaagtgatcctcctgcctcaacctccccggtagctgggactacagatgcgcaccaccacgcctagctgttattattattatttttagtagagatgtggtctcattgtgttgcccagactggtcttgaaccttcgaattcaagtgatccaaagtgctgggatcacaggcgtgagccgccacgcctgaccctctctccctttttcctctgtcacgtggagacctgaaatttttgccacctccagctgttgaagactgccctagttaaaaccccagacacttcccacttaaaaccaacatttttcaatcagcccctaacatttagggcttgtccaaggtagagggggacctgatccattgctgtttttgcagtattgactatgtttaaaaatgaagaaattacaaaattatggaattcctgaagttgcatgatggaattgttcttctaattctgtcattgtgtctcagactgtgtattgtcgtacaacaataacactaaaactctaaattttagctttctgggaatgtaggactcaggcaatggttttcccaaatgccctctcgtctgtccaggcctggctagccaactgctttctcagtgcttcatcaagtatgggtgcggcaaatgcgactggtgccctgctccctttccctgaccctttaccattcctagcatgccagctcatcttccatctgccaacaccttatttatttgctgagggctttctctgatgccagaggcacccagcctatccaaatggcaggctgtaagtacttaggagataatattatctctctgcccccaccagaggctacccttaagcagtgattcctgaggcctggtgtataaataccccagctctctcacttgatagggatagctctaaggtgcatgatctacagctgtctcctagagctccccagaaagattgagctccagttgcccacaatgataataggcttgataatgctcccttcatcagctgcctttccttccttgtctcatttcccccctcccctacaggtgtttcccaggaccacttctctaataaagcactttgtgttgtttctcgggaaaactaagctaaggctgttttgtggaatcattctattttaaaaatatacttcctagagccatagttgagttttttatttacaagacttctctgactacctcattgattgagtatgtaatttttttcttgtttcaagaaatgaagtggttgggccaaaatactttaattatatgtttcccatcgcttgttcttccatttggaaaatgttgtctattgttgaaattgtaactgccattagcttgaggaaatcttgtagaggttttctaactttttcaaaaggcatcttttttcttttaatttacaaacagaacaattaaagaaatcaagcagtagtatttcaagtgtgataaagagtcatgagcaaaagtatgtattggttagcatctgggggcagctgggttttttggctatctgtactttatgttcacggctctgtgtcacttgcagggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggtaagtagacttgtctgtctaaagtactaaggactttcatttattcaagcatcattcactgaagtacccaatgtcaattctgcttgatcaaatgatcaagctctgaactgaaatttactgtgtgaaagtgtacagatgtgagtgtttgcttaagagattgtggggctaaacaagattggagaagagggtgaatcaacttgatgatattcagactgcttagctcccagtagtcctcagaagttaccttggaggccaagcagtttagggaatgatcagatctgttgggctgggtttgtcaccaggacctctttcaaacagaccagagccacttttattgtttatacataaaagtagcctaggaggttactcacaaagtttcctttaaaaagtaagagtccaacttaaaaaaaaaattggggaatcattgcttaagtgaatagaaaatacatcatttttgacaacaggtttacatattgctatttgcatttttgtggaagctgtccacttaaaatttctccaagccaccctttgcaactcaattctagttactaagttgacttaagaatgatatacagttcttcaaaaatgtttctgaaatttagacttctggcttattaactgccattttcataaactaagtttgtatgctatagtgtttgttagcacgtgttttatatacatgggaaaagcttaattactttttttaactgtaaaaataatatgctcattgtaataaaaaagtaaacgtgaaagcaaagaaaattctgaggctaccatatagatataactactgttaacattctcatctatttccttctaataaaaatggaactttattttaaaatcattaaggatatatttaaatttcttaattcattacaatggaaatcataggataacatatggatgacctaataaaactaatgtagcaaaatcttatttgtttatacaaaattttaagtgtaggttcttttaatttttttcaccttatctttcacttgcctgtgtatcacctatgtatcttgaatatacatctctttctctatacacacacatacacacacacacacacacacacacacacacacacacagtcatgcaccacataatgacattcccctcattgactgactgcataggcaatggtgattgcataaggttataatactgtatttttactgtacctttactatatttagatacacaaatacttaagattttgttacagttacctacagtattcagcacagtcgcatgctgtacaggtttgtaatgtaggagcactaggctctaccatatggcctaggtgtatagtaggctataccatctagggtggtgtatgtacactctatggtgtttgcacaataatgaaattgcctaatttattgcttctatcactttggaagcttgaaaaccggataatcacactatttagaataaaatacaggattatatttcttcatctgcaaaatgaacgtaagtacccacctcaaaagttgtgcaatgattcaattaattaatgtgcatacagtacttagaatagtacctggcatatattattatatagagagaaatagactctgagtgaactgaatgaatcttctatgtacgaaatagaaaacttcaatagtaggtcacagtaattttaattttggctgcatttatttttttattttcacatggtttctgaataattaaaatttctacagaagcaagatatcacataaggacattttctacacaggtgggactattctctttctaccaagagatagaaaacacaactaaaacaaattgagatgtttactttgtttctggatgtaaagaaataatgttataaagatttaaggctgggcaccgtggctcacgcctgtcatcccaacactttgggaggccaaggcaagaagatcccttgagcctgggagtttgagaccagccagggcaatatagcaagaccccaattctatatttaaaaaaatacaattctttctgatttaattatatattgtactagtcataaatttttcagtggcaagagaaaggaactcagaaaaaactagattaagcaaagtgacctcccccaaataacaacaacaatctttatatactgggagcgtgatctagatttaggcacggctggatccaggattcaaacgatgtcatgagtgtcctctgtttgctggctttattctcagacagttctcttcatgtggcttcaaatggcggttagcagctccaatatcccatcactctcataactgattgtctcaaatgaagagaaaatgagccaccaatgaaagaattaatatacatgatgctcatcaatggcaatgatcaatgactggcatagaaaaaggagagccattcagacgtttcatgctcccaaaggaagtacacaatactttttgtgaagtattcttgccctataaaatcacaccgcaatcagagtaatgtctggctctagctatctctttacagaaaataaaagagggagaagaacatacaaatgacactatggagtgtccaaatccaaacaatatgaagatctacagtaggaaatcactgagatttcttcaccaaaacaattataaggaaaaaggagacagagggaggaaacacagattaagagactaaaaggcacatcgaccatatgacagtgtgtgacctttatgtggatgttgactggaaatttaatgctattaaggaactattgttgaaatttctaatatgtgatagtgaaattacttgtgtttttaagagacctaattttttagaaatgagtttctcaacctcagcactgacactatattttcacatctaggacatgatcctaggaaaagcaatcagaaatgtgaacaaaaacgtgtgcacagaattgttcacaatagggtcatttatagtagaaaaataagcatgtatattttggggacctgtgcaccattcagaggggaatatggagtaaattatggcccattcatacaatagaatattttgcatcttttttatatctccatagattttgggggaacaggtggtatttggttacatgagtaagttctttagtggtggtttgtgagattttggtgcacccatcacccgagcagtatacactacacccaatttgtagtcttttgtcccttttaagtgacatttataaggaattgttactagcatgagtgaaaattcatgcgacacgatagtgagggaaggcagtaacattctctctgtcaatagatattatatatatgcagtgtgatctcaactatgtaaaaatacctacattcatgtagaaaaggctggattttaaaaaatgaaagattagctaggcacagtggctcacacctgtaatctcagcaattttggaggttgaggcaggtggatcgcttgagcctgggaacatggcaaaaccctgtctctccagaaaatacaaaaattagtcaggcatggaggcatgtgctggcagtaccagctaccctggacgctaaggtgggagaatcactgcagcccagaaggtcaagactgcagtgagccgtaatcacgtcactgtactccagcctggacaacaaagtgagaatctatctcaaaaaaaaaaaaaaaaaagaaaaaaggaaaaaaaagaaagaaagaaaagaaaagaaaatgaagagtgattatttctgcatcaggtatttctaaaagtatattatttttacatttttccgcattttctagattttctttaagaagcacactttaattatgatcagacgaacaagaaatatcttttagaaattaataaagagttagaatccctataaaatgtgtgtttaggtaataattctggataatggacaaaagctcattttctctgataaggagaagattagaaatataaaatatcacaagaaaaatatttgatcagaaacatttaacgtaaaattctggtgcttaaagggctgacctttaagtatctggataatagaaatagtgtgagatgaaagaagcattactgtatgctgtcaagttactattgctctacatgttacggcactgtgctggcattctgctctgtattttgatttcctccagggtctcaagccatgaaacaagactgttcattttgtttgcttatttgcaggcctccagacagtggggatattccgagttggaagctcaaaaaagagagtgagacaagtaagtgaaaagtaaagattatattttgtttcacatgactttcaattgaattaccttttgcaaagttcaagtttatgcaaattccattttgattatctttttttttttttttaccctccaagctattataatataattgaattccaggaggtaaaaggcaacaactcagaaatgttgttacagttaggatcaaacacttgaaagcaaaatgtctggatgtatctgtgccacgtgcagccaaacaaaactaatttataaacatcttattgaaaattgcaaaagcaggaaattcagagtgactgatcaataaatgatataaagttgtatgtagcacccgcttttactaaaatgtgatatgaaaaatgccattaacattcccttcacataagatgctatgtttatagctttactttatcaaaaataaataattcttatgaagtttccatagaaccattgacccccagtttgcttttcacatagagactgtgctcctttgtttccttcagccctgtgcaacattcctgcaactgaagtttgatattagaccttcaacaataggttcctgtgatgaggcaggtatttgtgttcatgatggcttcataaaaggcaaaccatcctttgagaaaagagttcatttgttggtgaaggaaaattaaagcattattttcttcctgttgttttcaatggaaggagataaggaactcagcaactcaaaaatgaattcaaatgaaaataaattttagttggaagaagctgaagaaatgatatttgttcatattattgaaagtaattgaaataaatacctcatttatcttttttgtcaagacaaaaaaggctttcaacagaaatatgttttctgattggttggttggtttttattcttaatagttacacaagaaacattaaatggatcaacatttaatgtttcacaacagaacttgcaggaagaaagatagtacagtaacatttctgtgcagaattgcagaatatttttacaaatattatctcactgaatctgccaaccggctgtgagtgtagcccctttgacccacttctgtcaaggcttatagagattaagaaacataattcaagatcacacagtttaaccagtcaccattaacttcataggccaaactctttgcatgttccattctttctgcatgtacgtatactcagaaaagaagcatggtgtgtttgaatgatcacaagttggaggagtgccagtggaagtcttctttgttttggctgcctgacacacgctgatggcgtgctgtctggaatcaatgagtagttcaggacagtgatgggtattcattctcatcaggtggacaggtagcgagtgccagaaattactcatcagttatatcgggatccattaaaggggaaacctttgcatggagttgtatttaaggattacccaataaaaatataattagtgtttacttagaagtagatttcaagtatgaaatatgccctaactcactcatcattttactttgttatataaccccttagcaccctgcactttttccttagatcactagccacaatgttaagagtgaattatttgtgggattacctgcttatcacattgtttctctagagggactttgcctctttactcactagtgtattttgtgagcctgtaacagggtctgacacaggaaatgcgtagtaatctttgttgaatgaatggatggatgaaagattgaaaacaaatgaactcttagagaagttttttgcatagtgtaggtttatgaagttacataattatttctacagcagagaacaatgcatacgaaaagttgagctgctagagataaaagtagggtgtggagttattactcccttgctactgtgttttcttgctgctgcaagtgataatagacctagtataatgattaaggcagggaatccttctggtaattgttaataagactactttgacaaatctaagacagcttttatttagttattgtcatcttttaagtcttagtcataaatgtgttatcagggctcttaatttcatttttgcagaaaaaaaaaatctctttgctttcttatagagtgactcagtaaaatatcaacatccaaacatggcaggattggtgacacacagaaatgctgtgtaatagattaattcctccctcccacatttatagctgacctaaattgtcttctacctcttaggtgttcctcctaacctggttgtcattaccaagcccttctgcatacatcattaacaataaatccacagatagttttatttaataatgcttatatatatatatatatatgtatacatatacatatatatgtatatacatatacaatacatatatatacaatacatatattgtatatatgtatacatatatacatgtgtatactcatatatatacatatatatgtatacacacacacacacacatattcatagctggactgtgtcaactcggcagatcaaggtgaggatgttgtttgcttccccttcttggggtctgtgcagtcttaattccagatgctacgtgtcacagcacttctcctgctgggcactgctcattgaggtatggtgttatgtgactgccactcgaaccattgttcttccagttacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctctgtgcgtaatacagccatatgtgggaaagtggccctggaatactaagatgtccaactcattcatcataactttatgcatatgtttcctgataactttttgtccttatttatcaatctctaaagagtgagctatttgagggaatttctcagatttaccctgggaataattagcaagaagaaagttacaataaaacaaatggaaatagccaagaagaatttgagatgctttcaaataacccaagaacagtaaaaagtactatgagttagtgcttagagtaccaacaagagttcacattgagtctgtgcctaaaaatgagtttgtgtttctggtacgaagaaggagggaaccacgagaacccagagtgagaaaggagggcagcaacattccaggagaagcaagatgccatagcccagtgccagggctttcaacatagctgcttctgggctgtagctacagatcccatgaagaagaaaaaaaggaggaggtagaggagagataggccaaacctgggtcaacctccatacatttcttcctccaatgctgccattcaaataggatcacaacggagagagaagacattggctttgctgtatcttggttattgccaacaaaatatctgtcccttgtgaattgctcaacagaaaagagccttaaatccattataaactcaaatttcagaatgttcaccaattttcagccattgttaataaatatttaccaaaaatggaagactgaaatccttaaactaggtgatgagtaatgccagggaaggggggagaagaaagtaagggaaattgagttaccttttttttttttttacctggattacagttatttttctaggtattacacttctcgaggtctaatttggctttatatctttcatagaatcttgctggtaaattgctaaagcaatgggcaaatgagtgaaggcatgaaatgggaattgccttgataatccctttcttaagacaattgagaggaggcctttcctctgtgcctgaatagtatgggctccccttttatttgagtacctctttttgccttgcttagtgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtaagatgcctttgctgccatagatgccgtgactcttcctctcccctattttaaaagggcataccaccaaaatggccattttgcctggaggtaatgatgtctccccttctccaacctagctgtctctgtaggaagagactaatgcagggccttctctggaggcacagttcctaaaagtgcatgggccatgagcctccttatatgtttcaagtatgcttccaaatgaggctgtcattttccatggtgaggctttactcaagactctgaacttccgtttgtaaagaagaaaaacagtgaactacagaagtgcttgcaaccatgtaaaagtggaatgatgggggtgggaggagattgttatccttataattgattttacctgcttctataacttggagcccaaatatgatgtcacctctttattcttccagtttatccctggagctcccatctgcactatgagcaagaagtctagtgtctccctttcaagggatcctttcctttcttaaactctccccccaaaacagggacttgctcgatgcaagggagggtcagtcctgcttccaaaccaggtgtggaggaaactgggtctgatctgctgaccattgccattgtgtcttgatgtcacatggtatcaactgctcaaagcaggttgtacatagtcccacagactctttagaaatgttcttgttggatctgatccccactcaggccccagtgtgccccccccccgcccaccaaatctaagatcttgggttctggttctctttggttacactcatatatttcaagatttttttttttgtttcacccttggacaaatgagatgctggcttgaattttaagttgcttacttatgggcaacgtatttaatcttcaccttaacaagagacacccccttccctctttgataccatgcagttatacctctccctgacctcggattcctcaggaggttttagactccttaataagctaacatgcactgtaaatcaataagaaggggccagaggcattccaaacttacttaaccacagaaacttttttgtaaattcttgttaaacaaagctcagctgcactgcagcttcagttctgtgtttgtcaaatttctttcccaaagaacgtggttatgtataatttttttcactctaatccagaaaggcaattctgcatttcttctcgtcctcctccttacgggtgtgagaatggaactctcctgacttagccatttatctctatagcagttataattagtgaagccccagatggcttcaggtttcataatgtggcactgacaccttatttcagcatacacagctctttgatgggcatactataattctcataattgttaagtagttttattactcatttggatgccaacctctatcaactacagttataacagaagctgtagcatgatctgcctaattgctgggggaaagcagagctctgtgtttaaaggtactccagttacttctctgacatttcttaagtactgtgtgagaaggagaaaattgggtctcaggtaattaggaaggcattgaggaaagcaaaagttccaatcgaactcattgttgcccttttagaatcattttcagacattctttccattcaattgctgaacaagtctccattgcctatgccaaaaagaagaaaatattcttggacaggtgtaaatgaaacagcatgctggaatattagctaccatttatgtctctccttccatgagctggctttgtgctaggggagatatatatatatatatatatatatatatatatatatatatatatatatatgcatgcaaatacatataaatatataaatatatgcaaatatatatatatatatatatatatatatatatgcaaatcctcttaacaggcaaaagagatatcactgtctccatgtttcagaagtgaaaacttagggccaggggagctaagtaacttacctagcaacccacagagagcttccacttaaggttgtacgagtggcatattagtgcatttcacaactctaggggaggtgccatggaccccatagtcactggagatttgcagagttattaggacagtatcccagtggatgatagaaaaagatcttgaagaaggacaatgtcgttatactggttaatgggttgggttggtccccttactagcaaagtccaagctgtgcatagaacctgagccagtctaagagaaaagacgtacagaataggaattagaagaaaaaaaaaatgtactggggtctaggtcatggtttctcagcctctgcacaattgatatttggagctaggaattctttgtcatggggccgtcctgtgcattgtaggatgtttagcagcatccccggcctcttcccactagatgccagtagcagtacatctcctctcccaccaagttgtgacaaccaaaaatatctccaaacatttccaggtctcccctgaggagaagggttcaaaatcacccctggttgagagcgcttgatagctctttaattcactgaccatgtgttgttagaaaaatctattaaccttcctatacctgggtctcctcatctgaacttgaggaatgaaaattcttcaaccagccttgaagagtggttgagagacctagtttactgtaaggaatatggaattatcctggtgacagtgaagttgtaaaaggaagccagggtttacgagggtttctagacactcttgacctgaacattgcatcaaaatgaaagactaatagccaaagattaaagcagcaggagaaatataaggaaagcattgcttccgtgaaatcgttagcagtgacaggagagcaggcagctctcacagccattgtgaactgtagtaaaggctacggagcagtgaagtactgagggagacaatgggaaattgggccatgttcataaattgctgaatgcctctgtgcagggcaggtggttgattcttttaagctgtgaatccttggaaggattcaactaatgggtgatatgatccacgttgtagattggctagagacaaagggagagtgagttaggaggcttttgtatcaatagtaatatggacaacagcaattcctattataaacatttccatgtaagaatggccttggcgggccaggcgcggtggctcacgcctgtaatcccagcactttgggaggccgaggtgggcggatcacgaggtcaggagatcgagaccatcctggctaacatggtgaaaccctgtctctactaaaaaaatacaaaaaaaattagccgggcgtggtggtgggtgcctgtagtcccagctactcaggaggctgaggcaggagaatggtgtgaacctgggaggcggagcttgcagtgctccgagatcacgccactgcactccagcctgggtgacagagcgagactccatctcaaaaataaataaatgaatgaaagaaagaaagaaagaaagaaagaaagaaagaaagaaagaaagaaagaaagaaagaaagaaaagaaagagaaagaaagaaagaaagaaagaaaaagaaagaaagaaagaaaggaaggaaggaaggaaggaaggaaggaaggaaggaaggaaggaaggaaggaaggaaagaaagaaagaatggccttgggatttgaatcatgcatgtcctgagcatctaccctaggttcctgtaaaccaacgactattgctcagaaattttctaatgactggcctcaggatacaatggcatctaagaggtggaggaggtgaggacacaaggcaaatatagaattagggaatgcactgcagagtcattgcagacattcggagaagtgatgagcatgggccagaaaagttaggaatggcttcatggaggaggttgaatttaagatgcacatcaaagggtgtgtagggattgagtacatggaccacataagcacagcattgggatgggagttagccaaaccccttctgttagaagtcaagggtagagggagaggatcaagagaggagttatttattattttttagttgatttggcatgagcaggtagagaatatggaatgggcagactggagtaaaactaaataccaaattgtaaaatatggtcaaaaaccaatatttttcaacttcttctcttccctatttttttagtatgtattatctatttgttagggtgttgtttggggggattgcaacatagatgaaacctgaagcagattgtcaagaagcttgaaagctcacacaggttctgccagcaccttgctgcataacttgtctttatgaaagagaggaagaggaaggaaaacagagttgggatggggggtggtcttagcttcctcatctacaaaatgaacataatattttctctttgatatgtgcttaaaattcaatgcatcattcactggtgagaccttaaagatgtctaaaagaagggcatgagaaaaattgttgaccaatcagtgcttttttgggaaaaaatagcagtattttattgaattgtggtgttttgctatcttgtgtttgttttgttttcttctattttgtttagtttgctatttgctttgctccttagggaaaagagaaattcccaagtgtaagaaacattgcatttcttcaagaaagaatatagcaggaacaaaattgaaacctcctgagcagtggtttttcagagttcaagaaccccctggcactgcctggaaaatgtggtgtgaatatgcacttgtttggtgagagtccgtagctggcattgagttctcaaagggtctatgaggcaaaaaaagaagttacaaatcaccagtgtagggccatgattactaatctctgaggaggtacatgcctctaggaaatggtggttggctttggaacttagcaagacctgtgtctcccctcaccctcattcagccctgttttaaagctcgttttcccgtttccccatgccatggctgggtctgcccagcaagaggaaacaggaagagatgtagcaatgggatgaagagagtagggctgcctagagtggggccaccagcttcgcttctttctataccatctcctggctctgagctttggacatcacttccctcgtctataaaatagggacaacagcagcagctgtttcttaagcttatagtgagaaagaattgaaatggccagtggaaagcccctagcctggtacctgtacatattagacttttaacagatatgagctattcatatgaagcttagaaatgatctaggatgttcatttagtgaagataaaagttttcttgaattgctagctaattaaaaaatgaagtaatggcctggctcgagtgtacgttgtattacctagacacagccgtatagtatatatataaatatatgctgaaacacatggagaaaaggtggatgttgcctgggagcaactcttctttccctgttaaaaaacaataaaacaaaagaaaccccaaaagtgttaacaaaccccagcagcttggtctgcagctggaatctgtgtgcagttttacagatgggttgtattccattcccagaatagcaacaggagaaggaaagagcggaaacagagctctagattgttctcgtatgaaacattcttttaaaagaaaacaaaatcttccatttgttaatgttttttttaaaaaatgagaaaaccctaatatgactttacaggggtaaggggaaacactccaaatacctctgagttctaaagggaggaatttgaaaatgacacgtatttgattttcaccttaaccatgaatttccaggaaaagaaaaattaaatgaaaacttgtcaatgaaataaaaaacttaccaatgaaataaaacaaagaaaaatgattggacgatcctacataaagggcactttctttgaaattgtcagtgtttatcacatgaaatgatatcccttggaggccaatcattcacctgaaaacagccttgccttctaaaaataatacaactcgtgtaccaagctgggattgcagggcagggcagccaccagctcatgacgccacaggatgagagtggggttcagagggctttgtttcagctgttcattgggactcctgaattctatgctgggcacccaggtgtttctcaaaatctatgtagatcttcccaggcaaaagatccccaccaagcagacgcagttcccatacttatcctgactctcaactgatattgacaagagaaataaaaattcacatagaccagtggttctcaaccaggagcaattttaccccacaggggacctgcgaccatgtctagagataattctggttgtcacaactgtgggttgagggcaggggtgctcctggcatctagtgggctgaggccaggggtgctgttccacatcctgtaatgcacaggacagcccccacagcaaagaatgatctggtattacatgtcactagtgtcgaggtagagaaaccctagcctagagaaacttactcagactctcccgttcacctgaaagaaagacaagtagaaaaaattcccaaacctttgaaaacgttcatattccttattacaacaattcaacttgtaggaatttactcctaaaaagtgctcacccgagctcacaaaatatcttttcaaggatattttttgtaccattgcttataataacagaaaattcaagacgacatcaatgcctattagttgactgtggttaaaaaacatcatggtttattcgtgcagtgggattctaggggccaatgaagcctgaagacaggattttttttttttttgtagtggaaagattattgtagcatgttgttaagagatagtaagcaagttacaaaataatatatggatgtgatcccagttttaaagaagaaaatatcaggtgtacatgtatatatgtgcacaggaaggcataggaatggctgattcttggcagtggtgaaattatgggcatttttttttcttttggcttacctgtgctttctaattattaatatattgaatgtgaataattttttatgcttcaagcaaaaaatagttcccttccttcaccccgtactcccctttagctcctcctacatttcttcttcctccttctctgtgatatcttttgaagaaagtgtctacattcactgtttccacttctgcaactgtggctcattcctgccacaccactgacatgactcttagctgggacatcagaaccatcagagagtccattctggagggaagggtcacatctcgatgaccctctgccacagttgataactcacttgaaactcccctgtcatttcttcttggacacaggtttcttttatggtaacttctcacccattattggcctccttcatcagctgctccttaagggtgctggagtctccaggaaccccttttcagcccttcatgttcctcacttaactgtccttccattttttcatttgttaaaacacaagatccttaccctctgcattatcctcttcaccccctccgtaactttggaagctgctcttcatccctacttcttccttcctagttcagatgctagctgctgtggcctagactgttgtggtatgtcccaggtagtcctacttccttgcatcccccatcccctgttccatagattgctcttcctgaaatgcagattccatttccattctgctctgttcagaatcctcttgcccttagatcacagtttgaattccttggtctgacacatgaagatcatctcacctggcccttgcctgcctttcctgcagaactccctaccacactgagcttcctggggctccatgacgtattttagatgtttctgtctttgcatgtgtggtgctttctccattgtaaaattaccccctagcccagatcctttgcttttcagcctagcaaactctattcttcttttgagagtttgtgcaaatgcttccgcctctgtggtagtgaccctggggcctttggagttgagagctttatactttgtactcattacctgtaagtgataggtttatttcctccctagaatgagagacctttaaaataaggactatgttgtaatcattggaaaaattttaaaataattacaatatatgaaaaatgcccagcctatgataggtgctgagtggatggatcagtggtgagattatgggttgatgaatgaagggatggatggagaaatggatagatggatggatgggtgtcaatatttcttaagtgcaaacaggatagaaattttatgtagtacccattttacaataaacaacttagagttgcaaatttttattcaatatgctattgagatgatcactgaactgtgagcttcaatccaagatattaaagcaaaaggaaaataatgatgccctccatggattctgacagagaggatggcatccttgcaggattaaaaaaaaaaaaggagagtaaaaggtttcattgattgttgaatcacccagtatcttgaaaggcaaacataacaacagtccttgtgttctgttctcttataggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggtaggtggcccttctgtggcaggacatcacagcaaactgcctattggtttcctctggaggcaggatgaaattctagtagaccaccctctggggtgcagtgctgctcactgaattcattggaagtcaggcagtttcagcaggagtagaaatttgcacaactatgatgtcattttgagtttgtgactccatgtttaaacaaacatgccaaattataattttcattttgttgtcctctaaaccatggtcacattttggagtcacttaattataaagcagtgtccttgctcaagacattaataaaacccttctttatggaattgtgtccctcatgaattcatgtattcataagcatcctcagtggtttcacctcctccaaggtcaatcttgacattttacctcctacatgaagcttcacctctccttcctttgtccttcccatgccacttctctgtcccctgaactccattactgttcttactgatgtttatcttgcccaacattgtgtatagtaatttatgaccatttcccctagtagagtataaatgcatttaaaacaaggactgcaccattgttatctcctctccatatcctctgtacacttttggaaagccctccatctggcaggcactcaataaatatttttttgatttgtattgaattaccagttcctgttttccttcatcaaactgcattgcttgctacaacttcccttgaaacattaaaacaaatgccaactctcttctatttctgttcaccactaatattgcatgtcaaaatttacaggaaccttcttcatgttttttctcccatttctcttgtcaatttgcaaacgctataaagcctgcctattccactagagccttttgtggctccttccttcaaccgagaattctagttacctcttttaaatttctttagtagtttgtctacacttatcaagtgctttgcattagatttatgtccatgcttgtcttatactaattactttttgtaaatttgagacccagcagtttagagtatttgccctctgtgtcttacctatgtgattgtgaccaagtaattcaatactcattatgcatcaattctagctttagaaatgggaaaaacaaaatgatgatgtaattctcagggtggtgaccagaatcatttgatacgtgaaagtattgtgcaaactgtagcagtttatgcaactgttaattagtaattatattagttgggtaacacgtgctgcctcaaaagtcagtactttaacacaaacataaatatcactctgacataaagtttaatcaggtgttaagtggacagccttccaggtggtgatttaggaatcccagctccttgtattttgaggctctgacattttttagagttttacgggcaaccccagaaaggtcatccatcttgtccactcaaatctcattggccagaacttatgcacaagccacacttaacttcaagcgaggcttgaaaatgtatcctggttggatccccaggaggaagagcaaatgaaaagttcactgaggtagaatggcatcttgttcctgtttgtgtctctgaagcactgtccctgggttgcacatgctaagctctcaaaaaatgttgaattaataattgactctatataaaatttacacatcagcctaaatcctcataattaactacatatttggatgaatcaaatgtctgaacttttcaacattttcatcaagtttaagtcacatatcatcttgccaagtagtcttggcattacttcatgttctctggatttttttaacaaaataatacttctcatcaaacttaattctattatctaagcaaagttctcctttatatgaaaccacatatcatcgagcatttcttttcaactcagataccaacaaaagttttcctggcttctttgaaaatatagctgctgccattttaattgtgccatccctcttctttccatttcctgccacctgaattactaagaacagtataaaaacatcagtattctaccttttccagcttttcccaaatctgatctttgtttgccattctctgtagggattgatgtcggcattctctcatatttttggtctccagttatagtctttacttctcatagaggcctttcctggccaccttgtctaaaatgcacctccaccctccatcacacacacacacacatcatcactccctatttcctttccctgctttttccccttagcactcaccactgttaacattgggtcttacaaatttctcgtttatgttcgccactccctagaaatgtaaactacatgacaggatgatttttttggtccatttctatctatagtactttctttactgcattacccctgtgcctgggacatggtaggaacacaataaatattggttgaattaatgaatgactcaatggttgttctgtgacatatgatttccatattaccaagccttactccttatacgtatgaaaagatttgggcatggagaaattaaggatacctttcttggagtaagttaaccattaatgtaatcattcttgacctctttagaaggattctggtaatcatatattcagaaaaataacagtggagtgggaggaagagggagacaaatatctcaagtcttggtctatgaaaagaaactgactctggaaccagaaaatttactatcgtcctgtccctgttatatattggctacatgacctcatcttcttctatttctttagttatcaaatactagatttgaatgaatgatagccaagaccccttctagttgtaaaatctgcatggtgctatgccctagcactgacttcccttccttcctttttataaagcacaggagaaaattaatctcatcacattttagattatcttggcatatttggcagttgagaaactagtcggctataccaaggctggtggtttgtcagcaaagctgatctgcatgggtggacaaaaatgtaatcttgtatgtcgctatgttgttttgttttgtttggctttttaaagaagctttcagaattattataattccaaacaaagaaggatgaagctagtcagggcctgatggttaaaagtagttagtaattgtgcagtttcacagtccttgggtttaagagctcggaaagggaggtgtcacttctattagcattagaaaggaagacttgttaggaaaggtagctgtgagcttgtcctggaaggcagaacagacctggaggcagtgattccataaaataactggtggaagggatgtagaagctcacagaggcctggcagggacccaaaatttgttctgggtgttctaacatccttcatttcctgatgctgagactgcctctcccaagtggccactctctgagttaatgggaaagggcggaaaagaacctggcttcgtcctgtaatacagaagaggaacctagatgcagaggttgacacacaatttaagagtctggctaggacagtcttttgcattggttgtttgcttttcaggtactggtttggaaatccttgagctggaaatagatcataatagcagatatcatgaccacagatatcaaaatacgaaggcagtagattataatggtggttctcaaacttgagtgtgcagcagagttgcaaggaaacttagacattcagattcctaggatgcactcccgagaatcagattgagtagcactgggatggggcccagaaataatctgcactttctagtgaagacctccacagagttctggtagtttcctaaccacacctttggaaaccatatcttgggaaacactggtatggtagaaagaccatgtgcattggaatgagctaccaaaattcaaatccctgctcagccacttatttgctatgtaatcttgggccccacagttaacttccctagccaaaagatgaaacaatgtgacctaatttacaggactgttataagaattagaaatgacattttaaggcacctagaacagaattaacatatattaggcattaaaggaagatttctgctattattacattaaagggataaggtgcctgctctatcaaagcgtgtttgggtgttttcttggaaatcaagcccactctgcccactgtgtataatgctgtgacctgatcccacacatatatactcctaggcccttactctgctctttttattccatagcatttattaccttttaacccactatataatttacttatttttatgcttattgaaacctaacagaatacaaaccttataaaggcagagatttttgtttgttctgttcactgacattcataccacctagaaagtatatggcaaaagatgggtgctcagtaattatttgttgaataaatattgcaattctgtattactagaaaaaaaatgtatttttgtttcgattttgtccagtgtccatactgcttatattcccttacctttaaatcatgaccctccacttctgatatcaacacctgttgaaaaactggctaacataaaatgatactctgtgggagcactggaaatcaaggataagaatcattaatatctacacaaagtcattggtattatcctaaccagaaagttctcactgactaagtcattgatacatgaattgttctgaaagttgttacttctgtaactaatattgggaattccagagaaaactcatcattgctcttgggattagtaagaacttcagagcagaatggagaaaactgtcagcttcttctaagggctgatattaaacgattcttactaggacttcttcttaggagaggggcaagaaagagaagacaccacccttgtaagctgatgaaaagtccggagtgcagtggagacgtgggaaagccagtgtgttcccaccccactgagttgtcagcctgaactggggaccagcttagtgcacgtgggaaatttcaaatgagcactactgggagcaagggtcagaggctgtgatgaggattccgagtcagaagccaagctttgctttgtgttctcttcattccctgatgaaaatcgcattttcttaaagccactttgcacaccaagtcaaagagtcaagcattcatccaggtcatcaagcaagaaaccacccctcccagtatatccacataattatatatgatttccatttccttttctatatatcacaaataccactgtctacgtgccagggttgggctactcattacgtacattattggcttgtttaaatctcactaccatttcatgaggagtaagccaagtttgtttgcccaagtgatgcagtgactaaatgaattatttctacagcatgatgcctccttacacaaaagaagaggcattttgatgtggtatctcagatatggagtccatttgtggggaaagaacaagaaaatatgttttagccaatctggaaatgaggaatgaagacctttaacagcagtaatactgctggactaatcatagcacccctgatgttcaggccagcagatggcttccagagccagcaaatgttctgctatagtctgctcacttggccctgtctgtaaagacagaacatgtgtactgtttgtgtcccacaaaggtggaaggaagcagaagcaaattatgcctgaacctttcccactccctttaacctgttgccatggagcaaagactgctgatttctttcatctttgcttgagttatcctccaacatcgttccatgagccctggacccttccactgtatttgttcactaatgtacctgaattgccaaaacatgctgcctgacatgtatcaagcacttgagaaatatttgccgaatttaatgcatcttgaccctcccgtgcacccagaccccttaaattattaaaccacctgtcacaacagagccacgccaaaggttctaagctgggcctgtccttgtttgagcttttgctcccataaacagccaaagtgatttcttttagtgtgtttgttaactacaaaatgccatcatgatttccagtgctatttacttttgctgggttttaaatgctaaagcatccttcttggtcaagtgcaaagtggtggattggtgtggaacatccagtgacaagtgcagtagggctgggtcctgggaatagctcttcaaaaagcccttaatggtttattgtggtgacttagtaaatggagaaaactcaactcataccacttttctctctcagtggtttatggaataaactacctcatagcagttataccccaggcaataattcaaggtttcatttttaatttgatcgggtagattttaattgtgacagttttattctttcatatgtgcagtgtttacatttttttctctgaagcaggaggggccaaagttcttttgatttttggaacagcattatgctttgaaggaactcattaaaatctaaggagttgagtctccagataaacaagaccataaatggtacccttagaaaatatctagaattgttacaaggttgactaaagcccagtagagattttgatgtgaaacaatgaattgtaaatgaagaatcactttgggctgggtttcgtttcttctttttaacatgcagaattgcttgattttttaaaaaatgtaatatgtctttcactacccttctccttagttcccattttgctatatacaaaaatcccagaagcagaaaatgaaaacgttgtttaattattgagctatctttttcaaaaagttttgaagtttttgtattgataagaaaaatagcttaagaacttagaaaaaatctgatgataatcagttgggaaagaaaatgtattttcccactctagaaatgaacagcaagaagactgtgctgcagcatgacataggtaccactgataagtagagagaaacatctagacaagggcaacgtaacacatgcagtccataatcctgggtgattttagattattattatttttagccatttcagcaacattcactgcacatccactgggtagaaatcaccaccctagcttgtattctgaaagagcataaaattgagcaagagagtgtgtaagtgaatgacggggtgagggtcatagaagtgcaggtaagaccttccagagaggaaagagtaggaaggcaaagttagaggaggaaaatgagacatcatttaggaaacatttgactggcaaggagaacaataatcaactgcaaatggctttcgacatcagcatttattatgtgacacagtaaatatgggggggggggcacagtttcagtagctgggtagcactttgctctctctctctctgctctgccatcttcagctgcaaaatggctacagttgataacagcatctcttccagccatcattgcatcaattaatgaagagatgatgtttcttttcatgtacccattttcaatagggaagataaccttttccagaagctcctacatgccccacttcaggtaccagcatgtgcatacgtgatcttgccctagctttgagggaggctagctgaaagaaaactacaaatttctgagcctgtttcagttctgggtaaacaaatcagataatccctgccttcaggaaatttaccttctaatgacttgaatggtgggaagattcaaggtctagccaaaggaactggaagggtgaggctacacagagtctgacttcaagaccattgcagttgaagggccaagaggtcataggctgtaactccagaaattcagagggggattagaagcagaggcatagcaagagaaaatcccataactgagttacccaaaagaagtgttaagcaaaagagaagagagtgcttcttctctgaaagcgaatggatgactgttaataaaaactaataactgcagaataaatattgtccatctccatgttatctgcttttattttttcaagtgtttaacttacttatttcatctatttctaataaaacattttattactagatctctttgcaattggtaatctattttcatttttttttagcgcttttgattcccgtaacaccccccattaagtaaaatgaatatgcatatgttttcagatgtgggaacagaatcctaaagaaggtgattgatgtgtccaagtttatattaattataaacagcagagccaaaactggatttcaggggctgttgcctcagtcagatttttttttacagcatcctaattcctgaaaaggtatgcttaagtcagtggtctacctagatatttctttcttacttatttcaagctgctgtttcctatcagtttatttacttgacttttatttctccattaagtacctaaattaatagagaaataagtgttcatccaatataactgagccagtagtttgaaatttttattaaatgttaggaaacgaaatgtgcagttatagccaaagattagaagaattataggaaaacagtactgggtgctgttgtatgaacattaaaaaatcagtttcaggcatcatttcaaattttttacctcattttcccactgactccaattttctgaatcattcctttattttttagaatgtggtttaatcacatacattttgaagctgccttaaatcactctgtaacaaaatggattataaataaactaatgaattatatacaactgtagttagttttgcataatacataggaaaatattatttgccttcctgtaatacatggatctacaattttaaactatgtcttttttatgcatttgtaaatagtgtctccaagccaaaatggtaccatgggccttttaaaaggaaactgtagatagatttataactgtgacccttcctatttgcatttgttaccaagtaagagtcacatatgctacataaaatagacctcagtaattatgattgctcgcctagttgaatgaggaaaacctctgaattgcagactagcttgacaaaaatttatggaaagttattttttaagtaatgatacttctgaaacctattctaataatgcatccaagttgataatttatcttagacatactacatactctcaaagaattaatattgtcatgcttgcaccactctgaagggcttgcactctaactgtttattctttaattaaatccaagaatggattagtgcttggagcgaaattttttttttttttttgagacagagtctcgctctgtcacccaggctggagtgcagtggcatgatctcggctcactgcaagctccgtctcccggattcacgccattcttctgcctcagcctcccaagtagctgggactacaggggctcaccaccacgcccgactaattttttttttttttgtatttttagtagagacggggtttcaccatgttagccaggatggtctcgatctcctgacctcgtgatctgcccacctcggcctcccaaagtgctaggattacaggcgtgagccaccgcacccagccacgaaattttttattacatgtcaaagcctagcaagttttaaattaaactaactggatgaaaatgcaagtacttttcctaatttgtttatggaattttcttctaaaaaagagatcgggacatacatttttgtcctatattattttttgctctgctgttcattaaaaaaatatgagttctctttcctctcattttcaccctttaggtgttacgtttttaaaaactgttataatagcacatggctgttgggtgatgatctttggaaaaaatacagtaaaaatgatgtctttctgtttaatttatacagtaagagaataatctcacccttgacctaaatatcctgccctttcccttctccccattttcatacccaggccactgcagctggtcacagggttttaaataccatctatatgtgcctcttaaatgtctatgttcaacccagacctctcctatgaactctgaatccttattgccaactatctacaagatacctccttcatttggatgtcttgcaaacctctaaacattatcatatcaaaaccacactccaaaacttgacccccaaccttctcctcctgcagcttctccaaaccagtcaacagcaactccatctttctagttgcctaggccccaagcattgaggtcatcctttcttctccctctccctctcttctctctctctccatccaataaattaatgctattacctctatcctcactatgtccactgtggaaatatttctcatcacctcactgccctggttcaggacccatcatcttatctgggtagatcagcaggccctctctgctctccttgctttatctctggctccatgcattctactctcaactcagcagccagagtgatgctgcttcatgttagtcatctgttcaaaatctccagtggatccccacccactgcaagtaagtgcagaagtccttattatgacccataagactccatgacacctggtcctggccctatgaccccttcctaccacccgcctcctttcctactctcttccagcctcacagacctcctcatcactcttgactcaagacctttatcattggctttcttttccttccttctacctggaatgattttctccaactccttcatcagtttgagttttctgctaaaatgtcagcttctctgggactgacaatcctattgaaaactgcgtcttcccaagcatttctcattgcccttctttgccttgtgtttctctatgtttttcttgtatgtttgtttaatgcccgtctttccatatttgttaccagcttcatgaagacaaggattattgtctgtttggtttgtaactgaattcccagcatccaatacctggcactcaggaagcattcactcaacatttatgcaatgaatgaaaggaagggagggaagagaagacctgagggagaagcacagtggtgctgaagtagagcttgtgtggaatgactgctaggggagaagatgggaaagacagattgaggacagtatgcaagtggatggcttcagccatgggaataaaaagagtttccagtaaatgagtgtcttgaccatggcattctgacaaccacatagagaagaaatgtgctgcacatgttaaggaaatagcagacaaatttgaaagctgttgtatcaaaggttcatcaagtacgtatttttctttgcaatgcaaaactcaaactagcttaagtaatttgaaggctcacatagctgaacaatccacaagcaaatatggcttcagacatagcttgtcccgggactcagatgatatcaagacatcccttttatctctatttcttggtattgtttgctcaattgtcagcgcaatcatcaggcctcatatggatacaggccctgtatcctctcttagaagtctcagggaaaacctccagggttttcattgcctctgatggagtcacatgcccattgctcaggcaactatgatgatctgggaatggaatgctcaatagactttgactacgatacacacttcacccttgagctaaggcttgggtagcagttggtttaccagagggaacgtggggtataactattataagaggagggaaatggagacttttaatgatgaacagatgaccactacaaaaggctaatgagggcttgaacttgagtctctgcagttggaatggaaaagggagaaaagaagtaacagagatgaagtctagtaggcctcctggctctgaatggagagaggatgcagagaagctttagtacaattctgagatcttgagcttgcgtgattagaagttggcaatgtcattaatgaaggttcacgataaagtaggaggaacagatttgtaagagacagaacacatttccttgctttctcatccctgtttttattaataaaattgtttccagattctcagagctcaagaactgtagagttctgcaagaggcaagaagcaaattcttccaccaaccacttattttcagaagacttaaccctgcagttttaaaaagtcttctctctgagctcatgtgtgagagaatcagactgaaattttattttctctcaatagttttgagtttcctttggttgagctatcagcttctatggaataagaaaccacaagtcagagctgggttcaatcatctcttatagaacatttccacacagatgacttagggttgtgaggccatcttctaatgtactgtggatggattaggcttagagaaatatatgatgctcatctatagaactctactggatgcctaacaaattacaaagtgagaaacttttcatcactgatggaccaggtgcaagaaaggagtaaaggcaggcaccgaataataaagtgacatatgcaaatgtagtagccagcaattttttgagtatttaccattgaccaagtactgttttaaagtctcaacatataataagtcatttaatcaccatagcaatgcttcgtggtgagtactgttgttatccccattttacacgtgagcaaactgagatctaggaagatccttgtcgatgtacgttgtcaagggtcccacagctagtgactggcgtggctaagattcaaacccaagcagtctggctcaagggcctgccttcttaataaactgatcatatattccagaactgcccaatacagtcatcatttctgcctgctgccttggcataattataaatgtgaactctagaaagtgcccccattgggcaataaattatggacactatttctctgaaccatgatattttccttattcaaaaccaagaaaatctaacctgagcaataaaggcatccaagtggttcagttgtatctccaggcatatgaggggtgacattttggattgaatatgactattggtaatcatccagttggtcctaagaattaaagcagctgcatgggttggcgtaggtttggttttaaccagcaaatcattctgctgtcttgcagcttttagggctctgttttgtgctacagtaaaattgtcagtgaccatatgttgcctgtttctggaatggttttatttatgcctcaacatttggctccttcaggttcccccagatctccagaacgaagtgctgatcagcctgttagagaccgatcctgatgtcgtggactatttactcagaagaaaggcttcccaatcatcgtgagtattccagtgttccatcttctaaagccgcattggagatttctatttccatttctgagaaattggaaaggtttacataagtacatgcagggtgacctgaagtggaattttggcaactctttggcaattctgatcagtccatctaaccagaaaatgcttcgggtcccatcaatccacttaccaaattagaaaccacattacaagatttttctgttttattttcagctttctctagcctctcagggtccttttgacttcatttacagggaaaaagcacaaattactggcaagggactataatacacgtcaatgattctacttctagaattctgataagcgtgcataggggcccttaaggctgcgcctggatgcatcttgcttgtgcagctttaccagtgggattaacccattatcaaaccacaagacagaccttagctgaggcctaggtgcccatttgaaattagaggtgtgcaccttcttggctctcccactttttatagctagtattattttgataaaaatgcacatgggtttctacatgcactcatgtttgcaattagtaaaatgcaagccatgctgcaggctatggcttgctgccatttttgctcccaaaagaggagcacagagtttttgcattagtcagattttatggttacttccaatctttgctgcagaggcagagggtgtggggatgctgagcatttggcataaccagttaagggcataatatagcatcattaaccaggagtagtatcatcaccaggacaccaaacaataaatttgtgacaggaaaagttgttgctatgctcttacaaaattatcacttttgttatacttttaacctactaaatttcagcaattctaagatacgtttctcccatgacctatgatctctgaaattgagactaatcttataaccaatgataagctcctaacgtaatcccgtacctgtaaccccagcactttgggatgccgaggcgggcagatcacctgaggtcaggagttcgagaccaacctggccaacatggctaaaccccctctctactaaaaatacaaaaattagccaggcgtagtgacaggtgcctgtaatcccagctactcgtgaggctgagatgggagaatcgcttgaactggggaggtggaagttgcagtgagccgagactgcaccactgcactccagcctgggtgacagagtgagactctgtctcataataataaataaataaacaaataaataaaataatggcatgtcttaatcgatggtgtcttataaacagtaacacatgttaagttattcctgtatattggtgttgaacttgataaattaattttcactcatgattattgcagatacttaaaaagttatattatttagaaaaatttggtgaaaaggaattccatgttgttcaacctccttctttcccaggtcattacgttgatagcacagctaaattcagcttcactccatttccagcttagcagggaagaccttttaattggattatcctttcagatctactttaaaaaatctgtgtctgggccattcattatcaggccaaattctgattcaaataggaccaaattctgttgaaagtaaggcctggattcaagccccaagagccatgagtgaataaaattatattcaaattgtatagatgagctagtattttatggtcttgcttttcatatcagagaattaggcttacatttaaatttttcctagatttctaaccctcatcaaggtataagtcctaatttatattaacaaatggcttttcttttcagcagatcatgcaccaccataattttgataaactcatttatttccctcccttgtacagaaaagagacatgctggcatttccatttatgagcccctcatttaaactgcacttataacatatggttggtactgtgtgggaaagctacaaaacacacacttttgaggaaaaccactgatttttgcctggccaaatttctgcttttgtgtggcattatgagatagataaatactatactttaaagaacagttgatagaagtttttttacatggttttcaaatacactctttgcatataaatgctgtggtaaaaagcgaacctttctttctcttctattaggaaaaggaagaagcacacatattaagcccattccaagctgtacaattgtccagccccttctgttccctatccgtaagagtaagaagtagaattttaaagtgtaggtgagcagaccctagaccaagatcttaggtgagtgtcagggcttccaagaaaatagcaaagacttggaaccaacccaaatgtccaacaacgatagactggattaagaaaatgtggcacatatacatcatggaatactatgcagccataaaaaatgaagagttcatgtcctttgtagggacatggatgaagctggaaaccatcattctcagcaaactatcgcaaggacagaaacaccaaacaccgcatgttctcactcataggtgggaattgaacaatgagaacacatggacacaggaaggggaacatcacactccggggtctgttgtgggatggggggaggggggaggaatagcattaggagatatacctaatgctaaatgacgagttaatgggtgcagcacaccaacatggcacatgcatgcatatgtaacaaacctgcacattgtgcacatgtaccctaaaacttaaagtataataataataaaataaaaagaagaatgagcccataggagctctgtgtatgtcagagactagcattatcagtgaacagaaaacactgggggaagacttacttaggagaagaaagtgtttggtttttgtttgtgttcctctaggtacaggccaaggaacagcccagaaggcagagaatgatgtcatgaagtaaaaatgcatatgttaataaatgagtgtttacttttagtggtcttttgaggcttgagctccagagtgctacccctctagctgtagttgcctttttttttttttttttttttttttgagatcgagtctcgctctgtcacccaggctggagtacagtggcacaatctcggctcactgcaatccccacctcccgggttcaaacgattctcctgcctcagcctcccaagtagctgagattacaggtgcatgccaccacacctggctaatttatgtatttttagtagagacggggtttcactatgttggccagactggtctcgaactcctgaccttgtgatccatccgcctcagcctcccaaagtaggtggtctttttgtgttttaaactcactcactcatgcttctcaaactttactatgcatgggtatcaccagatcttgttaaaatgctctttctgaatcagtaggactcggggaggtagtctatgaatctgaatttctaacaagctcccaagtgatcctgatactactggtccatgatccacactttgagtttaaaaagcttaaaatatcaaagtatattcttgcttttaggagctttcagacttgttggaggaggcctccaagggtagaatgccaaacaataggtgctggcccactggctgtcagactcaccagccccttggaatcacctgggagcctgaagaacaactatgcctgggccacccctcagagattctggttcattttcataggctgcaatctggacattcggatttttgtttaaagtctcttgcatgattttaatgagcaaccagggttaagaacctctagcttagatctaccacgttggatatcacaaatttactatcatgtgggagtttgagctgggtgatttttgacattaaaaaggcatccttgtgttgacaaaggaagggaatcaatgctccagaccatgaatccacttggagtttggagaaggaaaagaggtgtgatttgaagtctcagagatagcttctgagaagaggaaggatttgcagtgaactttgaagactgtggaggatataaacaagcctggatatttggggagcttgcaccaggacctggacataacagtaaatatgttggctagctggggtcacaataaagaggctggccagcagtgaaggtagaagcccttaaatggcaggctgaggggtggtgcttaagtcaagaagcagtgacaatagattactgtaaggctaaattatagtaaattacagtaccctaaactgccagatggtgctggctgcattggcaagtcaattatccatcagtaacacatgtttgtgtagtcagttatctgtcaataacacatgcttgtgtagtttaatagactggttaccatttcagatccagagccagattgcctacgtttcaattccatttctattgctattatatatgcggtctattagttaagagttaatatctgttaatacatagatagatctctctctctagtttcctcatctgtaaactagagataaaaagtagcaccaacttaaatacagaattatgctcttagtgtatagtctggtatatcataaacatcaccaatttgctcatttacaactacttaccaaaggcgtggccatcactagattctactttggttttcatgagatagcaaccttccaggcaatatgacacaagagagaacccgttcactttaagttatagcattgtgtctaaaagcaaacactatatttgcttctaaccctttgatttttttttcctgaagcttctgttctctgccaccagttcacatacctaaacaaagctttacattcctgtgaggccaagtggaaactgcacaagattttatttggaggggaaaagaaacaagtttcaaaagagtgtaaaaccaagaacaagaaaatattataatttctgttttgaaagagcaaacatttagtgatatttgggaacttaatattttgttttgatttgggtttttcacttctttatgcaacatcggtattggaggagttaaaggataattccttgttttttctcgtgcttgtctgcttaagtatttggcttcaaccaaaacgggatgccagagggggattagaagagatttttatgactaagaatgcaagaccaggagtctgtgaccagcctggtcaccacagcaagaccccatctctactaaagaaaaatttaaaagttatctgggcatggtggctcatgcctgtactcccagctactcgggaggatgaggcaggaggatcacctgagcccggggttttgtggctgcagtgagccaagattaggccactgcactccaacctgggcaacagagtgagaccttgtctctagggggaaaaaaaaaaaaaaagaaagcaagactttgatttttaaaaatatatacttgtcaggtatgtttactagcattatatatgctcttttcttcaaaggtacttaaaatagttcccctaccctttgatttaaggatgtgaggaaatagggaatgagaatgggaggttaatcaaacaggacaggatatgttgaatgtgaatatttgcaacaaaacaaaggaatcacagtaggactgggacttagtgagaggcaagtgagacgcttgcctagacacagaatttaagggaatgccagaaaactcagtcagcaaaattgattatattgcaatgtaatattttttaaaaatccaagctaatgccaaaaatgtttgataaagaaaatatcaaaattttaaaaagactagccatgcttagtcatagaacctgaaacaaaaggtaaaatatgtgctgctgccttaaatggaagcaactcataagtcatatttattttttgagacagggtctcgctctgtcacccaggctggagtgcagtggcacgaccatggttcattgcagcctcaaccgcctgggctcaagcgatcttcctgcctcagctcccaaagcaagattttcaaaatctactttgtttatcttggttccaactgagagaattgctatgtttgacagtttctcttgaccaagtgacaatcttaaataagttctaactaaattaacctgaaataaaataataaggaaattctgtttgggcatacataaaacatttaaatttaatataaatattataggttcgaatgtatcttcttttcaatttttcaattttttcaactgctttgatgttctgggaaaaaaaaatatacacaaaaccatgtatatagaggtacacagttttcttttgcctgaggcatctcgggcccctaagttccgcataagggatgctttgcagaactaagcatgattaatgtgaaaatcccccataaatccagagctcaggagagctcagcagagctcagatcatctgtgacacagtaactagtttcagcaacaggtcttgtaatttttaaatataggcttgaggaaacatataaagatttgctcttattctatcaaacctcaggggctccccagaaatagaatattaattaaataaggctaagtaaagtatcttcccttctatactctggaaacaagatcaaaatagaacaaatttaactgcatttggagagaaggcagatatggatgaactaaactcaggtatatatatttaaatttcattgtggttaattctattagtagccttcacaaagtttttactggaaaaaaaattaaactaaaattaattttaaaaattagcaaaactggtgactagtgtatcaagagcatggttgaagatctgtactagtctgaaaaaaaataaaatttcagtactgaaaaataattgtattgtttagctagatgttcatcttattgaatgacaaatctgccttcttcattctgggggagcattaggctttcttctaatttaaaggtatcacatttaacttaccaaatatcacatagatcatttcttttaatctttcaaagctcatcattaaaaatatcttttttcacaaacatggagtgttatgtgacagattataatttctgtttttcttttactaggatttttcatatcagaaagggtttcaggaaattttcagacaagaaatctaactttaccagtacaatgtaacagcaaagagtcctattgagtggcggtagctgttggcctcaataccctggaaattatgaagcattaactgcccctgcccccctcccccaacacacatactccattcaagaaagtctttccagccagatagttttagaaaaagcttatgtggaatagagaattccataatgaaaaattctaaaatgtgtgcatatatgccttctatggaaaggcattcaagatggagggagaatgtatcacattaccccttccttcctcacaccttcactatgattcacagcttctttataaatttgcagaatgttaatttgaagatgtttttatcaggccctctgtaaataatgaaaacaacactgtctgatcttcacctgtcataagtgctccatttgccagagacattaggagggaattaataaggactaaaaatgaggggaaaaatttcaccaaaggcttatgcccagggtgttagcttcatcatccagtggagagtttagagccatgtcagttcctctttgaagtggggtacctttatccctagcaatctgtcaaagggaggctttgtagaactgatggtgattaatgtgcacattcttcatgattccaaagctgctccagcagtggattcctttcccagtaccattgatataatccaagatggatgatacaatgctttcagttccaacagactggaacttatcagtcatatgattaagccaaggatgaagccaacacacatttgaaacctccacagttcttcttgctggggtagctcagcaaggtgctgggcgggccccatccggtgattgaaccggagttttccatttgtccccagaacaagttctgtgcttccggctgcagtgcaggcctgcccacagtaccctgccagcatgtttacgccctg

SEQ ID NO: 3025 - DNA, 527536 bp, human
ggttctagcggctgcaggaggtccccagacccattttcctagaaggctggtgatggatctgctgctcctgccgccgccggggcacttggagcgcaccggcggcgcgtgagctgggctttgctctccactgccctgggcaaaccccgggccagccccgcctggcacctttgcctgagtccctttcggttcccgacccaaagccaccagcgtccagggagggaggaggaggtggtcctcaggtgcagccccgccgagatgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgaggtagggaccagcgctgcgcgtcccacggcccaaggaggaggcccccaggcagtttcaggagaccgcctttaattccattacatttacagagcaaggcacccactaaggggtttccgtggtgtgggttttcctcttctacttgctaaatggtgcctggaaatgggatgtccctagtggccacccgcttgtgcgtcttgtaggacttgttggctctactttggagcagtcgtgggagctggagaaagagatggtgttctggttttctgttagtgctgcaggcaatttcaaagggtcaccttatcccttcacccaatgttgatattttttccaactcaaatatctattgctaagctgtttgtaacgattggatgaaatatattttgaaatatgtctgccatcttgttctgtagagaattcagaaacattattttggagggtgtcattgactgtatgagtgagtgtgtgtgtgtgtttgggtggcaggggggacaagaattctctagttttcaccttttctttccctgaaggggcaatttcagaaatctatggtactgagtattagtttaacctaggagaagaagaaaatctctgtgtaggggtgtgaaagatcatggaaatatgctgatgcctaaattccatttagaacaattagtagtttagtgaagaatcaacaatacataggggactcagagggagctatcagatacccttaaaatatttgctgtccagttaagaaaaatagtgaattgacctattgggaaactgtcactgatgggcgctttgaaaataacacactttcagagaatagtaattgttttaaaaatgaacagcccctatccccttcggtccacaaactctataggtttgccttggatctgtttccataagggaagggagattccatcagttgtaatttaatattttaaagtacagttagcattacagaaatgaaatgaaataccatgtaattgctggagatttaggctaaatacacaaccaaggaaaaccgtttgaaaatagcatctgagatcatactcagctgtgttaatgtgagataactgttagactttggctttagtaaaccgccttagaaaaataagcatcatttatcagaattattagcatcacatattattaatgttagttactgtgtcaaagtaactgaggctgttaggtgttgggggtgcagattacaaaaaactaacaaattttgctaggtcttttgcccattttcttgagaaagataggcagtagaaaggaaagtcgaggcagagggcaagatgttacctccaaaccagggaactcaagattagaaagagcatcaaaaattgaaatgttgaatttctcttggtctttaggaggggctggattctcattgtatttcagaagcacacattatcagattaatctgtacaagttgagagaaagagaaatacaaaagcaagccagcattttggattagctagctaacattcgtgcttaaaactaattgcatcattaagaacatttctgcttttcttagcaaccatatacatacttggaatatagtatacagatgctgctcattactgttatgaccaaaaggcatgtggctgtagatgatttcacttgttgcaaattatcttcttatccattagcatctcataattaatggacaaggatctgaactgcagtgatactgggtggcttctattccatacagtgggcagtctgcacaaaactcatctaccatgatttttaccttttcatggtggttaaaactaaggatgtagccatctagcaaaaagccagaattttctcatagaatatgtgtgtatgtgtgtgtgtgtgtgttggaaattcctttatgcttgaggcaggcatggagtgattggatagaactctagcatgtagctccaaccctggttttgtttaataaaggccaagatatcctaacataacccttggatctctaatttaatggcctggattacctttcaaaggtttaacgccctggaaccctctgaaaaaccaagaaaatgtatcctattgggcactgcctgtccttttcacttgcaggcaagctgagtctttggtccttaaaggagagtctttactaatgacatcaaaatgtcagccaatgagcatcttgcaaggctgcttagaggccctggagggaatatctggttcatatagatttggttcttgaacttttctggttgctctggctcagggtttctcagccttggcactattgacatttgaagctgaatgattctttgctacagagctgtcctgggtattgcggggtatttagcagcacccctggcctcttcccactagatgcgagtagcactcctccagaccagtgtgacaacaaacaatgtctctagacactgctgaatatcctctggggatcaaaatcgccctaactgagaactgctgcgttagtgaggttgcccatagtaccccatgctggccatcaagagagtgcccacagaagtgtttacagctggcctaaactttgttggcgccttcgtttgattccaaaaccacgaggatccctctggagtcatgtaccccttacagtctgttcaaattttctatttctcttccattgaatccatatgaaatcctaagaattcaccttcaggtttagccattgatggatctcatccatttcccactttgttctttcagaatcttgtctgcttttaacgtaaattgtccatacaacagcccctgctcccaagactctcacaaatgcctgcagctttgttacttgtgctcgttcaaagcttacaaatgaccattttatggcctaaacctgggaagtgttaggcaaagtcagctacgatcttgttagcatttcctcactacgtgtttcaggattgctttaacaaaatctgattcctggacatgctgggtagatcatctattgagtagaaacatggaggagacaaagggtaaatggtacgtggtaacacagttggaacgtgtttctcaacttgtgttcttagcagccaagctctgcccctgactctgatcacaggcaaaggaataaagtctcatttcaatcctgagcttctcctaattcttgtggatcagagctgggattatgtccatagctaacctggagtttgccaacttttgcaacccataattaaaatgatttctatatatcactggcgtctatacttttcttcattcatggcacaagcatttcttgagcatacgcatttctgtaggtactaggaatgcagagaggctaaagagctcatagtctaatgaggggacaggtgagttaactgatagggggaatacagaagatcagcagaatgagggaacagagaggggcgggtgatgattcactgtgctttggggggccttgaaaggcttcactgtccagagaacatttaaacttgatcttcaaagatgactgccatttctaaggagaagaaggaaagtgatgccttcatgaggcagaaaagagtggacaggcaaaggcgcagaggtgttggtgattctacagctcccaaaaaagaagacttagagggccctaagcgcaataatttgtttggaggagcaggttagggcacctgcagtttgatacacgtacaaccacatggcttttcatgtaataaaagcctgaccgaataaagtcagaaatcagacctgttgggttttttttttttttttttttttttttttttttttttttttttttttttgagagagagagagtctcaccctgttgcccaggctagagtgcggtggcacgatctcagctcaatgcaacctcccatgttcaagcgattctcctgcctcagcctccccagtagctgcgactacaggcatgcaccagtagagactgggtttcactatgttggccaggctggtcttgaactcctggcctcaagccatctgcctgcctcaccctcccaaagtgctaggattacaggcatgagccaccacacccagcctctactggggggataattatgggtatgaacaaaaatgagagactggtcaaagcacattactctccaaggagcccctgggcatcacaactgcagagagtgaaggcatattgagtgttgcccaagtgaagtttggggtgcctggagaagaggatgtatcttgctgtgtgcaggataatagtgttcaacaggtaggatagtggtaattacgaagcgtctcactgtgctcatctcaggagtttggacttgtgtagagcagtgattcttaacctggaggtgactttgtccccaggggacatttggcagtgtctgaagacacaactggaagtggtggtgtattaatttcctatcactgctgtaatgaccacaaacttagtggcttcaagcaacacaaatttattgtcttacagttctggacctcagaaatcccaacaggtttcactgggctaacttcaaggtgttggcctgactgtgttccttctgaaggctctaggatctgttgtggttccttttccagtggcccccttccttcattttcaaagccagccaagttgcatctcatccactcttcttgtgtggtcatttctctctctcgctcttttcgggactcttgtgattacattgggctcacctggataatccaggataatctcattattttaatgtcagctgattagtgacttttaattccacctgaaaccttaagttccctttgctatgaggtattcacatgttttagggattggggcgtgggcatttttggtggtatattattctgtctaccacaggggagttcctaccggcatctagtgggaggccagggatgcttcttttaaataccctgcagtgcacagccccacaaggaataatcatctggcagtcaatgttaggagtgtggagactgagaaactctgctgtagagagtgggagaaattggtgatttttaagcatgaggtgtaacatgatcagatgtgttttagaggtaaactggtgtctgggggagcatgggttagaagcataaaacaagtggaggacagatcctcagaggaggtgggcatggggaaatcatgccaagcatgcatcctataaataactgggagttggcatataaacataatacttttatatttcccacttctctgttttagtaaagtttttcttgctctgttgaactccttgaaagcagaactgttactcatctttgaattcttaaaatctggcccctgtactctgggggttttagagagatcatcataaagaccagtggttctcaaccaggagaaagtttgtaccacagtgtacttttggcaatgcctggcagcatttttgattgccagaactggggcaggagtgtgctactggcgtctagtgggtataggccaaaggtactggtaaacatcccacaacacacacaacagcccccacaaacaaatacttatcttacataaaatgtcaatagtgctgaggttgagacgccctgtatacaagaaactgaattccaggttttgcttttcagtaccattttctctcatgcttgtggctttactctttgtcattttcctcttcttatctagtatatgtcaaccaaggctttgaaattcaaaaaaatgactttctatgggtattgagcatatgaaaaaaaataagggatttctaaatatatctatagggaagaagtgaatggtaaatatataatgatggaaactggaattaaattttaaaatgcagcagagaaaaatattgtgtttaaaaatagaggctcattcatgtcaccaaagagaaagtaattagaataagacagcttcaaaaagaaattgacaaaaagtgttttacaaggatttttgtctgaaatcagtataatgccttaaggtttttttaagttaggaaaaagagttattcaactttcacacatacactctctctcaggctatctctctgctagaattccttctgaaggcaatttttaattttaatggagaatactgtgaagatagcttctcagatgacttagaattgagttttcaccaacattttgagatttgagggttgggaagagcaaagtttagactcagaaagaaccttgggtagcatctagctccaaattgcttattttacagttgaagagagggactgtaaagcttaagccactcaaactcaggcaaagagccaagggcagaaccaccctgaaatccttcttgactctctatataaactgccaagcttctggaaaaagtaagtgaccacgactgcttttattctctggtgagcaccttaaaccttggcaatcagtttttatcctgattacgtactgaaactattctctcaaagttccctaagttccaagaatcttcttagactcctttggctagacttctgggcaaaactgagagtaccacgtcccctccctgctcctcctatccccatcacacacagagaatcttggtttcctccttacctttcttcccactcctctgactctgggattgtcttggccaaccctacagttctgtgtttttccttcaggtcattgtccctcctattgtctcattcacttttgtgacttcaaccatcatccctctgggggagactcctcactctgtgcctacctggaatcttgtagttgagctcccaatatatattttctgatttcttcctagatatctgctcatggatgcccaatggactcaaattctacatgtttgaaacagaacaaatcacctcccatttcctctgaacatgtttcattttatgtattccttattttggttggtatcgctcttcttctgcttgcctaggtttaccaggccagaatgcctttactcctcccttttttgtttcctcctttattcttccataagttttcgaacgctgcagtgtgtacttcccatttgctccactctagaaaggatttgaagtggagtgtgtctgagttcttacatctctctccagctgttcattcacaatgtcactgcctagtttgggttctcatttgctgtgacccccttcttggtcaccctgccttcagtttctccttgttgccatcttggacttatcctcaaaagatgcaattgtaatcatgttaacccctgattgaaaacctttgatgggtctcagagtgtacagaataaaatccaaactacttagctagtcatttcaatgccttttacaacatcatctcagcctgccttctcccaggaactctagtccagcaaagccaagctggccactcacacagatagtcatcaaatatttatcgcatgccagctatgcaatggacactaggaatgtaggtggagcaaataggtatggctctgcaaggtgcttccagtttatgaaagcagtaacttcaaatcaattaatctctatagttttttcagagtgttaattgcattttgacgagaggactgtggtagacagaacaatgtcccccaaagatgttcatgtcctaatatctagaacctgtgaatatgccactttacatggcaaaagaggattttgcagatgcgagattatcgtggattgtctgggtggggccaatgtcatcacaaggatccttataagagggaggcaggaaggtcagagtcagataaggagatatgaggatgaaagtaggcagagagagagaaagagggagagcggaaaggagggagggatagggcaatgagagagattttgaagatgctacacttctggctttgaagatggaggaagcagccacagcccttggctgtagcagcccctagaagctggaaaaggcaaagaaatggattcttagaaccttcaggaggaatatagctctactgacatcttgatcctagctcagtgagacttctgaccttgaggactgtaagagaatatgtcagttgttttatgctacaaaatttgtggtaatttcgagcagcgataggaaactgatacaaggcataaacaggtctgggatgtctcagctgaaatcattggatgaggaggcatttgccaaacaaaaagaaagggcacagagctcctgcgagaaggaatggcgtgtatttaagagggaacatagcatgcttcaagaatttagagaaatccaactagaatggattatgggattgggaagatggtgaagaataagtctcgctggactttgggcttaatgatatggattttaccatttaatgtaaagattccccacatagattttgtttcctctccttctcactttacttttgataacttggtcccatatctacctgagaaggctccatttgtactttatggctcagccaggtgcctccaaataaatgagcttgactctggtacatgtcatgacacattcaggatttgcagaaacagaagctcatgttttcatagtgagattcacattcttccaatctggtgcttgaaaaagagaaagtgtgtttcatatcaaaatctagtcaatgactgagggagtctgcatgcagatagcagttctcccagattcccagaggcttgcctttggggcgtgacatcttgttctaaaatttactgcatcctctctgagccattacttagataaagagagtgagactgtgattgtaactatgttacgacatggcagaaaaacccttggaatgtaatgtgtgaaaaaatgaaattagttgtgttatctggtaaagaacgatgttttcattagctattagggaaacgtgaatcaaaactacaatgagatatcatttatacccactaagatggccataataaaaaaagatagataataacaagtgttgacaagatgtagaaaaatcggaactctcatacactgctggtgagaatgtaacatgacgcagcagctttgggaaacagtttggcaattcctcaaaaataaaacagttactccagagctcagcaattctacttctgggtatatacctaagagaaatgaagatgtatgtccacaccaaaacatgtatatgaatgttatagcagcagtattcataatagccaaatggtagaaacaattaaatattcatcaacggatagatgaatggttaaacaaaatgtgattaatgaaaaattactcaacaataaaaaggaatgaagtactgatgaatgctatgccttggatgaattttgaaaacattatgctaagtgaaagaagctagtcacaaaggtccacatattgtataattctatttatatgaaatgtctagaataggcaaatccatagagacaaaaagattacttgttgtcagaggctggtagggagggatgtggagcgacagctaatgggtataaggtttcttcttagggtaatgaaaatgttctggaattagatacaggtgatggttgcacaatcttgtgaatatatttaaaaaatcactgaattgtatactttaaaagggtgaattatatggtctgtgaattttacctaaaaatgatatttataattttcagaaaatatgttgttgccacatcttgttttcaataaaacataaatataaatgtagaagagtagttatatagtcagttgaagcttcatgtattcaacatgaaactagggaggtagtaacggctctgggagattgaacagagtcgtcggcagccagccatgggattttctgagattggttactgtggaaattcgatgtcctgattattgcactttgaaagcaagcacagagaagctattaaaagattgctttttcagagaggcagagattttaaaaactacttacaatcttgaaaaattgcctggccttatctcacctgaactattaaaaagcctaagattttcaggagccgttagaagtaacagtaattctagaaaccacctatcgaatgatatgctgatggatccaagaggagaatgctgagcctgagaagctctcctcatctttagagaaattggaagtgaattgaattatgtggcttgatggaccaagaaaataacatgttttcatttctgtagaagtggacagctcatggaaataggtgaattaataccacctataggagctgaagtgtcaataagcattggatcagttctcagcttgtattgctcataacttcatctctcaggggtttgaaaaacaattgggcaagctggtactttgaggcccagatatagatggagtaggggaaagagaagccttaggcaacaatagccatgctgcctcagcgtttaatataacaagggctttgatatagctagtaattttgtccagggaaatcctggactgggccagcagactttctgagcaaagtgtaattctgctcaaattagaacctccaggtgatttcttgttcacttatttcagtcaaataatcgttgatgggtgaggatgatgatgatggtgacaaacaaaataacaattagtatttgtagaatgcacgccagtttagtgttcttagaacaactctgtggggtgatagtatcaaccttcattttatgagtgaggacactgagactcagattcagaggtaggcagatttagctgcagagaaaatgaagtgaatcggttcagctagactctgaaccagactgcctaggtttaaatcccagctctgttttgtgacattaaacaaattattaagccccttttttgccttagtttcttcatctatcaaatgagaatgatgaaagtgcctacctcaaagagtttttgtgaggatttcatgtcataattacctggaaagtgcccagcacgtaggaagtactaaaagatgcataggagtgcaaggctaaataacattagagatgtggtcacacactaggaagcaacaaaggtaagacctaagctaaagaattactttagtcaaaaatagttatcgtgcacctactatgtgtgccagaaactttggtcagtgagttaagcccagctgcatgagacaacagcaggaaacaagtggaactttattttgcgagctgttaaataaggtatagttttcatggtaggcattggagtgacagcaggctgtcactccaggcattttggcctagtgacttggaacacaggaatttgtcagacttgtattgtggatttggtgtaacccaagacatgccaataggccaaggggctgccttcattccagtacatggtaacttcattgcatttagacactttttagtagaatatttagaatgttggaaactgaaaagttcttagtcgagccctgttctttaactggtaaatggcagtgtgcttctcatttcaagccaggtgtgtttttatttccacatactacagtgattacatgagaccaagttgactgcttttcaaggcccatctcattcaacatctttccagggtaaaaacgcagcagcactaagttaagacaatcctatctacaatcagattctctttttgctcaaaatctaaatgtaaactccattagcatttctagactgattttagcattctacgagcaaatagaatattaggaagaaaaagtccttgaaggtcttctgtctattccaaacatccatgtcgtgcttaaatcccatctatgacacccccagtctatgcctagctatcacccacaaacagagaccttcatggttctgcctttagattataatagacataaaaattctccatggaactgtgttcacaaccagtctccctgaaactttcatcatgttacagacaaattctgcctctctggttttccagaaaatcactaatactgaattattattgttgctagggaagtacgggttggcctagcttgctttctgagcatcaacacaaaagtttgggtcatattttctttctggcagatgagaattgtgaatatatccaactacaactggaaaatattttaaacgaaagttaaactcttgcccccaaaggtattttgcaaactgcttatagaaactaggtttaggcagggaatcctttacccattgcttgtttttgttgggtttgttgaaggattccctattcagtaaatggtgctaggataactggctagtcaatatgcagaagattgcaactggaccctttcctttcaccatatacaaaaattaacttgggatggattaaagacttaaatgtaaaaccgaacactgtaaaaaccgtggaggacaactgaagcaataccattcagaacataggcatgggcaaagatttcatgacaaagacaaaaccaattgcaacaaaagcaaaaattgacaaatgggatctaattaaactaatgagctgcacagcaaaagaaactatcaacacagtaaacagcctacagaataggagaaaatttttgcaatatatgcatctgacaaagttctaatattcagcatctataaggaacttaaacacatttacaagataagaagcaacgctattaaaaagtgggcaaaggatatgaacagacacttttcaaaagaaggcataaatgtggccaacaatcctatgaaaaaagctcaacatcactgatgattagagaaatgcaaatcaaaaccacaatgagataccatctcatactagtcagaatggctactattaaaaagtaaaaaaataacagatgctggcgaggttgtggagaaaaaggaatgcttatacactgctggtgggagtgtaaattagttgaaccactgtggaagacagtggggtgattcaaagacctaaagacagaattaccatctaaccccagcaatcccattactcggtatatacccaaaggagtataagtctttcttttataaagatacatgcacatccctgttcattgcagcaccattcacaatagcaaagacatggaatcaacctaaacgactgtcaatgatagactggataaagaaaatgtggtacatacacaccatggaatactctgcagtcataaaagagaatgagatcatgtcctttgcaggaacatggatagagctggagaccattatccttagcaaactcacacaggaacagaaaaccaaataccatcatgttctcacttataagtgggagccaaattatgggaactcatggacacaaagaagggaacaacagacactggggcctacctgagggtgagcagtgggaggagggagaggatcaggaaaaataactaatgagtactaggcttaatacctgggtgatgaaataatctgtatagctaaacccccgtgacacaagtttacccatgtaacaaacttgcacatgtaccccaaacctaaaataaaagttaaagaacctaggattagtactcacagtctctagattcccgctgctgatgcaatgagtcaggtttctgcatttcatgatttataagagagctcaaagacagatacagttttcatatcatatcagagtgttactctagatatttcagcaagtcctcaaggaggtgtgttgaatctggcttctaatgttttaatatattgtcaataaatgatattgtcagaatgtgtcaaaatgctgagaaagtaaacatgaaaggtgatatgaagattatccacaggcttgaaggtcacaaagtgtgatatgaatcccagaccagctccagacactccaaggcatgagctcagcaaatatattgttgttctgctgcaatggcaatattttaatcttctaatttatgattgaattgtaaatatattactttttctcatgtagctgaaagtgtatggtgaaagataggtatagtgttatggaagtaatcaaatatttaggtttttgttcagggttctttagctgaaattagttattcagagttacaagtttaaaaaatgtgaaatagttcattttctttgagctattctgttttggtgctccctggggagagccggatgcaggagagtcaatggatcttgattgtctagtttgcctttcctcatcaagaaatagccttttttacagaaaatgtttaaaatcctactgtgtattttactctccttatgaggttatcatttctaatttatataaagatatagtagatgctgcttatataaatgttcattgactgaatctaaaaccaatctaaaaataaagttattttttaaaaagttcattgaataagaaagttgaatgattgggccaggtgcagtgactcacacctgtaatccccttgaaagcaggctgaggcaggaagatcacttgaggccagaagtttgagaccagcctgggtaacatagtgagaccccatatctacaaaggaattttaaaaattaaccaggtgtggtggtgggtgcttatagtcccagctacttgggaggctgaggcaagaggattgcataggcccaggagttcaaggttgcagtgaaccatgatcgtgccattgcactccagcctgggcaacagagtgtgactctgtcttaggaaaaaaaaaaaaaaaaaagaaaagaaagttgaatggtcaagaagaaaattaacaatatatttgcaaagattccttccaattaattaattaaatgtttctatgcaatatttttataatgcagaaagttgattttttcattttatttaaaaagacttcttacagagttttagatcacactctattagtataatttccctgtctatatgtacatacatgtaacttttaacttaataactgctttataataaaaaatgaaaggttggctattaccatatataattggagcaatgtggttacattatttttatgaaaatacaagtttttaaaactttgtgaagaaaagataagagtggcaaaagctctgtttcttagtctgagttttcccaaaggcaggatctgggtgaaagcagtttatttgggaggtgctctcaggaaggagtaatgaagaaaaagggataatgaaatggggaaggaggggaagtaaagctgtatcttggaagttgtaattgtggaaaaagggatgattcaagttccaccaggactgctggaaaatgtgtagaatgtctatcgagatgatctacccatgttttagttctctattgctgcataacaaaccacctccaaacttagtggcatgattctgtgggtcaggaattagatcacagctcagctgggtagttctttggctctgcatggcattggctgggctcgctcacttggctgcttccagctggtgtctgggatgcctggaaagttcaaggtgtcttcattcacatgtgtggtgcctcagtgatcctccatgtggcccttctctctccaactgactagtttgggcttcttcactgaatgttggtctaatggtatttgatcagagtgagtcacagggccagcccagattctagggcaagggaaaaagagtctaccccttgatggaagaagtgacaaagaatttgtggtcttctttaatctgccacgagctaaaggaagggaagctggagaatgtctctgttggtttccatcttccattttttaagattgcttctggggttttaacttccacatgcttcttacatatgatgaggtgtgcactagagatgaatcactagcagcacacaacgtcagtccgagcttgcacagaactgcccagcacagttgtagcagaactcaaaaactttagcacaggctcatgggaagtagcatttagaatcagtcacccacaatcttagctactcaaaaacataactgaaggacaatatgatcttagacaagcctaggatcaaatctcagtgccactatttattaggtgtgaatttcagttttctcagttgtttaaggggagtataacagtatgtactttgtaggagcttgtgaaatgaattggttgagggtacacaagctataaggggtcatgtagaagtatttattgtttattactttaattcgttctcaaatgttataggaaggtgtacatcaattttataatgcttcagcgggaagaggaaaggcaacaatactatggtaaatgtaaagagcaattgtaagatgcaactttaggttttttaaactgtagggaaaataagtagtagttgaagaattatgatacaatgtagtttatcctctacattcatgggaactaagaaacaaactttggcaacaggtttattactggggcaatcttggtaatgtttttaattaatactttaacaaaacttataattgatacataacagttgtacatatttatggggtacagtgtgatatttcaatgcatgtatacattgtataatgatcaaatcagggtaattactctgtctaccactgtagacatttattatttgtggagataacattctataccttctagctatcttgaaatgtacactttattgttattaggtatagttaccctactgtacaatagaacatcagaacttatttttcctgtctaactgtaactttgaaatacttttaactgaaatatagaacttacttggatttttatcagtttttccgctaatatccttttcctgcttcaggacctgattgatgcagaatctcacattacatcaggttggcaaggcttcttggtctcctccaatctgtctttatttatttttcgtgagcttgccacttttgaaaagtattggtcaggtattttgtagaatgtccctcggtttcagtttgtctgattttgcatgattagaatgggatacttggaagaatacataaaacatcatttgaacaccaagtgtcactgtttatctatgttagtaaaatacaatgtttcttttattgatgatgcttttcacccaatcagcccacattctcctgtcctgtctgcctggtagcatggccatatgcgtgttgataagatgcaatactgaaggctgtgctgagggactgaagaaagccaccttataacagtgacctcattagcagccaactgacttcattggcccttcagctggattctctttctctgtaatttggattcgcctgcccttttttttccattacatgggaagctctctggcaggctattgctttgtctgtccttattgccgcctcggggcatcaacagcatgtctttgggtgctgcatttgttaatgtgggaggctaagagaaatccaagatgaaaatactccttgtcattcccctgtcagaagggggaggaagagctaagctttgagtacatattcatttacatcagcagcattcttctgtgctcattggttgcttacttctctcttattaacagtgctagaataaacacacaaatctaccaaaatattagcagtgtgtgctgttttctttcacttgccaggattgttttataataaataccattggaaaaaataccactggcaagcatcctcagcaattacgttaacatctctagagaacaaagtatggtatcggaaggtgctttgcaaagaggagcagaacgtgtctggtttatactgcattccttgaatatactgatcttgttacctatgagtttgattttaacttaggtatttctcttgattgacaaaaattgatgccatcattttgtatgatattcactaattaaatatattttggaagacaaatataaaggttcctttaaaatgaagtgacactaaaacagatgttcataatgtgctttcatggtaggaatttgtagattaaatcagatattcatgtttgtcaaaatattttagtcaaatggaagaaatgagttttctcaacaattttgtttgtttggcttatgtcatgtcttagtttatttcaactatcatttctatcctttagaggtaaaaattgttatttctctccccagttgaaccctagttccatatttctgtttgcaaacaaaatgtttctacttgttgattccaccatcacttcaaactctaaatatttaaaataattaccaaccctttcccccaacaaaggaaaagtaaatacatgaatatacaaaccgcaaccagttctttctctaaaccttcctgttttcttctgtgataaccatttttgtaaccttggaatcttgaacacatttcttattgttcctcagcgtttatattctgtattgaaatgacccccaagacttgtctcctgttctaggcaatgttcctatttagccttttctctctgttccaccgggcatggcccttgtctctcatgctgggtgatatggtttggctctgtgtctccatttacatctcattttgatttttaatcctcatgtgtcgagggagggagagacctgtaatacccatgggtattacatggagagaggtggttggatcatggaggtgatttcccctatgctgttctcatgttagcgagtgagttttcaagagacctgatggttttataagtgtgtggaagttcctccttcgcttttctctttcctgccaccatgcaaagaaggtccttgcttcccctttgccttccaccatgattgttagtttcctgaggcctcccagccatgtggaactgtgagtcaaacctcacagcaatgtgaaaacagtttaatacactggaccttctaactactttcctggatgatgggttaaccttgttttaatccatgctttcctcttccttaagcattaataacatcatttaataataattaacaacatcatttaatttcgttatgaagtccctgttacaatcaagacaaaatctcatctgtcatatagacccttcctaccatcatcagccccttgcccatccttttctagtaggtcttctttgttcctactcctctccttctcctctttcctaattccaagcttcttctttgcagtcttcaacaaccttattcaaatttcacagtcatctctttggctctaaaagccaacgagggagagcacccaaggactttatttgaaagtttagagacaaataactttatttgaaactttatttgaaagtttagagacaaataaaatacgtatgtttgtctaatttctgagacaatgacttaaaataaaaccattttccatgtaaactgtgatagcatctttggggttgggcaatcatgaattgctgagaaccttggtagccacttcatattgttgaattatagtttctcttttttagaaatgaagtaacgtttcccccagaagctactgtggatgagatgtttggagcattgagtagtccatattaatataagggatagcaaaaaaaatgattttttttcttttggagtataattctatggattttagtacatgcataaatttgtgtagccactgccacaatcagaatacagaacagtttcagtgtccccaaaaaactgtcttgaatgattgctttatcattcctaacctgcccctactggcaaccactgatctgttctccatcactatagtcttgtctgtttaagaatttcatagaaattgaattgtacagtatttagccttttgagactggcttcttttgctcaatataatgtctttgtgatttgtccaacttgttgcattatcaatagtttgttcttttttattgctgagtagtaagttccatgatatggatgtccaagtttgtttttccattcacccgtcaaagtaaatttggcttgttttcaatttgagggcaattagtatggctataaatgtttatttacaagtttttatgtagatacaagttttaatttctctagagtaaattccaggagtaggattgctgtgtcatatagtgagtgtatggttaactttatgagaaactatcaaactattttccagggtggttgtaccattttcattcccatcaacaatatatgagagtttcagttgctctgcatccttaccagcacttggtattattagtagtttctatttttttcactttaataggtggtatctttaatgagtggtatcttgtcatggttctgcttggaatttccctaacagttgatgatgctgaccatattttcatgtacttattggccatccttatatcctctttggtgaagggtctgttcaagacctttgcccattttttaaaaatcaggtagatttaatttttgtaagaaaattcttcctagatttctctaggtaagaacataatgaaggcatctattttctagcaagggtggctagaagcagaagtttttagcttttacaggcagcagtggcagcaaagttgagtttctgatgagagtggcatccatctggtaacagtgtggttgtagtaacatttaggtttgggaggcaacataaattatagcatctggagcttgaagatggccaaattcagttaaattaccagatcagctccattatgtggttttgaaaatttttctcggaagcttggttctgggcctctccatgatccccttagctagctgcccaatatcttcacaactccatttttcattaggtggagttagcttctaagaacctaaagtacaacattgaattacctactgcaccagttatctatgaccacgataaagttgtataacagacaaccacaacacttggtttcatgcaacaatggatagttaattttgcacatggatctgtaggtttgtgtagtctggttgatgtggaaagagtgtggcggatctctactgggtttgctcatgcatatgcggtcagctagcatgttgttggggataattcatgctgatccctatggcctcattctccagcaggctagctcagatttgtactcatggtggaagcagagttgtaagagaggaagaagatgctccaagcctcttgaggcataggctagaaactatgcactgtcacttgtgctatcttctattggtcaggctacatggcagcccaaattcaagggattgggccatagactctatctattaatggaaatttcttccacaatgtaagggattgattctgtaatcaatctcctttatatataaatggtttggaattttgaaatgagtgcagtataaaaagagaacccagaaaaatacatcaaaatattataatatctctgagtgaatttaaatcctcttttgcatttttgtactttaggttttctaaaataaacagatattacttggtgtaagttaaacaatagttgtaaaaaatttataaagtgttttggaaacaaagaagagggagtgattaattctggcgttagaaaggtgctaacattttttcccaaattgcaagaattgtaaatagtagtccttcagggagtaaacttgtccagaatttttttggcataaaatattaaatacactatttgtagatgggaacctctgacttttaccaaacctttggatattttagacttatttttttacaatagctttgtgctaagaagaaagactgtagaagggaagacaaggctctggtgttatcctcttaaatttggaagactggaatcatgcaggggaaaggactctatagtatgaacttttgtgtgtgtttgatgttgagtagacagcttggtggtggatctatggatggggcaatggctatagaaaacagcttttcttcctcaatgccttctgacaaatctcaaatgagttgttcacaaaaacaaaagcagggaaatgctacaggagaacccatattaagtagatttcagttatacccattatttcctttattgttttaaaaaaaacagctttattgagatttaattcacctaacatataattcacccatttaattttaggacatttttatcacccccaagaagaaaccttgtgcccattaagcagtcattctccactgttccttgccctcagtttctgtctaatctactttctatctctgtggatcttccagttgtggatatttcataaaatggaattatacaatatgtgaccttttgtgtctagtttattttacttagcaaaatgttttcaagattcatccatgttcatgttatagtatgtatctgaacttcattcctttgtatgactgaatgatattccattgtgtggatagaccacatcttattgatccattcatcagttaatggatagttaggttgtttccactttttggttattatgaataatactgctatgaacattcttgtgcaagtctttgtgtagatacatgttttcagttctcttgggtatatatgtagcattggaatttctgagtccattgaggcttaaacaaatttattgcttaggcacgtttggcaaatatgatagttgatttttctaggaatatatattttttggcctaaacacagtgaatataggacatgttatgagtaatcattctaggagagttcctcaaaagcagagctgtagatacgtttaagtgatggcacccaagttggaataggtctccagcatctgtagctaagtattttgaagtgattgtgcaaattctgtggattgtttccaagatgtactacatctattaaaaattaaatcttatagttaatattcaatatatgatgtattgcatatacttggtatcagcatgcattcaaacgtgaattgaaaaagagaaaatggatccgtacttatggtctgaaagaagtaaaagaaagggtaaaatcggtctgtcaagcaatgtagaaaaactctggatgtttgctatctttttaaatggtatttttttttccatggggagaaaacacatgatgagaaaagaagagaaagcaagtgatgatgatatgattgataattaaatgcagctgagcagaaacaacgtggacacgcttagaatttgctttagtactttctatgcttccttcccgggaggctgttaaaactcttcagcataagagcatttaaacaaagagaatattgccttttttccttctactgcatctattcaaacatgcagaatgtatgtcttggtgaaatgctccaaagatagcttgtggaaatatttataatgcgtgtaccagcatttttcacataatttaaatacatgcttttaaactgtttattcttctctgaagttttgcaatatctatatgaccaaatttattgcatcatctgctaacttgaccgagctgttaatgtgtgatgcgaccttcttcaggttgaaagtgacagtttagcatatcacaaagaaaaggttatccttaaatgttgagactttgagatactagccaccgttgtcaatatgccaagtcccaggctacttgctgctcatacttaaggacaagataagtgtctttggaaaacattttctcccatttgggccatctttttggaaccagaaattgctctgcttctatgcaagggaagagaattttgctctctccattccctgtatcattttggcaaatccttgttactgttaattcagggggactgccaatttgaaggatgtggtgaatgtcaaagtaagaggccatatttgccccatgtttctcctgaggcagaatataatttttacattgtgatcctttgtgaaatcagataactaaggaccactggttccaaagacaagtcttctccctatatttttttcccacttactagtccagaaaaaaaaaatgggttactcaatctctgtgccagcaagtatttgttaaacacccatgcccctgtcacttacacaggcttgtgatgtaaaactgccttaaccttcatacagcttaccattctaggtaggtaggacacagggaaatttacagaataacacatcaatattaaactgggataaaactatataaggatgcctgccaattccatatatatttagataagggagaatttgggatgactgagagttaacaaagaagacctcacagatgggggtactttgagctgcctctggaggtagacagaacagaatgtcaatatatgaattggagactcttctgggtgtttgaggttggggaagaaacaaacaatgcctccaggagagaagcagcctaaacagcaactccaaggaagatgggtatgaaattcaccgtgtgtgtgaaattatgacaggagtcccagttataggataaagcagcaaaaccagaaagcaagtgtttagacatttgagcaaacctcttattttcttatctgtgtttgccccgtcacataatttacagtagaaagttatttaaggcgaggcagcactgttcttcatcagacttgcatttatgtattcaattttggaaacactatgacttttggaagcaaagaaacagagttaggctgaacgcccaactccagtgtacgagaatttttcttcaactcactgaataaatgagtattttggggtttttgtaatgttcagatgggaggcaaaatgcagacacaagcctagaaaataatgcagatgccaagttgatgtgttcttgagcaatggacattgaatcaacaaatagcctgatgagagagcagtgagggtgaagtagggagtggaatattcatgtttcctttcccggggcactgttcttacatctcctttacattttgttagatttaaaactaaggaatcagaagctgataaaaaattactgtaagagaacacattgaataaaagagtggtgagaggattcattcctctattaacatcagcagtcatctaaacatgtactttttttctggcacaaaatcatagctgtagcatgaccttcttgcttactaaagatcacttaaaatttttaacaaaaaatggcttaagcttgaaaggaggcttttaaaatgttaagtatggttctgatctacttttaaaaatccaatggttaaggccaggggcattggggttagaagttggtggggggtcaggagcaggttggtgattatctttctctctctttctctctctttttctccatgtctctgtccctttcaatctctctttttctttcaatctttctcaatcccccatctctcttaatttatctatttctttttctctcacagatatatactgtaaagtatataacaaaaatgaagtcccatgataatttgttgctaaaccacagtgcagctgtctaatcaagaaggcatatttttttgtggcacatatacaccatggaatactctgcaaccataaaaaaggatgagttcacttcctttgcaggaacatggatgcagctggaaaccatcattctcagcaaactatcacaaggacagaaaaccaaacactgcatgttctcgctcataggtgagaattgaacaatgagacaacttggaaacagggaagggaacatcacataccggggcatgtcgggtggtggggggctgggggagggatagcattaggagatatacctaatgtaaatgacaagttgatgggtgcagcaaaccaacatgacacacgtatacctatgtaacaaacctgcacattgtgcacatgtaccctagaacttaaagtacaataaaaaaataaggcataattgtaaaataatttatactcttttcataatctgccccaatgtcccttgtttcagacttatgttttttcccttgtttcagacttatgttttttctcccttccattcctactgccttgtcactttcttaccctttcacattccttagactctgggtttaaattcctgatttttggcagtcagaaatcccttcaaatgaggctgtcaatccatgcttcttgtagcctccaattttcagattagctaaattataaactttcccatttacaagtgtggcattcctccgcagcctaatgtttatctaaaaatggtgttcattatccattaggtcttattcactctaatttataaatttagtagtttgaccacttttactagtgaatacacttatttaaaaatactttttacatttaatttttgtggatacatagtaggtgtatatatttatggggtacataagatgttttgacatgactttgtatttaatagtcttgggctatatataatttttcttttatctgctagaaattactatcttcttcctttgggttggggactaaaacttgcatttaatatggaggggtggtaataatttggccctgttttctctgtatgcttgttgactccttgttcttaggacacatactgggaagaattatttttgcaactgaaaacaagtagagattttaatagggggtatagaatgaatttcagatgacagtaatcactaaaagtgtctaaacagttcaaattagttgtgtgtcttgtggacaactcatctaaatacctgaagtttggttatttgcacatagaacctgaacactatttcaagcttcaggttttaacgtgtgctgacttgtaaacaactttcaaaaatttaaggcaggcaagttcacctcaggccactgaattttcattgcttctgtgtatatttttcagcgttacccttgttcttttttgactttgtcattttcttcagtccaactgaaaatgttagtcagaatttattttacattagagtatatattcctagatgctaaatccctgagaacaaccttttctacccacttttgtttcttctggtgatacctatttacattttgctttcaaagggtgcccaaccactggatgccatacttgtgttattagctatctctatctgcctaagcctctggtttgcttcctcttgggaattaaaaataagatttctcttgatttcattgaaaaatcatcattctttcagctttgaccatattgttttgataaaaacagctgatttgtattattgaacatctttctcatttttctttctccataaggagaaattcatcacgatttattacctgaacatttgtgaaaccaatttgagagaatcccaaaagaatcattttaattgaagccacctaattacttgtaattaagaagacttaaaatgccaaaaaaaaaaaatcaaaattacagctaacaaattcagaggataggataaaatcaattactgaaaaatccaattaggtttggggagaagctgaacagaattttatttaaacccagtaaaatgtctttgagcttttcacatggacccatttgagttcaaactctttattattaagagttaattttatctttgttttctggtagtgtagtaggtttgaataggagctcttgaataggagtgcaaataattaggttaatggtttttcttttcatacgttattagaggaataatacaggaggaatgaaaatgaaagcaaaatttagaataaaactttaaaaagtttatgaattgttaaagctaactgttggactcccagcagtggctgggaaaatggtaggattttatgccaaatattattattgttgccttttgccagagtttagtggaattgccctgaacatcaacttggccatttcaactctcttatgtttgaggtctgctgccagtagtcagaccatgataaaaacccatgacatgctaagtaatggatgctgggcaataaggatctttctaaaaatggctcttaaaaaaatcatcatcttgcaactgtaaatggcctgtttgttaatagattatttttctcctttcagtcaagattttctgcgtaagtttacagcctataagtttataaataaagtactacattgaagcaacatttttattagtaggtatttcaacttggatgttgtgagggccttttaatttcactttgcacaaagtgaaattgtagaaatattttaaacaaattgatcatggcctaaaattttctgcaacatatttggttgactgaagttattgttaaatttggcctgaccaaaatttgaatttcatattttatggttaccagtgtactctttgtaacaagttgtgcttctcttgtgatgacaagaattctgaaagatggttgatttagtacttcgagtttcacattatactgaaaaatgtggatgcccacctgagccttgatctgatgaccagggaaacagcagcactttttcaaaatcttaattgattttaaacaagcaaatcatttaattctgtgagccttacactctgtttcttaaaagaaaactggagaagaaaccctatctcaatccttgtccttgagaatcctagaaaatccacataacccttttccccaagtcattggagaccttttttcatcctacaaactctagataggcttgttaccgggaagctttaggagccttcctagtacctactgtagtatcttgctagctctacagtaaagaaagaaaataatatgaaaaagtgctctgatttatagcccatatctctaattggctattagtctgcgctgacagtaaaaatattaaaacaaattacccttttaagttaaattcacacccaatgaatgaacaaataatctgaatgaacaagcattctcttgttgatggtgatagtaattattatctgttgagcaggttgacttaatttagtgaacataaatggcctctacttagggtgttcatataatttgttgtcaaaattgtagcattttggaaagtgaaaagaggcgctattaataattacactaaaataacaggcataacctgaattgtccctgttaaccctcacctggaatgtattgttctccttccttccatgtgtagtcaagtgctacccacttttgacggcccagatgaagttttctctaagaaggctctttagagtactttgtttatattttacctgaattaaggcattgaggtgccagcatgtcagaaattaagatgttttatatatttcaaggaaacaattgttgctgttatttgacatgtatttgttctctcttaccaagtagaatgcaaccttcttgagcacaagggatatgtcctatccttctgtcttgctgaagcacttaggtatattgcaacgcccaaagtgaagagagaacacattcttgctgagttgctttaccttcatagtaacattcctctctatgtttgtgaataaaataatggatattggtgccaaaaatgctggttatttaaagagatttcttctgggtttataatcttatacagtagaaagggataagaatcaagccaaatatagttaattatggcctgagtacccatttagtcacccgatgtttgaaagtgtccactcagatttagacattttaacaacaaccagacctttactagcagtactttatcatagaaaggatcatttgagaatatcttaattgtagcattctgagcaaaattataattaaattttactaagtatttattaaaaatataaagtggatatttttctaattataaaagtaatatatgctcattttaaaaaaatctcatagaatacaaaaaaatgtagaaacaaaaccaaaaaccactcataatcctttattatagagataattacttggactatttgggtatgtttccttgaagtagtcttttgtgttatttatatactatacagtgatccttgccttctggcattcacagccttgtgtaatcccctccgtataacttgcttataaccaataagagatgacaactttgggaggacatcacttacatgatgaggtcacaaaagattgtgaagtttgacttgctagccggttctatcttgctggatttgatgaagtaagctgtcatactggagaggtccacatgacaaaaaactgagagtggcctctggctaacagccagcaaggaactgatttctcagtctcataactcttaaggaattgaatcctgccaatgaccatgtgggtgagcttgaatgtgaatccttctccagttgagcctccagatgaaacccccacttcagtgacaccttgatcatggctttgtgaaagtctgagcagaggactcagctaagctgtgcctggattcttgacccacaaaatctttgagattacaaatgtgtgtggtttaagctgctaagattgaagtactttattacatagcaataggtaactaatataattacagagtgtctcatttatagtttaatagcatttttacttaacattttcttattaaaaatctcctgtgtcattaaaaattactgaaaatatgatttttcttttccaggtggaaaagaatcacatagtaaggatatgccaaattttaattattcttatctaattggatatttagattatttctaattactggctactatgactaccactaaagtgaacatcctcatacatccatctttcactacaatgactacatatcttattatcccaacaaaattcattgccataagataaatgatccaaaaggtatgcataattttaaggatttaggaatattgctaaattaccttccagaaagttaggctattaaaatgcctctgagtatttcaatgtaccttggccagcactgaatggttaaacaaattagtcaacttgagaaagagtatctctttgtgattttaatttttattttattatgtcttcatatgattattagttaaagcttattaagaatttaaataaaaataattaccagcctgggcaacataggcagaccccatctctacaaaaaattaaagaaaaatcagctgggcatggtggtgcacacctgcagtcccaaacctttgggagcctgggagacagagtgagaccctgtctcaaaaaaaaaaaaaaaaatagccaagcacatggcttaaaccactcaatccataagtaaatatacacataggagaatgcttttcagtgaacatttatcaagtgctccttatttgttttacaaatattaacttatttgatcctcacaacaactctgagtcaggtaccactataaatgctgttttacagaaaataggcaaaaagcaacttactgagagcagcacagctagcacagagctgggagctggagacaggcatgcccttgactgatatgtaatagacacccccatttcaaacaaaaagccacatccattcaccaaattccaaaggaggcatcaattccttcattatagatcagaaaaatgaagctcaatgcatcttgtctagtgaatggttcaaggttgtgcagcttgtcagtactgtgatttagaactcaaatgctagtctgtccagacgccttccacttccacatttcctatgaggaataagcacacaaagcaggtgctcagtaaatataggttgattgaactccaacaggctacatgcaatatgaaagggtgatggaatgtcagtgaattggaaacagtgggtatagtggagtgatgctaaaaatgacccatcatggcaggtcacaggaggtctcccagtggctcagtccctcagaagaaggtatggagaagtaatgggggaggtagagagaaacaaaaggtaagtttaaagagatcctactcataggcaagcttatgactgtttctgcaaaggcattcatggcactgggacagggagggtgtattgacacacagccaatactataagggaaaaggtaaaacaaaaaccaaggcatgtttgtccaggtagccgtagctgttaccagcagcatttagacaattgcatatgttttaggttgtattctccacaaagcagacagagctaagggtttgagtgctagtgatttgtagggaagagctttagaaagaagccagaacagtagtggagtaggaaggggaagaagccaagcaagggtgtagttttgggtggagtcccagggtcagcctagatcccacggggtgcttgggagggtaaattatacctcagagtttgttccaccatgaggcaaaggctctgggcattggtactcacacaccagtcaatggctaagtgtctcaggcacttctggcatgtgtgagctggcttcagcacaaaggggacaggtgccagtcactagcagcaaagcccacaaaagccaagggatggacacacaaagttagtaaaagggatcttagaagatgtggtggctaccagcagtgcccattacagcatgttttaaactacatatggcagggcatccacttaaatacatgtatttgtgagaactggaaatttctaatttgacaattctaatttcctcagttcctgctgggtcttaatgtaccagacagaagtagaaattatattatgttctttacactgtgaccattcatgcggaatctgtgggagttataattacgtcaattaaagctgcaatttgctaaaggaaaataaagaatagaacaaataattccaagtctctaacttagaggattagtgttcaaatcaaattggagctttgcaaatgttaatagttaagctatgtttaaggtatttcaattctctacccataaaggcaggttttaataaagtcacataaatggtaaccccaaaggctttctagcagcaggatggcaagttgttatgtattattgggaaatgaagtatatttaatacctttccaattgtcatcactctaaaacacacttcaacaattgattaagctgaaaccagaagaaaattatttccccttacttttgttttcttaatctaatgtctttgctagaaaatgtagatattagctaatctgtgtctggcagcaaatacctgcatgttttaagtattcacaaatttcactaatagagtagcttaacaatagttcttcatttctaggtgaaatattaaatattatattcttaactcttactgtcagattaggagaacatttacatcatatttaaggcaaatattcctgagtccttaaagcactctagctgggtatttaaaaaccaccttctgtagaccaggggtcagtaaactatggcccatgagcccaattcagcctttcatacatgcatttttgtacatcctgtgagcaaagaatgctttttatatttttaatggtggaaaaaatcaaaacaatattttatgacatgaaaatgacatgaaattcaaatttcaaggtccaaataaagctttattgggacatagctacacccattttatttacatattgtctgtggcagctttggcgcttttatagcagatttgagtagctgtgacagacactggatggctatcaaagcctaaaatagtttttatttgatcctttacagaaaatgtttgctgctccctgctgtagacttttgtgcctccctttgcccgtagtttgtgatctcttaaaataacattggaacacttagaacttggggagtcgtgctatggagacactggaaataaagtccattttactttttttttttttagacggagttttgctcttgttgcccaggctggagtataatcacgtgatcttggctcactgcaacctctgctccccaggttcaagcaattctcctacctctggcctcccaagtagctaggattacaggcgcctgccaccacgcctggctaatttttgtatttttagtagagatgaggtttcaccatgttggccaggctggtcttgaactccagacctcaggtgatccacccggctcggcctcccagaatgcttggattatgggcatgagccactgtgcccagcccattttacctttttgagggaagagttgattattttgatgagcattttacttaaagacatatggctacaacacagacattgcacaagatcttttatctatgcatatttgaaatgattgtagatttccaggggcctgaattatctgaactattatctctgttccatttacatgagtgacatgtcctttggcatagagacaatcatcaactctcttcaatttaccttgtcccagcattttaaaaaaaacagtgcctggccaggcagccaagcggccgctttcattgttactccatcccatcctctcgataatcctacaaataaattttatttttcaattttagcgatgaggaaatcggacaaaaaaggtgatgctattcatattaacattgcatacttaatcaaaggtcgcttcaggatccacactttgattcatctaacttcaaagctttgctcagagtattttgtcttattgccagtcaaaggaagaatgtcgttaacattggtcagaaatcttttcctaaatcattgattattctctacccctactcattctccgcctgtccaggtaactatctgcattcatctgcttttctgtctgtccatccatccatccatccatccatcctttcattcatcattaactcaaacatcaaatgtttattgagtacatgccagccatcttgctaactgcactaggcagtagacatacatttgtgaacagaagagacatggtccccaccctcatagcatctttttgacctgacagaactgcacagaggatggattttatttgtccacagatttatagggcccaggcatctatatcataagtgggatttgatgtctatatgtttcataatctgcccttttggaaatcatttgacttggacctcttggatgtcttgcttttacaagtagcctaaatagtgtattgaagaggttataatcagatttttaaattgaagggtggaaaacatatgacactgcatcttttctttttaactgaatgtaacgctttacataaacatttccctcagagctactaaacacatgccaaattctactaacaactttctatctatctatcatatatatatatttggtaatacatttttgttgatcctatcccaaaagctttccacccattgcttgtcactttgagacaacagaaactggcaggaggtaattaatagacttgacctgtagggtgaatacacacacacacacacacactagttgggggagcttcgattcttttcaaaggactttgctggtgagacttgaaagtgccatatgcctgctgggagaagttttgttttggtagtagttactggttaggctttggaaatttttcttttggaaatctggctggttctcaaaaattgcctttaagaattgtattttgtaagttaagagcagaagctattattagctgtgtgtttgtggttgaaacatgaggtcaggtttggcagggaactcttaagggtgtgtgaatgcgagcctcagcccagccatcctgtggccactcagtgccttggggagcggcttattcctggatacagaggcaatgcctttgtcttacaattcgtgggagtatgtgctttaataatggaatgcttcctttgtgatttaagagtgacttatagtaaatttttattaaggattcaatgtcctattgagaatatatatatgaatatatataatatttatattcataattgctttattagatcagggatcatgtttgtcttgtttatcattttattccatgttccaagtgcagtgcttggcatacattataaatatcaatatttgttaatgaatgaatgcataaatgaatgagtgaaaaatgaccacaaagagcacatgtagaaagattaaagacatatgttaaattgaaggatagaagttggtagtcagagaacatttgtaggtcaagcacttccaagtgatggcagatatctaagatggggtgaccacactcatgaattgcaaatacagaattctctggacctaagagaactgtggaactgtgaggtaattgtatgctctgatgttgaagccactaaaggtaatggcagatgaaggtggtggagatggaggaaagtaggcaggttccctcctttcctagctgtctcttggaatgaactaagtaattttgtatagatgtgtaaagatagtaaagatagaagatctgtaagactcgagctctagctcgtgtatacacacacacacacacacacacacacacacacacacgtatctgaagcatggggatgatcatatgacagtaataataattaaacacttactgtaagcagatgaccaaaattagctgtggttggacattatggaatgattagtacacataattattttctgctaataacaagacaggaagtatttatacccacatgaaatatttaagcagggagaaaacaattccagttttgccaaacgtttcttatatccattttgtggaaaagactccgtactagggaaaaggagttgatctgttcattgctcacttgctttcacgtagcagatttttagcgacacttagatggtgagctctggaggaaatggctattattattctagttcacagcagtacctaaaattgtgaatggttagaatctcttcatgctctgatgacccaactagctgtagagtatcacagaaagaaatgttgtcttgctaccatttgcacgtatgcaaaatatgcagagaatatagctgttttaaaagaaagctttgtaaaaagaaactagtaagctttcaataagaaatcctttaaatcctcagcattacacaataatacaattccctctttacagattcacttatacctttactgaatcagaagatgatgttgggggaaaagttgcttttcaaatgtaaccataatagaattttccctgtatctttcaaataattgtctgtgaaatcactttgtgatgtctatttcagaagcttagccatgacagcacaatcataaatattttcctctatgtcaaccattttagatgacagacagatctatctagtacattttgttttcttctaaaatctcaaatactacccaagtcagctgtttttaaagctgtggcctaataaacaattggatattgaattgctttattgcaaataaaaatgcctcatctttgtttcaacttattctcaaattaccagtgacattcacttttatattacattgttaatgaaagtttacctgtgggtctaaaaatagagacaaaaagcagtgaattgactggaaaactaaccattagggatattaattttttggaaacagtagttttattctgaatagtgtacactacctgaaggcttgaaggttgcatataccagtctctgaactccatagtggaaatgatgtctaccatagcaatcatcacttaatgagaaattactacttattacgccaggtactgagtgaattagattagtaattgcattttatctctcattaatctcatgtaaataatgttaattctccactttacagatgaggaaactgaggaccagagattagataatatgctcaaaatcacacaataagggcaaagctaagacttgaagccagatgtgggttcctaatcactttgacctaattactgggagaagcataataataaagacaatttattgtgacctgtgtattatgtattaatgactaaacagcatttttgcatgtttaaaaaaatctctgtaagtggtattatttgataggcattattctgcaacatattttctttactcagcatagttctaattatccattttaattgttatataatattccattttatgagtataatatcaattattttatctcttttcctattgatgaacagagtattcttcaaaattttcttggctattcttcaacacttcttcatttacataagttctatggtatgcttatctagttcctgattaatcatgttggaatattgtgtggaattgttttgcatttgtatattaatttaggaaaattggcacacatatgatattgagacttcatgtcatgaaatggtatatctctccatttactaaagtaatattatatgttattagcaatattttaaaactttttcaacataccctgtatgaattttcttgcatgtattcctaggaaccttaggattatcattgattttttttgtatggtatgtttactttctaatttgttattactctgatatagcaagggcattgattgaatgttgatcttgattaaacaaccttgctgaattatctaacttgttctaatagtttttctatgaatttctgagattttctttggaatatcatcatatttttgccagtatgggctgttttatctctttctttccaattcttagacatcttaactcctttatttttgttttgttttatttacattgattgtggccttcagaaaagtttggagggaaagtggtgatctaacatcttgtcttagattttaaaataatgtctatcaagttaaaaattgggagttctttaatttttgttaagagtttttaaaataatgagtaatgaattttatggattttttggtaaatacaatgagatgcagatataggttttcatgtgtaagttactaatgtggtgttttcatttttagatttgcttttccattgaaccatccttgcattcctgatgtacattttatgatgcattaagaaatacctgctatattttcttccagactttaacatctgtgttcattgtcaggtagttctcatattttaattttttatacagtccttatcaaattagtataaagaacattttagcttctttcagagaattgggtaatttttttccattttctgaaatagtctgtacagatcataaaaccctgtgagcctggatatcattttcaaggcagacttcaaattgacaattgaatttctctgatggttatttatttgttctggttttatgttttctcttgagtagtttttgtaatttatatgtttcttgaaaattatccattttatccaagttttgaaatttattatattacattcatattattctgatttaagattttattgtatttgtattttttgaattcttaatattgtgtatatgtatattttattttggcatatctgacttacaggttgccattttactagtttgtcagtaaaaaaactagcttttgcttttacatatattttattacatcttgttttatatttcatcaatttttgcttttctcttattctgttttttcatggtattttattttatttatttgtgaaaatgtgttgagaatatattatagaccaggcactgtttagagatttggcatacacttagtacaaaatttcagtagttattggaaacttaatgactcttttgtaatttttttcatttttcattttcatggatacatcacagttgtatatatttacggggtacatgtgatattttgttacaagcatacaatgtgtaatgatcaaatctgggtaattgggatatccatcacctcaaacatttgtcatttatttgtgttgggaacatttcaaatcttctcttttacctattttgaaatatataacaaattactgttaactatatttgtcctattacagaatacctgatcttattccttctatctaactttatttttgtatttattagccgagccctcttcattcctccccactacccttcccagcctctggtaaccaccattctattcactgtctccatgagatacacctttttagctcccacatatgagtgagaacgtgaagtatttttctgtgcttgacttacttcactaacataatgtcctccagttatatctgtattgcttcaagtgacaagatttcagtcctttttatgactgaataatattctattaaacacacacacacgtaaacatatatacatatacacacacacacacacacacacactccacattttctttatccatcaatccattgatggatactatatcttgactattgtgaatagtgctgtaaaaaacatgggaatgcagatatatctttgacagatgcattttctttcttttggatgtatatccagcaatagaattgctggatcatatggtgttacagttctatttttagtttttgaaaattcatattgttttccataatggctatactaatttacattaccaccaacagtatactagcattgccttttctccacattccatccgcatttgttattttctgtcttttggatataagccattttaatttggttgatacgatatcatattgtgggtttgatttgcatttccctgatgattagtgatgttgagtattttttcatatacctgttggccaattttatgtatccttttgagaaattcagatctttggccaggcatggtggctcatgcctgtaatcccagcactttgggaggctgaggcgggtggatcacgaggtcaggagatcgagaccatcctggctaacgcggtgaaaccccgtctctactaaaaatacaaaaaattagccaggcgtggtggtgggtgcctgtagtcccagctactcaggaggctgaggcaggagaatggcatgaacccgggaggcggaagttgcagtgagcactccggcctgggcgacaaagcgagactccgtctcaaaaaaaagaaaaaaagaaattcagatcttttgcccatttaaaaattggatgattattatttgctattgagttgtttgagttccttatatattcaggttgttaacgtcagatgaatagttgacaaatatttcctcccattctgtatgttttctctttactttcttgattgtttcctttccactgcagaagctttttagcttgatgttatctgatttgtcaatttttgctttggttgcctgagtttttgaggtcttactcaagaaatctttgcccagaccagtgtcctgaagcatttgccctgttgttttcttctagtagtttcatactttcgggtcataggtttaagtctttaattcattttgattttatttttgcatatgatgagagataggggtctagtttcattcttctgcatatggatattcagttttcctagcatcatttgtggaaaagactgtcctttccccattgtatgtttttgtacctttgtgtaaagtgagtaggctataaagtgtggatttatttcagggctctctattttgttccattggtctgtgtctatttttatgccagtaccatgccgcttggttgctatagctttgcaatatattttgaagtcaagtagtgtgatgcctctagatttatactttttggtcaggattgctttggctattctgttttctattgtggttgcatacaaattttaggatttcctatttctgtgaagaatgtcattggtattttgatagggattgcattgaatccgtaaatcactttgggtaagatggatatttttacaatattaattattgcaatttatgaacataggatatctttccaatattttatgtcttttatgtcctcttcaattttttttttttttttttttgagaccgagtctcactccgtcgcccaggctggagtgcagtggcgcgatctcggctcactgcaagctccgcctcccgggttcacgccattctcctgcctcagcctcctgagtagctgggactacaggtgcccgccgccatgcccggctaatatttgtattttttttttttagtagagacggggtttcaccgtgttggccaggatggtctcgatctcctgacctcatgatccacctacctcagcctcccaaagtgcttggattacaggcatcctcttcagttttttaaaatcagtgtttcatagtttttattgcacagatcttttgctttttggttaagtttattcctaggtattttttggtagctattataaatagctttcttgatttcttttttgagattgtttgctgttggcatctagaaatgctactaatttttgtatgtggattttgtatactacaactttactgaatctgtttatcaactctaacatttttttggcagagtctttaggatttttttaaagagtctttaggttttcctaaatacatgattatattgtctgcaaacaaggacaatttgacttattcctttccaatttagatgtcctttatttattttcctcgtcttattgctctggctatgacatccagcactatgttgaataaaagtggtgaaagtgggcatccttctttttccagatctcatcttttgcaattttatcagcaaatggtaaaggtaacatagaacatggttctttgacttataaatattaagattttacttaggttgttgataattactatatttttgttccatggtctttattgaatatatactactaaaaacttggcatagagccattaaaaaaatacaaaatgttttcttggaaacagcaaaatttctaatccatatacacatttcaaggttaatattttatacttgtgactactagatcatttatgctaaatagtacagcttaaagataccataatgataaccttttagattaaccaacatctttgatctaggatcaaggaaatttgatttccctcaatcccttatttttcagattaagcagttaaagtaatcagtcatttttgtgacacagcagggtccaggttacaatagttctccccattttttatggttctagacccttctcctacctatcttcccccaaccccctggtttggtaactatttctctgaacagtctttctgtttctttggtacatttttttccatgtataattgatttattctggtcatttacaattcctattaaattctctaaatgcttttccttgcccaaatttattattcatctcttcacttgaaagtagaattttctttcatagtgaaattaaaagcaatatattaaagtgggaagtatgaggtaaaatattagaacaactaaactcaagggcatttggcatttctgagagtgaagcagcttacataccacagcaatgtcacttgtttttcattgatgagacacacaaaattgtttcctttgtcctatgcctttcccttgaattcacatatctttttgctgaaatgaatcctttcatagttcttttaatgagtgcctgtgggtgttaaacagtcttaatgttttatattttgtaatatcattattttaacattgcatgatggtttctctgggagtagaattttatattggcagttatttttcctcatcactttaaaaggcattgcttcaggttcttctaccatttgttgttcatgatcagaaatctgtgtgtatgatagtaacttcttcacaggtcaaactgtattttgtctctgctaaattttaagactgatattttgcagtttgactaaaatgtgtctaggtgtaggacttatttgtatttatgtttctgaatactcatagggtactttcaactgaggattctcatttttttctgattctggaaaactcttggatattaatgttcaaataccgttcttcattaaaaaaaaatctctaaacataagttctaaattttaagtaagcctttgaagctagaggctctcaaaccatctgccctgattcttaaatgctcctttacaagttttgattactttttctctttttgctggcttctgggtaaattttttggtatcaaaatctaattcactaaaacacttaccagctgcctcaaatctaaagtttatcctatcttttgaatttttccttttaaaacaccattttttttcaaatcttatttatattcacctattcttatctcctttctgcctgattttgtgtcataatttgtttgatttttatacatgtgatttcatctatcttcctgagtattttaaacatgcttgttttgaagtctttgtcaagctattttataaaattaatttcaccacagtaaactcatattctggatattgatatattggctgtcttcttcagtgttatatttcttcacatgttttgggattttgattcacaggctaattttgagtgaattttttgtttgtgttcttctgtctcttgctctctgttcatgtatgtccgttctctctctctcacccactttctctctctgtatgagcttctttttgtggctggtatttttcagttgatgtccaccggggtccccaggacaaaaccacattttaggtgatggtttggagctcctgccctatagtaaaataatgcagagccagtctccaggccaggagcagcttgtttcagatctttgtctagacagaggctgtgttgacgtcttttaaatctgtaggtttttaggttttaacttcatataaaccaggttttctcagtagggcactgttgacattttggaccggatgattctttgttgtgtagagctgtcctttgcattgtagaatgtttagaaacatccccagcctctactcactaaatgcaactagtgccaacttccctccagttatgaccaccaaaaatgtctccagacattggccaaatgtcctctggggaagaaagtcactgactcccccttgataaccggtggtaaaacctgtaaaccctggagtcaattggcaatgtctgatgttagcttcctttatcaaggaaagggtgccaaatccagtccagctttaagcctaaagcctggcttcagcctttcatagtaagtagaggacttttcgtctcccattggaaagagatttctctgtctcactgcctgatttggggctcagcacccatcaggctttggcttcaaccacactcactattactggtcctgaggatgtatatcttaatttatattctggcattgtcttttcagtattcttttgttatatttcacttatcacaattgcatgtttcgagcaatggggacaccatatagcatgaacttaaaattctttcttaaccagaagtcatagaaggaagtttttcaaaaaaagtttgtttttttaattgcacttcttggtagttcaacattttagatgccttattaccttatgccctgacttgattatgcttttgcttcttctttatttgtgattaacaaaagcctccataaacctgctttatttgtagtcaaattctatatttggagtattgatcagactaataaaaattagatatttttgaatgatttctacagatatctctatgactttgtgtatgacctcattggaattgagcacaggcattgcatttgggaaattaagacaattaggagattgtcctacaaagtcagagcaaaggaagcctgtagttagttataatacagagggacagtgaagactgtgagggagaggagggcagcaggaggcttagaccttgctggaaaatcctcaggaatgaagtgaaatgtagccaatttggaacctaccccagccctttccctccatgttaaagttagttaaatcaattccagtgcctatttatagttaagccttggttttgattaatgatgttggagagagataggaaagcggggaggacaactgttaggaggaagggaggaggcaaagctgctgaggctgatatgctcatctgttgtttgaaccctactctttgtcacacacagatttctggccaaatatgataaaaaaatatttttgttagagggcagtaatccatgtcaacattttcactgtatgccaagtgaagaaatcaaatacctaaaccctgaattaaccatatgataaatcatggttccctttttcattgagtcatccagcatgcatcatcatggacacaacctaagacttaaatgtctttagaagttatgcttttatacattaacaaaaatgaaattattaaaacaaacccacattaatggttaagcatagattgcttttgagctgcaaagagctttagagacacacaactggtccaacatttaatattgtctggagaaaaccaagatttgagagtcctaaggacttgcttaaagctgcacaatatcttggttgcagaacagggactagatcccttgtcttccctccaatccaaagatctggttacttctgcccaaaagataatcaattttaattttggtagctagccataaatacttttctggttgacttattctctgcttttaatgttggaaatagatgaaagtttatagttctcataaattagcttcagttactaaggagattagtgtattattaatccctcctattttttcaaaaaaacttttactaaaacccactttccttgaaaactgatattttctaaagatttagctctccagctatgcactcaaacagaggattgtgaatggggattgtctgcattaaaaaaaaaatcctttctttcttgttaatcatgaatttaaatattatagaaaggtagagggacatacagtgactatgctcctccttccacttaggtggctatgtaaaatgtcttttccttgatatatgtaattgttgtttactcacagtaattttatgtcagaatctcaacagcatgggttgggtaatgactatccatttgtttatctacaggaaaatggtattgtgtatgaagcaagttcattatataggacaattgaatttttatttcataactttatcttctttttctctttagtgatttctctttgtggccccatgcatattgtgcagattaattaatcatgcatgagctcggtacaatctacaatgattcactgggtaaagcagttttagggaatgcattgtattataaatgtggaaatgggatagacacctagaatatatcagctatcagtgaatgtccttaatcatagtcatatagatttctacttactaaaatgaagtcatatattttggtagaatccttcattttgaaggaaagctgacatgcaacgtaatttatctgtgtatgtgtataaagctgtattaatttcctgttgctgctgttacaaattactgcaaacttagtggcttggaacagcacaaatttgttatcttacagttctggagatcagatgtctaaaatggatttcactgggctaaagctaaggtgtttgcagtacttcgtttattctggagggtctagggaagaagttgttccactgtctattccagcttctattacagaagctgcctgcattccttagtttgtggccccttcctccattttcaaagccagcagtataacttcttctattttctctctgacaatgcttctgttatcacatttccttcttgctctcctgcctccctctttcccttataaatactcttgtgattattgtgaaaccctaaggagtaaaaagaaaattagaaaatgggcttacctggcaggaacagaaatagataaggggagcaaatgttttgagaaatggggtcaaccacaaaaggctcactggcacccatagcatcctgttacgagcattcagctcatggcccacctgcattcaagcattctgtctgcaagcattcagctcaagcagcacgaccttataaaactccccttccagcccctgactctgcagatagcagacagccttctttctgctgtcttgcaatgtatctccccttctcctctaaataaatctgcctttctaaactcattactatcttggtaaattcctttaccaccagtgcactggcttcagataatcatcaaccatgacaattatattgagcctacctagataatccaggattatccctcatttcaaggtccttaacttaatcacatcttcagagttgcttttgccatgtaaagtaacacaatcaaaggtttagtggaaatctttggcagggggttattttgcctatcacaaatgcgtatgaaattgggagactattttgaaatagcctgtactcatgctactttgcatgatgaatatgacacatactatttaaactatgtattttctatagcagcaatctctatagcaccaatggtcatagaaatataatgtaagctacaaatgcaagccacatctggaaattcaaatgttctagtagacatatttaaaacataggtgaaattcatgttaattatatattttatttaattcagtagatccaaaatattatatcaacatgcagtcaatataaaaatatcaatgagctattgatattctttgttttatactgtcttcaaaacccagaatgtattttacacctacagcatatctccatatggattagacacatttcatgtgctcaatagctgcatgtggttcatggctctaactttggaaagcacaactctgtagccaaggtttttatagctccacacccatttaagagttatattgtctactcaaaagaatgtgatatgatggctaagacattgaataagacccgggtttctcaacactggcagtattgacattctagaccaggtagtttttggttgtgggaagctgtcctttgtattgtgggatgtttagcaatatctctggcctctaccactagattccaggagcaaccctccagttgtgacaaccaaaaaagtctccaaatattgccaaatgtcccctgggtggcaaaattgtgcctagctgagaactactaggctaaacatagaaagtgtgttagtctgttttgtgttgctatgaaggaatgcttgaggcttggtagtttattaagaaaagaggttggctgggcggagttgctcacacctgtaatcctagcactttgcgaggctgaggtaggcagatcacttgaggtcagcagtttgaaactagcctggccaacatggtgaaaacccgtctgtactaaaaatacaaaaaaattagctgggcatggtggtgggcacctgtaatcccagctacttgggaggctgaggcagaagaattgcttgaactgggaggtagaggttgcagtgagctgagatcacaccattgcactccagcatgggcaacagaacaagactccatctcaagaaaaaaagaaaaagaaaaaagaggtttatttggctcatggttctgcaggctgtacaagaagcatggcactggcatctgcttggttactggcaagggcttttgtgctgtgccaaaacattttggagagggtcaaaggaggaatcagtcacttgggaagggggaccaaacccagggtatactagttataacaatccattcttgccagaaataatccattcccttgagaactaatctgctgtcactagagtgagaacagcaccaagccattcatgaggaacctgcccccatgtcccaggcacctctctctacgcttctcctccaacactgctacactgtgggccaaatttcaacatgagatttggcagggataaagaaactatatccaagccatagcagaagggttgggtttgaattctgttctccatacattactgtgaccttgaaagaggagccactttaaattgttaacatagtttcatcctctttacaatgggaaaagtattatctaggctgcttgagcctcaaaagagacagtgtagataaaacagctctgtaaactgtagatactctgtaagacaaactcagcattgtctttatttgtttatgttcagcacttgaatgtaagtacagctatttcagtactgatgtattttctcataatatttaacttattttttaatgccctatttataatgattggactacagtgtagacaagatgttttaggtgttttgttttcctgtctgtgggtgctcatgggagtacagaaataagtagaactgggtcttttcaatgagttgatcaaatttgaaataactgggagttgttctgtggccttctcagctctgatagggtacacctgcctaaggaacttgcagagatattctgcaaattactttgtttgacccaacaattattgaacacccattcctgttaggaatagtgctagttcctgggagtagaaaaaagaatgagacaagattctatccctcagagtgcttgcaagagtagtaggagaaaaggcatagacattaatggaaagtatttggatggaagtggtgcttggaaaagagtcaggagaatgcaaagagaaggttgcaaaatgacgtttacaggaaggtcagagaaaggcctgagaaaggtgcagaatgaaaaagtgcatggactggtttgacattttgggaaatggagcatagcatgaaggaaagagagagaaaaggagaacataggagtatagtctccctaagaaaggtgggtccccttttgcaaaggccaattcttgggagaaggagtaagctaggagttcttagcaactgggaatgggtccaccagcagtaagggtctgtggcagcaccacagcatccactataggctctaatgtgtctccaccttttttttttcattattgccccctcaaggaagctttttaaaacattttttctctaatctccccagcctccacccatgaaatttacatagcacagatatcctatttatctgtttgtgttgtgtatttctgtgctttatacataaaaataatacgttttcttcgcctctcccagtaatcgatttttacccccttggtggcgatattgcctagttgagaatacatgtgctacgtttgtcactcatgagctgtgttattggctttggttcccttgactcaaaaatgttttaacagtcattctgtgtttcagggtgatatggtttagctctgtgtctacactgaaatctcatgttgaattgttaatccccagtgttagaggaggggcctggtggaaagcgattggatcatgggggcagatttcccccttgctgttctcatgacagtgagtgagttctcatgagatctggttgtttgaaagtgtgtagcagttccccccttggttctctctctcctgctctagccatgtagaacgtgcctcttcctcttcaccttcctccatgaatggtaagtttcctgaggcctcctcagccatgcttcctgtacaggctgtggaactgtgagctaattaaacctcttttctctgtaaattacccagtctcaggtagttctttatagcaacctgagaacggactaatacacaggggctacactgaaacaatccctttctcaacacttgggggagaaggctggagtaagagtttctgagaggtataggggtgtgatcctgcttgtgtgccacatgtctgcccagcaggtccttgaggatagagttggggtggaagtggctaggtgggccgtggaaaaggtcctatttactgaatttgccatatagagaagtgggtggtgcccgcacagggaccatttgtgccagtggtctgggagccctggatgtggtgccatgatggtctgcagaccaaaacccttcctggttcctgccaagggttcttggcctcatctggagttattgggaaaaggcccagctaaaagtaaagtacaaccttgttttctgttttgctgtttttctttgtacatgtaactcttccaggaacctgtgggcaggggacagagggtgaatacagtcaggatttagcccaaagctatcaaacagcaccaaccattgactcttcctaagagtgtgagtccattttctcttttccaaagaatggcagcctggtcacaaactacattgccagaagaatgatgggattgatactcaaaagatttatagttgaattatagacagggaatgccaaggaagaaacgctgtgagaaaactccacatttgtcctttatcatttactgttaaaaagctctgtcagagcttcccagaaccttctatattagatagggctctggtcgctagtaatctaagctgattgaactagctaaaggacactctgtgaaagtgtgtgggaatgtctgtgggtctcaaaagtagagatggagccagatctcagaaaaggctgaaacctaaagttagaattatatatgcatcattccagaatctctcattgctttgtatttgctttattcatctttctctgttcactgtccttctcagattctcaatttccatggtggccaaaaggtagcctatcctcagaggttatatcaaatgagccctgttcctcacagagccgctaacagttcttcagctttgcagtctcaattcccagatgcaagagtgtgattgaccctccttgggtcaggttaacgcttaagtttggtcacacataatggaacaaatatggctgctatgggccaacctttggaatagggatagagcgagtagattagtagatggaaggtcccagagaaaataatatcatattgttggcttctgaagctatctgctacaggcagtgatcactgatttttccagccagaataaaccattcaatttcaataaattatgggcattttagataatggaaaccttagtgtttaaacaatgttctttccttattctaagtttacagctagtaggcttagttggttggtacataaacaaggagtgataacttaagagtgagaatgtagaaggactagctggatcataatgccacttactgaaagaacactgaagaacactgaaagaacactggagttgtatcactagggatgctgagttattatagacctctcctctatgagaagtgttatttcttcccatcttagttcaggctgccatataagaaatgtctttgactgggtggcttataaacaatagaaatgtatttattatggttctggaggctggaagtgcaagatcagggtgtcagcatgtttgggatctggtgacggtctacttcctggttcacagatggacaactgtcttcttgctgtgccctcacgtggcagaaggggcagatgaactatctagggccttccaaaggctccacctcaaaataccaccacatcggggactgggttttaacatgtgaatttgaggggtacacaaacattccgtttatagtatctcccatcccaggtaacagctgtttagatcagaagtggatacctgacccaaatgacaacctggtttttctcttctgaaatttagaattgagattggaagaccttagtcagtttggacatctacagtgtgccagaagctagcagttgggtgtacagtatttaacaagagagaagttgctgctcacttaaaacatgcatttcagctttatgttcagctatgtgcaggcaaacagacacgtggaattatgatgattttcacttcctcctgaagccagctgtacatgtggcccttccaggtctgtgagattgagatcacattatcagtgatcacactaggaagattaagctaatttgaggtgaatttttattacttaaaaccaagaatgtgtgtgtatctttgtttatgaaatgtttttgataatttatttgattggttgattagtctccatctttttaaaaagaggttaaattctttgagggcttttttttttttgtacttttctgtccccagggtgtgccacccactatgcttggcatattatagtcactcagttgtcactgcatgttgtctggtgcccctgagcactcagtgatatggagtgagagaaagaatggttataacttgggggaactccaagaaaacttgatggagtgagtagccttgaaggatgaaaaacttttaagtggaaatgcaagggcaaggagtgagacaggctattgtaaagaggggatttactgcttgttggtttgaattgaaaaaaattcattgtgcgcttcctttggaaggttttttaagattttttttctcagctgcagagtgaatattaggcagggacatataaattattagatcttcactagatcccaactagtgattcattccttggaaagataagctttagcaactacatcttttgtcctaatggaaataatcctatttgttcctcatcatgcactaagtcaaggggaaagaatgctggataactttttctcattgttgtgttcagaaatgtagttacactccattttagcaagcacattatgccctagcttcttgccgtttttcttaagagtgtgtttcattccctacaaggtcttctattctcttgtaaagtgtcttttattatgggttcttagtaattgttcccttcattagttagaaaagttatgttttagagccctagctgtagaactctttcctctttatgctaagatggattatatgaaaacaatctgattaaaactaatgcatatttagaattaaaacacaaaaagttgcacacaaatgtttatagtagcaatacccataatagtcaaataatagaaacaactcaagtgtctgttgacttgtgaatggattaataaaatatggtacatccataaaatggaatataatatggcagtaaaaatgaagtactggtatatgctacaacatagatgaactttgaaaacattatacgaagtgaaagaagccaaacacaaaagaccacatattctatggtcccatttatatgaaatgcctaggacaggcaaatccataaagacagaaagtaggttagtagttgtcagggcctggggagaggttggaggaggggatggggcatgaatgctaatggacatagatgggatttctttgtgtggcgatgaaatattctaaaattaagtgtgatgatggtggcacaaccctgtgaaaatactaaaaacctctgaattttatcatatgtatcatatgtgaattatatcatatgtaaattacaccttcataaatctgtttacaaaataagacatttctgtgtgtgtatgtatgtatgtttctttgtgtatatatttacatatgtttatgatgtttcagatgttggcaagtgcagcaagcatcattaccatgggcacttcctccatatgaccgctggaggaatttagagtgcatataacaatccagggctctgccattggctgtgtgaatttggatgggtcatttcatctttctcagcctcagtttctcacctgaaaaatggggataagaaaccacctttgcacagtccctataagaattaaatgaaatggtgtatgtgagatgaggtgactcactcattaggcagagcaggcacagtgcctggggctcacagtacttcaagggcccatgaaaatgttttaatttcttttaaatgcagaagaaagaaagatgtccttttaggtccaataaaaagttttaatgtataatactaatgtatttgtctttacaccaatctggtcatacagcatattttgtatttttttttttttttttactggaggaagaggcccatgaaacaaaggtaactcaggcccatggaaggcatcatggacacttgaacgtggcagctcaatgacacaggctgggtttatcttattgctctgcaaattcaacagaaacctcctctaaaatcataccaacaatttagcaacagtgtaagcagtctgtgttgagcagctcacctgcacacgcctggaggcatacacctagaggagaggaggaacactgggttggccagcctgggttactggcaggttcttccatttagtagtgcccagcctcctctttcttctagggcatctttgccaccattgctcccatttgttgagtccctgttatgaaccagacacttcatatttcttatctctgatcctcacaatctcctgtaaaggtgagtagtgtcctgaatgtagcagatgctgttgatgccctttccacttttcttctgcctgatattccctgcagctttacagtgtgcagtttttggtatgctgataggttgccactgcaaggtcctgccattgtcttctttgccatagctgcctctcctgcttctcttccttcttaaactctgcctgagggcttcctctggcatcccaggagcttgctttattgtttatagcggcaacctgaaaatgtcaagcggggttaatgcctcagagaatagccctcaagtaatagtggacagaagtaagtagaaaaatgccatagctccctcctgtctagtgagtgattctgaggtgtgttccttctggtttctcagagagtgctttacaagattgagccccacctgtccatagcaggaacctattcatctatgtactttttgacttttttttcttcttctcacatttcacttcctcccttggacctcttgagatcacttcctatgtaaactccctgcatccccatacttctccagggtcttcttttggtggaacccaaatttaagataatgagtttgtaaatgtaaaaactaaggctagggagaagttggggaacttgtcccaggaccactgcccctaaccaatggagccaggtttgcaacctacatctatctagtcgcggggcattctgtctttcagccattgcagtaagtactattacaagccaggagttgcttttttagttatgacggaatctgccattcctggtgccccataggtggttagccatgccttaggtgggtgtattagtccgtttttacactgctgataaagacatacccaagactgggaagaaaaataggtttaattagacttacatttccacatggctggggaggcctcagaatcatggtgggaagtgaaaggcacttcctacatggcagcagcaagagcaaatgaggaagatgcaaaagcggaaccccctgataaaaccatcagatcttgtgagacttactaccatgagaacagtatgggggaaaccgcccccatgattcaaattatctcccacggggtccctcccacaacacgtgggaattacgggagtacaattcaagatgagatttgggtgggggcacagagccaaaccatatcagtgggcagagaccatacagctgaaaggacacagagtcatgatgtctcatagccagacttgtccagcttcaaagtctgggtttcttctccaaaagcctcatgcttcatggtggttatgatggtagtgatgatggtggcgatgatgataatattgatgatggtggtgacagatttttcggttgtcagagtttactaggcacctattttgagcctgaaaatgtgcaatgtaccataaccatgtcctcagatttaataatccaattttgcagaaaaaattatttttatattttgaacactaaaatgtaccagaaccatcattttctcattgatactattattccattacttaaatttatttgtacttgaaggaaaagtatcatttcagtcactgtgctcatataatcctgccatgtttgccgggttaccttagggttacttactctagagttgtagctgtgaattatcactttgtaaaactgaaatatatttatgcaatggtagtaagtgggagagtaatgaaaaccaggctttatctatttttgtccagtaaggacaaaacattcttaaataataatctgctgtatccacaagatataattgcatacagattgcagacttaattcttaaatcagcgtttttgaagaatatacccaaagaaaaaccaattatgattatttccccttatttttcattgaagcctgtagtatcagatgtgctgttaggcttttgcactggttcgctcaaagctttgttgaaagaagccagaagattacaaattatttgttgccccagctttttggctacaatcaaacataaatttaaagtagactgtaaggtcactgtcacaagctatacttttatacatggcataacttaacagtaaccaagccaacaataagaagttgattacattccttcacggctattttaaaaatacatacttacaaaagaagatggagattttaaaccctgaacataacctcagattctcagttactttgtctataattctgttagcttcatgaatttttcctctgagtaactccaacatcatctaacccatctctgaacactaaataatggtggaaataccttctcagtttgctttctattagggaaagaagtatggaatcaactattgtgctgtaatcaccaccagggatctgtccttttatatccattcatttctggatctggccttttcggggtacttcagaaacaaaatcctgcctctagagaagctccatcatttgtacattgtcactgttcaacatctctttggacctctgttgatatcattgcttgagatgacagactatgataagagaaacaaggttctctataaggcagcattgactgcaggaagaggtgagaattgtaagttgtcaaaatgcaaagggcaaaaaagtagtctgccaggaatatgttcatacagattattatatacacttactgtctgtaacagctaagcattcaaagattacaatgaagatgtttccaatatttttaatgggaactatgaattagttcatgagttggcaactgtaagaacaaaatcctacttaatcaaattaatactgactgaggcagaaggatttgagcatcttgttatgagaaattggaagaatgaaagaaataagaaaccgacttgagagaatgaagtattgaatgaagtggttttgtaacgtgggatttgtaatcactacattttgagcaacatttatgttttgtgaagtggtcttcctaatgtatttaagcttttaaattacccctcatatataggtttcattcaaaagtgaaagtggtacctaaattaaacaatgtctaaactttctattgggttcagatgaagttttaagattttaaagagtaaaactgagcctcaagagacccaaaagtaatttaagaaatggtatcctcacactaataagatgctcccactgtgctttcccctatgtgttccctggactgtgtctaagggagatcctggccattgatttcattttcactttaactaatgatgtgaccctatcaggatctattcattcactctcacaggcctcattgatcctgtttgccacaaggactgctaagacccttggatctgcatggacaaaccttgccttcagggagatcatgaagcatgtacacactatcaataagtggaaactgcaacaagagcacattcttggggttctcagaaacagataacatagcaaagagtttaataaaaatgcgagacaacccttggagaaccattacaaggagttccactaagtgtagcagctctatcctggcaaatctttattaattccctcagttcatttgtataacttgggtaaagctaagccacttcctatccagtccaagtgggtgtcacattcaaaccaacacaaattcaataaactaaatctttgttgctatcttctttatggtgaaattaaattgcacaacacacagaaaatcatcctgaaaatcttcaacagtctgaactcccaaatcctattcatcacagcgaactgcctttgcataatttctttccttcctgttctcctcttccctcccttctcttccttttccattccccacctagcttcctctctcacagcactccatgccccacaacttactttctggatctattcttttctccccgggatggggttgctcttggctctcatatagctcatactctcttctctgggctttttttcagttcacctttctacccattaccgagatcatacaaattaaggccagaccctatactctcaataaaaaaagactccatcttttttgggggctgatgtgaggctgtgaatattcaattgttgttattaggattttcctctgtcacatcagtttcatggagtatttctgggagaaatagtcttatatttctcagccctcctgggacatccagattagaggaaaagctcttgaaattcaaaattacaatgagatgtttaaaagaaagtgtcgggcacccaaatgcctgcctacttgccttcctcacatggcaatagaatctgaacagtgtactcattatttgggggactatccagagagctcttgtacaagtaacacagactagttagctgccacgcccactgccactccccctgttcttcttctcctgccccatctccaaagccacttggcgaagcttcacccaaacaccttccctatagcagaataccagtgtctctatcaccaggcactccaaaattcccagtcctctgtgtgccagcttgctgctgggttccatgtagaagtgaggaagagtggacagctccccatctcttagtcaggcttcgtcatttttacctgaagcttaggtactgagtctcccatggaaatccaagagccttaaccagagaactcaaacccaaacttagggaccaaatggagaacattgcgtccattctccccctccctcctcctgtcccttgtgcacaatcaccaactcttatctcctccctctgttacttagcatggcttcccaaacagatcagtagataccaactgtagtggatgctgtgaggcttcatccaggcctctcttcagggacagctcattcaatcctagcttctgggaatggtttgtactgaaggcttacagctgtcccctgaccagaattatccttggccccagggaactggctgtccaaagattacacttcctctgaaagggcaatccattaccattgactggctgatttagggatatgaaggtcaagcctccttgcctctgaagggccaccacagctccagagctccttgttgagtcagctgaggcctccattgcaattgtattgcaagtcaactcttctttctgcctgatccttccttgctcacttcctcataggtttatctctttagaggattttctaataaaccttctacatgcaactacctggtttagtctttttctagagaacctaatctaagaccccacaaatacttttatttggagaggatggggacttgggagaggccccagataggctaggtttgagcccagttacacaataaatagcagctatttatgcatgaggtatgtagatttcatggggacactgggaatttctagatgtctgtagaactcagcctccaaattcactcatgaaacttgagccactttgtgactcaaacttgagccactatgtggcagtttcccactgttgataaactcagtgactaaatcacttatatctaccatctacacaaaactattcatcagaatgtgtttggggcccttgatctgggccctttttgggttataatgatgggattcttgtacagtgtgatagcttggttgtgtttttaatgcttcattctctctaaggcagtatgattttccagtgcactagagtgggttgagtatatttttgcaccaataattggtgttgggggccatatgacttgctttagccaatggaatgctagtagctatgatgcaagtggaggttttgcatatgcttacatggttaggcttgtcctctggtctcccgatgttgctgtgattagagcatgctccaggtacttactactctttcatcctgggcttcacgaaacagatgagcctgagccaaaccaaactgactgcagtctaaagcagagacactgaatgggattggatgatacttgttactgctggacacagagctgtaactcaacaatttgggttagcatttttgatagtttcacacataaaatattgtgaatttttcatttccattttgatgtattatactcttttatcttgttaaatcagagatgttatgcatacagaccataaaagtgcacctttaagaaattttgttctttatgtgtaaacctaggtcttctctacacacaatcctgttttcttctctaagtataaattgcattatttttcttgataaattgtattctaacatataatctcatccctctttcctcactatatggataatgcaaaagcttcctgttagtaaatcacaaataatgtttaatatcagagtcacagaaaccacagaccctttgatgtctcaaatctgatgtatttcaagcatccccctctacacatgcatatacacaaatgagatctgtaaacactgcacatacacacccacccatgcatttgtaagtcaaagcagcaatcgactgagggtaaaacactttctagagcattattttgtaccttgttttgtgtgaaaaagcaaaacagttttcacattgaagctctgttaatttaaaaaaaaattataaaattaggactgaaatgctcacacctatagatcttcttcatcagggtagcatttgctacttcccaggatataaattatactctcagtggattaagtggcctgaaaaccgatttaggaatttcacaatttttgctcagggcttaaatgcttcttgagagccactaccggtgagatggaatgagcaaccttagtgctactttccagggcagaaattccactctgcttttcagagcgaaggtcatgttcatggccctttctggagcacatagcctcaatcaatgccatgctgacgaaaatgtgtatcacaatctccgtgacttaagaataaagtcaggtgggccagtttagtggttttcagtctttagggatttttaaatgtcctatcactcagacacatccggtgttctgggcaaagcatgagtccataagcactcaagtgagttgagctcacctcctcagtggggatcttaatgctaatgcttgcatgtaagtgccctgatttccagtatcctccagtgtcaattggggataatggtaattgaccacacagaggtttagtaaagagctccagcgtgggtctggcagataagcacacccagaggttgtggacagttggtagtgccacattaccacccctttcctcaactggacaatacccactgtgtgagttgggatgggaagcatatccctacctcctcttgcaagaggttgagagggaaaataatccctctcccatgcccaggtgggcagagcaaggggctcatgacatagacctaaccaatcagttatttcttcctgaacttgtagcctggaggtaagtggcagggtagtgtggccactgggccccatgatagtagcactgcacaggcacagagaaagtgtcaggtatcccggagagacacttttgttatgtagcctcccttgattcctgtgcattttccaagcctgaattttgagaaaatgctaatattcttccaatatattgcaatatacccctctgctttttaagttagatttagatttctgttgcttgcaaccaagaatcctagcagatacccagacaaatgtttcatttgataaactttaaagcatttcactgatgggaggtattgctttttttattaagatatgtcatgatattaggaacaaattatatatatatttatgaagcatcaaaataagacttaaaaagtatcagttacattttactatctagtggtagagaatatttgtgctgtccacagttatgatataaatatccctagttcttttttcatccttaatcaactcttgtactcactccatttttgctaagcaaccccctctcacctccatacacacagcactactatgactagcaaaactgcactgtaggttctttcaagctttgtcttactttttttgtacttactcgccatttgttcttagcttcttttaagtgttttctttgctgtggttgtccttcagatgttggagttgctcagagttctgttctcaatgttcctgctctccctgggcatcttctcagctgccatggttactgccaacatggttgtgctgtaagcttcaagaaggaaaggacttcttacttcatattcaccactgcatgtctctagagattgacacattggccggcacatagtagacatttaaaaaaatctctgttgaatcagttttatcttatattggatgctatgaaatatttgtcttcagcacggactgcttctgggttccttaccagtaatatccatagcatgcttttatttggataccccataggcctcaaactaaacatgttaaaaactaactcgtgatgctcactgaggcataaataaatggtctgtccctctgtgtccctggtaccatgaatggtgcagccatctggtgtctggaggcagacatctgagaatctccctctttctgtgattctttaccctcccaccattcaccacatcctcttgattccatcccctctctccagctctacttcctctccctgccaccaggcatgcaccaccactgctcttttggatcagttcaccagcctgccacctactaggcctcccttcataatggctcccttcccatacactgctgctgtccctctcccacacccctcccctaagccccactagctcctacaatcctttaggacttatcccgatcagtcacctggaactgcttgctggtaccctctttcctggtttgtgcttctctgtgcttaacattcaccattcctgtatggtctgactgttgacttccatctaccagccaatgccaatctctggacatgcctctgtggatgctgcagtctttctagcctctgcacagtacaggatggaagtgccaagcagtcacatctgccaggatcaaccctcagcacatgtccagtgtgcttccttagttttactaggaaatctctgagacatgttccacccaggctcgcaaaggtccccagcagaactgaacctcagtggcccacaatgggaagctgtgctacgggctttcttcccttgccaatctcacttcacactcccctactggtgtttcctgggaacatcagcaaaataaactccatacactcatatgcttgcccactgggctcaatcctgccagaacactttgggcgatagtatagaacacctctcagagttatcccaactggggaccagggaggttgatgtatttgcccaccaacacttcatttgtcattggtaagggcttcttccaaggacattaactttctggtatttccacttagccctgcacaggaggtcttgctccttcagccagaagaaaagccctcaggcagagatttacaggtgttcccggcaggcaggcttcagcaaacaaggtggaggtcgagggtgaggcatcaataatatctgttccacaagtttaaattttataaaagactttgttattctgctgcaacgctgagattttccctatttgtttctgggcttggagcttatgaaatagaatgcgagagtgtttcttcccccatgttcaacgctgaaagcatctggtccttgacagtctggttaatctggtgtgttaccatccagatatactctgggattcttacatagtcaaaattacaactgtccttctgcatactgatactgttttcctttggcttaccttggattcccaggaattcatgtatgggcagcatgctgtgcctgtattctggtcaaatggcttttgagagtagtgcatggtatcttggctatcactgcagagccacccacctatgagagtttccagaaaaaagagcttccctagaacatagggtattatgtcactgaaagcccagacttattacaaattgccatctctgttccatttactctctgcattctttattttgcacaagtagaaacattcgttttgaaaccacacatttcattgttctgctgtgtttcctttttgtgtatgttcttaaggtgtgcaactttataatttgatatacatatacattgtgaagtaatcactacagtcaagtttatgatcatatccgcacctcacatagttaccggtttgtgtgtgtatggtaagaacacttaggatctatccccttagcaaatttcaagtatacactattgttacctgtagttaccatgctacccaccagagccccagaatttactgatctggcataactgaaacttgtacttcttgagcaacatctctccatttccctgttcccccagcccctgaaaactaccattcttctctcggcttctgtgagttcgactattttagattccacatataagtgatattatgtagtgtttgtcttatttcatttaccataatgtccaaaaacacatggagattcttcagaaatttgaaaatagatttttgagtattgttaccataaaaaattataagtgtttaaagtgatggctataaaactaacccaattcgatcattatattatgtatacatgcactaaaacatcacattgtgccccataaatgtctacaattattatggagcaattataaatttaaaaaataaaaaatagaactatcatataacccagagattccacttctaggtatttacccaaaggaattaaaatcaggatctcagagagatacctgcactcccatgttccttgcagtattattcacaatagccaagacatggaaacaaccttaattcccacagatggatgaagagatcaagaagatgaggtacacagacacacggtttattactcagtctgaaaataaatagctttatttatttatttatttatgtatttggagacagggtctcactctgttgcccaggctggagtgcagtatcatgatcacaacttactgtaaccttaaccccccaggctcaagcaattctcccatctaagcctcccaagtatctggaaacacatgcatgccccactatgctgggccactttaaaaatgtttttgtagagatggggtcttaccatgttgcccagactggtctcaaactcctgtgttcaagcaaccctcccacctcagcctcccagagtgctgggattacaggcgcgagccaccatgcctggccatggctgtgtttcttaaatggaaattatgtatttagaatataaaaatgtggtacatatacatcgtggaatactgtgcagccataaaaagtatgaagtcacgtcctttgcagcaacatggatggagctggaggccataattctaagtgaattaacataggaacagaaaactaaacactgcgtgttttcacttagaagttggagctaaatattgagcacatatggacataaacatgggaagaatagacactgtggactactagaatggggaggaaaggagggggtatggattgaaaaactacctattgggtactttgctcactgccagggcacaatatacccacatagcaagcctgcataggtaccaccatatctaaaataaaagttgaaatttaaaaagaaagaataataaaagtatgtatatgttttaaagaaagtggcactgtaagctggtattctttgtaggtttttgtcaacttaagggtcagtgtataaagcagctgaattcatcatcttcccatccccactcatcctcttccagagtttccatccctgtgaagggcaccaggtccactgattgctgaagccaggtacttgaatgtcagtttctgcccttctgtcctcccatgtgcccaccctacatccaatcagttatcaagtgatatgtcttccattttctaaacatctctccagttttcctctctccagtgtcccatgtgagatcacaccaagacctgtggcagtcttaggactggactctctgcctccaatttgacccatcagcaatgcactctctccttttgttatttgagtgattttttgaaaataaacatctaacatctacttccctgcaaaaatgttttgatggctccgcattgctcttagaatcaagtctaaactctgaattcacttctctactttttcatccttagccccaactctctatcctctcctcaattttttcacaaacaaaacacacttttagcttcttgaatatgtctcatggcccctcacttgtaagtccttactcacgctcttctctctgcctggaacattattgcttagtcttgattgcttgtgtttctcaagagccaagttcaagccctgacctgctgtcagtttctgattaaaaatgttgattttggctttgctttttatattaacagtgataaactctgtaattccttacggcttacagaatgatatttgcttctcccatggggattcaaagtaatttttaatgcaacatatttgacaaggaaaaaagggcagattcaatactctactatcactaccaatgaaaaaaggtggtagaacagatactaatcagctatattaaattggccataaacttcactcctactgagatatttctcagtggtcacagataagatggagacttagttaacacggatttttctagctgtgccatatttttttaaagctattaacatttttggctttgaacttttctttttctctttaggttgccaggaattggcagaccatttttgtctaattataacagtacttggaccttatgataaattcacagaaaatcactattttggaaatggatgcttaaaaatgcagcaacaaaaatgcatgcaattgaaattaatcacaaatatttctgagtaaatgttatgcttaaagccctgtattaagcctgtgaaaaacacagataagctcataatttaaatcaaagggtatagggtgaccaactatcccagtttgcctgggactgagtgggggaaggagtcctgagaaattgaattttcagtgagaaaaaacagaaggtcccaagaaaactggtacgagttgatcaccctagctacatatcaaaataatagcatgaattgttttatgaaaagtgccacacattagttttaacaaaaaataattacatgcttgggtcaggtggggaaagaagagatatcaagacactcacaagccaggaaaatggctatgatcaaagacaatgtgctttgaaacctttgagtatcaaagataagtatgagtcatgagaccagagaatttagaagaggccaaatttgaacaccttccaaattccaagcctgggggccagaccttattctctaaggacttgggtgctaattttggagaatttggggcaagttggaccaaaaattattataaaagcaatttttatggaggagtagtctaagttcttttttatttttaatatactttaagttctggggtacatgtgcagaacgtgcagttttgttacataggtatacacgttccatggtggtttgctgcacccatcaacccgtcacctacattaggtatttctcctaatgttatccctcccctactcccccaacccactgacaggtcttggtgtgtgatgttcccctccctatgtccatgtgttctcattgttcaactcccacttatgagtgacaacatgcgatgtttggttttctgttcttgtggtagtttgctgagagtgatggtttccactttatccacgtccctgcaaaggacatgaactcatcgtttttttatgactgcatagtattccatggtgtatatgtgccacattttctttatccagtctattattgatggacatttgggttggttccaagtctttgctattgtgaatagtgccacaataagcatatatgtgcatgtgtctttatagtagaatggtttataatcctttgggtacataccctgtaatgggattgctcggtgaaatggtgtttctagttctagatccttgaggaatcgtcacaccgtcttccacaatggttgaactaatttacattcccaccaacagtgtaaaagtgtccctatttctccacatcctttccagcatctgttgtttcctggcttttcaatgatcgccattctaactggtgtgagatggtatctcattgtgtttttgatttgcatttctctaatgaccagcgatgatgagcattttttcatatgtctgttggctgcataaatgtcttcttttgagaagagtctgttcatatcctttgcccactttttgatggttttttttccccttgtaaaattgtttaagttctttgtagatcctggatattagccctttgtcagatggatagactgcaaaaattttctcccattctgtaggttgcctgttgattctgatgatattttcttttgctgtgcagaagctcttcagtttaattagatcccatttgtcaattttggcttttgttgccattgcttttggtgttttagacatgaagtctttgctcatgcctatgtcctgaatggtattgcccaggttttcttctaggatttttatggtcctagatcttacgtttaagtatttgatccatcttgagttggtttttgtataaggtgtaaggaaggggtccagtttcagttttctgcatatggctagccagttttcccaataccatttattaaacagggaatcttttctttttgatccttcttttttttttttttttctcttgagacagagtctcaccctgtcacccaggctggagtgcaatggcacaatcttggctcactgccacctctgcctcctgggttcaagcgattctcctgtctcagcctcccgagttgctgggattataggcgtacgccaccatacccggctaattttttgtacctttggtagagatggggttttaccatgttggccaggctggtctcaaactcctgacctcgtgatctgcccgccttggcctcccaaagtgttgggattacaggtgtgagccactgcgcccgactgatcattcatttttaagagaatgaagaaatctccagaaagttgtgtttactaagaagactgcatcatctcaggctttgttttttattttgtaaacaagagcaagtgttcagaaccttcttaaacaactagcaacatgacaagcaatattgaaaactacaggtgtgccttattttatataaaactgctttgtgaaatacagatctttatgtatgaagcaattagaacagcatccccaacctttttggtaccgggaattggtttcgtggaagacagttttttcataggtggtgggtggtggggtggtttcaggatgaaactgttccacctcaaatcatcaggcattagattctcataaggagtatgcaccttaaatcccttgaatgtgcagttcacaagagtccatggtcctacgagaatctaatgccactgatctgatagaaggcagagttcaggtggtaatgttcactcacgcaacgctcacctcctgctgtgaggcctggttcctaacaggccacataccagtactggtctgtgatgggggagctgatgacccctgaattagaaggttatttattgcatgagaaaggcatttttcttttctaaattaaatagcattttaaaatagtgttaaatatatttaaaatagcatttattatataatgtaagcattgatttacttagctgtgacttctctgctgaactgagacctgtagggtcaatagtggagtgatgaaaaattggaggaattgtattccaggtaagggaaatacatacaaaggccttgaggcaaagggagcatggaaaattttagaaagtaaaggaagctctgggtgactagagcatagagagtagggtggggctgagagaaataaagctgaagggggaatgggcctgggatatcatgaagggcatgtcaaattaattaaggacttccaacttcctcactgtttacagggggctttgaagggttttaagcagggaaccgtatgtcaaggccagggccaacttcatcagcatgtgatgaatgcccattgtttagagaggcccaatgtttgatttaatgctgtttccaccattttggaattttaaattttttgaccaagtggctctgcatttttattttgtgctggaccctgccagttacctagctgatcctggccaaggctctaggtcattgtgtgtagtgaattaatacctactgagaggaccatgtttttctgctcactgctttttttcctttaaatagactttattttttagagcagttttcagttcacagcaaaaattgagatgaaagtgcagagttcccatacatcccctgtccacccactgcaacagcttctcccattatcaagaggtttgcaccaaagtgatacctttgttacaactggtaaacctacactgacatatctttatcacccaaagtctatagttaacgttagggttcactcttggtgttgtacattctgtgaatttggaaaaatgtataacacgtgtccaccattatagtatcatacagaatagtttcattaccctaaaaatcctctatactccacctactcatcctccctaaagtctggtaaccaatgatcttttactgtcactatggtttggtcttttccagaatgttgtataactggaatcatatggcatgtagtctacttggataggcttcttttcaccgctttttcccctgctagtatcagataattgtgcaggccactctacgagagccaaaggtcgtatttctccttctcctggaataatcacaagaacaggaggttctgcaggagcaattgactttagaggattaggggacaaataaacactgaagttttattcttcaggatttttgtatttctagaatagttcaaagtatgtacagagttgacagatcttttcaactgactggtcattcgttgcaaattccaaagaaataaactgtttaggaaacaactaactgatgagttacattcaataccctttctttgattccagacactaaagttattttgcatgcccaaattttgtactcagagacattacttctggggtctgtctagaagtaaaggcacaaatatgctgtaatagaatgctgccaggtagtgagggtcatcttctggccagaaatttcaccagaggctcttcaaaccttgcttttcccaaatgcagcccctaccaccaacaggttcctctgagctaacaaacaactccttgtcttctgtgacattttggattttaattctcatttcttcgaagaaaagggcaagcacatcttctcttttgggcttttctacaaattgtatatactgtctcagaagtagtgtccaacctttattattatgtacatgtggattttatcactagtatatactaaatatattactagatataaccactaataactataatactatataatgatataataccatatttttgtatatattatataccagcaatatacttttttcctattttgtcttctcctgcctatataataaaaacatgcttgttgaagatgctgccagagcttcatctgtattctcatgcctccttgtaccatttattgtgcacatcagttcctgggtactttcactcccaatagccaagtacttgtatctctttcttgaaggatcaaccttaggctgtggcacacaaagaaccacaacaagtttctgtgaatttactattccaggcaggggtggaggtaggggtgtcagccaatggctgattggtgttgtgtgttgtatgtttgtatgggtggtattataaatactccagcttcctgagcagatgactttgagtgggacccacactgtgtcatcaacttccccttcccccatcttcctcctctgcaggatggagccatagttaaccctctcaggctctttgtctgatgtcacatgtttgcttgccattcttacctacttagtctccctttctcatgctcctattttttcctgggactacttcttacaaatcactttcacacagttcttcatctcaggactacttttggggaacctactgtaagaatttgttgaggtagaaaagttgcagatcattgtgaagtgtaaaaaaagaacaggaaatgaatcatactatttccctacccccaagaaacctgttgtcagtctttttctatgaatttttagaagctttattgaggtatactttgcatatcatttaatttattctttcaagtatacatttcaatgatatatgtagtaaatttactaatcagtcattttcatcatcccaagaagacccatcatgtccatttaaatgacattaatcttcattttcctccaccctagcccctggcaaccgccaatatactttctgcctctatggatttgcccattatggtcaatttgtataaatggtatcataaaatatgtgatcttttgtatgtgccttaatttagcacccgtgttgtagtatgtatcagttcttcatttctttttatggctagcatttcattgtatggattgagcactttttatccattcattccttgatgtacatttgggttgtttctactttttggaatattaataattattgattaataatagaggctttaaattaataattatataattaaataattatttaattaaataattaaaattaataaaagttttaaaacatattttaaatttaaggctgttgttaaaaagtaatcctgtattctattgtttgtctgtaattctattgtcagtatctgtatgtgggataacaatatacatttgactgctacgctggaatttatttatttatatatttattttatttatttttatttttttttgagacgagtcttgctctgtcacccaggctggagtgcagtggtgcgatctcggctcactgcaacctctgccttccaggttcaagtgattctcctgcctcagcctccggagtagctgggactacaggcgcccgccaccacgcccggctaatttttgtatttttagtagagacggggtttcaccatcttggctaggattacaggcgtgagccactgagcctggccccctgaatcttttaaatcaaatgattcaacttaacttatcttttcttttcttttctttctttctttctttctttctttctttctttctttctttctttccttcttttcttttcttttcttttcttttcttttcttttcttttcttttcttttcttttcttttcttttcttttcttttcttttcttttcttttcgagatggagtctcactctgtcacccaggctggagtgcattggtgctcactgcaacctccacctgctgggttcaagcgattctcatgcctcagtcttccaagtggctgggactacaggcgtgcaccaccacgcctggctaatttttgtgtttttagtagaaatggggtttcaccatgttggccaggctggtcttgactactaacctcaagtgactcagccacctcggccttccaaagtgctgggattacaggcgtgagctactgcactcagctgattccattttctttaagttatttgtattcattcattttttttttgtttaataattcaacaatttttaaaagtattatgccaggcattgtgtttgatactggaaatacatggttatatttttgaaaccaaatttcaaggcatgatttgacaactgcatatgtattattggagatgataaaacagagctttggaaatcaagattggtgagaaataatttagataaaaaagggagatacaaagaattataatatagtaattaacctctgggacactctacctttgtagagttatgatctaaatctttctcaaatctgagtagatttttaaaaatctccatatacacgccattgctgtgtatttttaagatatcagattccgattcaggaccataagaaatctcagaacacagagagccagtataagttgtgttttcccttattctccctctcttcaccctgcccttctcataatcacttctgtctcaagttctctgtgtcttcatctatagggctggtacttaaaggcatgcctcattagtcttaactgtttctttcccatcaaaggctgtataattaccttgtaaattccaatgggagcatgagtgagtttgtctcatcgctgagcttcagggttctcataagctagcgataaagtaacagttcacacagatgaagggggactggggaagtgtgggtagaagtttttgcaatgaggtaaattttcttctgcaaggctcgtaatgagacatcaccacatgagtgggctggtctggattttgtcactctcctgtatcagcctttcccctccaaaccagcctatcaggctccctattagataattttgtttggactcagcatttcagcagatagtaactaaacaccttttttccttcactcagaaaagtaccctgtttttatagaaaacaagaagagcttgccgaaatccttctcagaggcaagctctccaagtaagtatattttctcaggctttttatagtttaatctacttacaaacttccataagcatagtatgtgtctttccatgcagtcttctgcttgatatccatgtatgagaaactgcaaaaaaaaggttatatttgatttataaaagttcttcattatttaaaagtgtactagaacaagccagtataaattccagtgcaggctggtgcggtggctcgtgcctgtaatcctagcactttgggaggccgaggcgggaggattacttgaggtcaggagttagagaccagcctggccaagatggtgaaaccccgtctccactaaaaatacaaaaattagccgggcgtggtggcatgcgcctgtagtaccagctactcaggaagctgaggcaggagaaccacttgaacccagaaggcagaggttgcagtgagccaagactgcactactgcactccagcccgggtgacagagcaagactcgtctcaaaaaaaaaaaaaaaattccaatgcagcagtcaaatgtatattgttatcccacatacagatactgacaatagaattacagacaaacaatagaatacaggattactttttaacaacaccgtttttgaagatataatccacatagcacaaaattcacccttttaaagcatgcaattcaggggatttgagtatattcacgaggttgtccaactatcatcattatctaattttagaatattttcatcatctcaaaaggaaatcctgtgtcctttagcagccacccctcattccgttctcctcctcagccctaagaaaccaaaaatctactttttgtctctatggattgatctgttctggacattttatagaagtgcagtcatacaatatgtggtcttttgtgactgacttctttcatttaaaatggtgttttcaagattcattcacgttgtagcatgtatcagtacttaatttccttttgttgctgaataatttattgtatggatagatcacattttgtttattcatttttcaggtgatggatagttgggttgtttctaccttttggatagtgtgaataatgctgctatgaacatttatgtataagtttttgggtaggcagatgttttcagttatcttgggtatatacctaggaatggaattgctgtgtcatgcagtaatattatgtttctaagctttggaggaattggcaaaccattttgcaaagctgccacaccctcctaaactgacagcaatcatggagggtgattatctacatttgtagaccagaaagtggtggtccagagagcttaaaaaagttgcctaagtcaataagataaacctgtattacttttcaaaatgttgcatcagccctgaaatgaagccctctcagattcctttaagaatgtctaatgacagagatggaagccaggagattgggacctgagtaatggatgtgtctgcctcaaattctgaacatctcaagggcagttccataaatggcaaacacatctgtaaaaagcatatttctctttttaacagcagaaaattttaattcttattaaaataaacacatatcactgtgttcatggagaacgcagaggggttaaatatatagaaaagatcatgccactgaaaccatcatactctaagaatttattctgtcataagattaactcttctccctttgctttctttatgtgaaggtgaagaatcctatggcccatagatttttacagtgttctccatcttgcagcacattaaggagttaattcctttcaggaaatccatttctgctgaaaggctcacttttccagcccctgaacagcatatgtgacctgcagtggttattcttagcaaacttcttcccagggatgacccaatgggagcagcacagctcaatcttttcgtgaagagagaaaacatctcagattcttttcctgttttaaattattgggaaccaatggctcagaactataccagttacccttataactaactgcattaccatcttccatccttctataccagtctcgctagtcttccttgctggctgtagttcttggaactctttaaccaatcttgacttagggtcttctttcagattgctctctatgcctgtgatgatctcccaaattcttatctagaaagaatcttttccttccttggcatgcaatgtattcctcatatgtattaccaaacacattgctttaaaaattatatagatacctcaaaataataacagccacctatgacaaacacacagccaacttcatactaaatgggcaaaagttgaaagcattcctcttgaaaaccagcacaagacaaggacgccctctctcaccactcctattcaacatagtattgcaagtcctggccagagcaatcaggcaagagaaagaaataaaggggatccaaacagagagagaggaagtccaactatccctgtttgtagacagcatgatcctatatctagaaaaccccatagtcccagcctcaaagctccttaatatgataaacaatgtcagcaaagtctcaagatacaaaatcaacgtataaaaatcactagcattcctatacaccaacaaccgtcaagtcaagagccaaatcagtaacgaactcccattcacaattgccacaaaaagattaaaattacctagaaatacaactaactaaggaggtgaaagatctctgcaaggagaactataaaccagtgatccaagaaatcagagatgatacaaacaaatgtaaaaacattctatgctcatggatatgaagaatcaatatcgtgaaaatggccatattacccaagcaatttatagagtcagtgctattcctatcaaactaccaatggcattcttcacagaccagaaaaaaactgttttaacattcatatggagctgaaaaaaagcctgaatagccaagaaaatcctaagcaaaaagaacaaaactggaggcatcacattacccaacttcaaactatactatggggctacagtaaccaaaacagcatggtactggtacaaaaacagacacacagaccaatgggacagaatagagagccaagaaataagactgcacacctacaatcatctgatctttgacaaacctgacaaaaacaagcaatggggaaaggactccctattcaataaatggtgctaggataactggctagccatatgcagagattgaaactgtacctcttcctatcaccatatacaaaaatcaactcaagatgaatgaaagacccaaatgtaaaacttaaaactataaaagtcctggaagacaacctaggcaataccattctggaaataggaatgggcaaatatttcatgacaaagacaccaaaagcaatcacaacaaaagcaaaaattgacaaactaatgagcttctgcacagcaaaagaaactatcaacagagtaaacagacaacctacagaatgagtgacatggtttggatctgtgaccctgcccaaatctcatgttgaattttaatccccaatgttggaggtggtgcctggtgggaggtgattggatcatgggggcggtttctcatggtttaccacgacctcccttggagctgtcatcataatagtgagttctcacacaatctggttgtataaaagtgtgtagtaccttattcccacttcctgttgctctggacatataggctctgacaatataggcagaaggcttcacccttcgccttctgccatgattataggttccctgaggcctcctcagctatgcttcctgtacagcctgtggaaatgtgagccaactaagcctgttttctttataaactacccagtctcaggtatttctttatagaaatgtgagaatggactaatacaatgggagaaaatatttgcaaactatgcatttgacaaaggtctaatatccaacatctataaggaacttaaatttccaagaaaaaacaaaacaccattaaaaagtgggcaaaggacatgaacagaaacctttcaaaagaacacatacatgtggccaacaagcatatgaagaaaaagctcaacatcactgatctttagagaaatgcaaatcaaaaccacaattagatactatctcacaccagtcagaatggctattactaaaaagtcaaaaaataacaagcactgtcgaggttgtggagaaaaagaaacacttatacactgctggtgagaatgtacattagttcaactactgcagaaaacatggcacttcctcaaagacataaaaacagaactaccatttgatgtagcaatcccagtactggctatatacccaaaggaatacagattgttttattataaagacacacacacacatatgttcattgcagcactattcacaatagcaaagatgtggagtcaacctaaatgaccataaatgatagactggataaagaaaatgtggtacatatacactatggaatactatgtggccataaaagagagggagattatgtcctttgcaggaacgtggatggagctggaggccattatccttagcaaactaatgcaagagcagaaaaccaaatactgtatgttctcagttacaagtggaagctaaatgatgagaacacatggacacatagaggggaacaacaggcactgaggcctttctgagggtggagggtggagggtggggcttgtacaacaagcctccatgacactgatttccctatataatgaacttgcacatgtaaccttaacttaaaagttaaagaataaaatatttgttgagtttcatgttacacatctgtagttattatagtcataacactttagagctgcacagactcaaatgatcagcactgccagacgttctgacagcaaaattatctgaatagataagagacttaggtgggcttttgctcagtaaatgaggttgtttatattctttgaaacagtacggcaattcataatactccaacacacgactgcctgtgggcagaccctcctgttcaaggtactgtgtggggtatcacagaatgctgttcaggaagatatcactggggccttctactctcaaaggggttgataaacacttgagagcatgaggatgaatacccaagggattaggtatgctttgggctctgaagctggccacatcagtaaaatatcacatacttggcaaattagatctgagtaatcaaacagaataattcagcatctctcccccatagacttttagtggctgacattagttttcatttgatgataattactgatcacagtaatcctcacaactaacagtttttcacttctgtaactttcttatatagatctggcacatttcttagtagtttacagatttacttttcgtttgtttcttggttgtgtttgcttatctgggcgaaatatatttttcctatatgttctcaatttggttatttatgacttataggaaatcgattaacttgtaagtttgtcttgtatctagtgacattattgctttcatattagttccagtaaactttaaattgacaagttggatttgtagacagaaagtcatttatttgtttataataacactttggcatagtccttttccgtatttaaggctttaaagaaatcttttcttatatgttgctgaagacttctggtacaatgtcaattttaggcatctttgccttgctcctgagtttaatgagaccactttttaacttaagcaagataaatcagtttctttccatcttgacttattggtagttatatttttctttcaagctggaaagcctgtgaaattttgtaaaatatatcttagcattacttgagatgatcatgtttttttttcctccatctttaatataaatacatagagaattctgttaatagttttcctaaagttgaacctccttgaattcctgggataaagcctggttgatcatgatttattgttgtggagttttctatttgcttagctttgtaataattctccattaaaaaacacttattggctaagtgaaccaaaatatctaatgaaccatgaagttgtttgaaattatagcaaggaatataaatagactagttggctatgctgttccctttttaaaaataatttcattccatgctgacatgagcaataggatttgatcgtaacagagagatgacttcttggctgtgtaggccatatgtttcctgataaaatatctagtgtctaatatcgaatagcccttgtggcttattttgtgtgtttaaacaatctggtccagttctgctaagtgacaacaagcatcacctactgtcaaaactcttttctgagcctgcagaaattactacaactgtgggatgtacttgatttcaatgtgctgtattaatgtttgcccagtaatttctagttacagaggctatagcttgttcttccaccaaccatcctggagagcagttagtaaggtgtagcagttgagagtgtgaactatctggtttcacttcacagctctgccattaactggctgtgaaaaccttaaattcctcagttttattattttaaaaatgggactatttaaggtaactttgagctattgtgaatatttagtgactaaatataaagcacttaaaatgtatttggtgcatagtgttacatatgtgctagctatgatttattttttgtttcaatgtaattttttcctttttttaaatttaaaacttttatagctctattgaggtataattcacaaataaatattgcatatgtgtatatattgtatacaatgtgatgttttgacacatgtatacactctgaaatgattattacaatcaaactaattatcatgtctattacctcacagttatatttaatattaatatttaagattattctcttagcaattttcaagtatacaatacattattaactacaagctatgactttgaataatcaagttagaatgatcaatttgccaggagtttttgttacagatgtcagagtcctatgatcacacatgaaagatttgctttttttccttatatgtgacccatggaaacatatcccttgtagaatttgactagtcctttactcattcaaggaatttctgaaaataggcagatttgtttgactaatgtttttccaataaaaaagggctggctgtttttctcacaatattttacattttgaaaaattcaaagaaatgaaattgaagctgattatcagaatctgtcggggaaatcattaaacattggccagccctagtaaatagcaatggaagggtaatttacacctctcattgctctataggaggttcttctgttgcccctgtgttgaccggttcacagttagcaaaagtatcttgtagggggactccaaagacagagagattgtgtgcagcttctgctctcagactccctgggtcaaatctgagctttgccactggtcatcagcaagttgaccttgggtgtgtttctagtgctccagtttcctcatttgtaaaaatgtgataataataataattacctctcagggctgtggggagaattacaagagaaaacccctgtgtatgaccaacataggaccctgcacatacgaagtgctcaataagtaatgtgtcatttagtacaaagcatttgttatttggaagtttttttttgttgttctaaggtgtaagtcatcatatctccggctaggcagtatgccatacatgaaagtttgggagagtggggttcatttattttaaaaacagttcagtgtttttagtatagtcacagatatgtgcacccatcaccacaatcaattttagaacattttgatgaccccccaaaggaacctcatacccaataactctcatttcccccttcccccgtccatctagctggctgtaagcaaccactcatctactttctgtctctatagatttgcctattccggacatttcacacaaattaaattgtactatgtttagtcttttgtgactggcttctttcatgtagcttaatttttcaaggtttatccatgttgtaacaagtaccggtacttcatttctttgcatggcagaataatcttccagggtatggatagaccacactttgtttatccatttattcattgatggacatttgagttgtttctacctttcggctatagggaataatgctgcagtgaacattcatgtacacatttttgtatggatgtatgtttttatttttcttaagtatgtatctaaaagtggaattgttaggttatattccatttgaggaactgtcagactgttttccaaagctgctgcaccattttacatccccaccagcagtgtatgtttgaaggttccaatttctccacactttcaccaatacttcttattatgtttttgtttatagccatcctagtaggtatgaagtgatatttcattgtgattttaatttgcatgtccctgacaactagtgatgtagaccatctttttgtgtgtttactggccatttgtacatcttctttgggaaaatatctattcaaatctgttgcccatttttaattgggttgtattttcaattattaagttgtaacactggtaatttttattgagctattaatcgctgttcacacttgaccttgcacacaaatccctggggactttgttaaaaagcagtctctgcttcacttaggtcccttggggaacctaagagtgtacattttccagtagttgcagatggcgtagtccatggaccctacttgaagtaagaaagacactttttaaaatgcttcatgattggctttttatgtattactcagaaaagccatttgaagagagaaacacaaaacctacattttatttattctttcctatattcacttccacaaatggaagtattagagaaatgtaaaatataatatattctcactgttttaaagagagctaacattatattagtgtctgaaaataaagatatagttagaataatttaactttttttctcgaatacttgtattataatttaaagcatttagaagcagtatttgccaagtgactagatttactttcagtttttaaaatagttttggctacagatgtagctgtaagtttggactttctagtacttatttattatctttttcctttaaaaaacagtttgagacacagtctccttctaatgaaagattattcatcatcctctttggtcatgcttcgttgggaggcacttgcattgatgtaggacaggaagaaaggggagggaccctggctgaaccagccagatttgcagaattagtggccaacacgtgtctcatagatttatgtgcctacagtcttggcagcatcccaatataaaggtatattatttccagggacttaattcccctcacagtgtgaaagagcaatgaaaagcacaagtttggaaaagaaactgcaaatgaaaaaatcaatgtaatgaaatcaattgtgaacactagagtttgttcaaattagttttttgtttgtttgtttgtttagttttggtagctatcatcctcatagatacctcacctaccctataggacgtatgatttcactttcaaggggattttctggcctttaatgagtcatggcagcagttaacactagttgcagtggctggtggtataatttggaggcgcattctgttcttttgtgacattaaaatggaaaatatgagcccagaaaatgatttctctagggatgcacatacatggttacagctcattatggacctgtcaacatcttctcctctgcccttccttgggggagattttgtctcctgacgcagttttgaatgagagtttaacaagtgctgagtctcgtaccttttacagtaaaatatttgcccagatgaagtcatctccttcggaatttgaaatttccctctaaaaatatggctaaacccacaagctataaagaatcataataattcatttagagataactttttggcagctggaaccactagaaattttctggagtatagatttggtaagttaggcaggctaaagggctctgcccccagataagtgacccttagggaattttccatatctgaaggtaagaaggactatgggaaattggtttattgatagagttagttaatcaagatgttatttctggcaacttttaataattaacatttattgtacacacattgataaagttagaaaatatctactctgaaataatgggactataatttttaaaatttaacttaaataataaagttatcatttgtaacattatactacactaatactatagtatcaccatgcagataacactatgaggctgatttgttatattctctttacttcttagctcagaaggcaagtagagatgtttcataatctgtcgttaaaattgttttcttttcctcattgggcccatgatcgtccaaacgtttctctaaagaaagtccccttgaataaaagtggctttttaaaattattattattatacttttagttctagggtacatgtacacaatgtacaggtttgttacatatgtatgcatgtgccatgttggtttgctgcacccattaattcgtcatgtacgttaggtatttctcctaatgctatccctcccccatccccccatccccccaccccacgacaggccccggtgtgtgatgttccccaccctgtgtctaagtattctccttgttcaattctcatctatgagtgaaaacatgcgttgtttggtttactgtccttgcgacagtttgctcagaattagggtttccagcttcatccatgtccctacaaaggacatgaactcgtccttttttatagctgcctagtattccatggtgtatatgtgccacattttcttaatccagtctatcattgatggacatttgggttggttccaagtctttcctattgtgaatagtgctgcaataaacatacgtgtgcaaatgtctttatagtagcatgattcataatcctttgggtatatacccagtaatgggatcactgggttaaatagtatttctagttttagatccttgaggaatcaccacactgtcttccacaatggttgaactggtttacagtcccttcaacagtgtaaaagcgttcctatttctccacatcctctccagcacctattgtttcctgactttttaatgatagccattctaactggtatgagatggtatctcattgtggttttgatttgcatttatctgatgaccagtgatgatgagcatttttcatgtgtctattggctgcataaatgtcttcttttgaaaagtgtctgttcatatcctttgcccaaaaagtggtttttttttaaatcatgaaagcaaaagagatcctccctgtgcagagtggaagtgataacccttcattggtgagataatatcccattatttagatgggggaatcttcacattgttaacacactgaacttagagtatagagggtgggggatgcccattcctggctgcaggggccctgggacctcatctcttctgggtgcagcactgctgcctttacatcttttccactctagacctccattttaagccactgcttaaagagtataaaaatatcttctgtttcctttcttcccctttccttccttttctccttttcttccttcttttttttccttcaaaatttaagtagtacactcatgcatgctggtgagtatgctaggtatgaggatagaagtggtccctcaagacgatgactatgatgtggcccctgagacagtcataggctggggaccagaaaggaggcaatataggtatcggccgaaagatgatgactttcattttgactgtgttgagttttaagaactgggagcatgtgtccagctacttgtacagtgcctaacacatagtagcctgagacactgaatggaagccaccatcagtgctcttctttggtcatgtgaccttgggtaattccccctccccaaccaacaccaccattctgggcctctagttgctcttctgaaaaaagatatcattggattagatgaccctagaagtttcttcctttacaagaagctgttggtaccctctatgtatttcctagacacacacctgatggcaagtacctggtaaaaacacctgcaactctctttctagtagtttctttctggtcatgggaacatactctgccatgacagggcaagtttcagaagtgacagagagttaatgatcctaggagcagccctcaactggtgatggatgaagagtaggtgggtaattctaggttaactctttcagggtaactctgaagcatatccactctgtctcgcagagtctccctgcagggctgagtcccagtttccttcgatgataactgtattgtgaactcatgttttattgacttctttctctttcctatctcattgcctctcactcccctaccaactgtttcctggtgttacctcctgtggtcagcagaataataccctgagagatgttcacatgctaatcctgggacttgtgaatctgttctcttagatggccaaagagactttgcagatgcagattaaattaaggatcttgagatggggagattggcctgggttatttgggtgtgcccattgtaatcacaagggctctcataggtgaaggagggaggcaagggagtcagattcagagaaggaggtgtgatgacagcaacagagttagagagaaattggaagatgatacactgctggctttgaagaaggaggaaggtgccacaagcccagaattgcaagtggcttctagaagctggacaatgacaaaaaaagggggatggggggctcctcctctagagtctccagaaggaatgcaactctgcctcttggtttgagcccagtgagatccattttggacttctgacctccagaactgaaagaaaatatgtatctgttgatttaaaccactaaatttgtagtaatttgttacagcagtgacacaaaattaatacccctcctaaataaaccatttgttcaggaattgttgcttcagcatctgcttctgggagaacccaaattaagacacttcctaatctgatattgtatgcttatttttaccttagttaaaatatcaacatttttcagttgttcaataacaattagttattgtgcccttttatatgcttgatgtttctgtaaggcaagtcacaaagatgcaattaactcagcccttccctgcatagagcttacattctaacagtggaaatagaaaatgccacaaaaattgtagcatgtgtcttgtactattgagcacttttttcttcactagtcagataactgtaagtatttataaggcatctaatgtgaaccttgagcaaagcatcaagtatataaatatatgccatacacaatggtgtataaaataatatagtcactgccaacaaaaaaacacattctcaaatctaatttttaataaagtgacagtatcaccctaaaagaggccaatcttattttgtcagtagaagaaaaggaagaagaacaaggagttctcactgtaaacaatgtagggatcccattttagggaaactgaaacactgatttcaccttctagattcccataaaaagcatggaaagtttattttgttcccaaggaaattcactgttgtttagcttctgaaccatcagcacattaaaaaaacgataatttactgcagcattttagctgtgaaatatacggaaagaaagttgaagtcagattcacaagatatgagttcaaatcctggatctgtcacttcataaaatcatgagctctcaggcaataatttaactgttctgaactgcagctgttaaataacaagtcatgggtggaggtcagcacatgctaatgtcccaagctctttctctgttttatatggttgggcatgtagtagagtaagctttttcaacgctttaggctgaaattctggaatccttgttgctttcatttctgctttcaaagttgccaaattctctcccatctctcccccaccctctttccttttaatcccttgtcagacacaggcaagagtagccaacatatgctaacattttaattctaaaggtgctggctttgaaggcatgtggtcgcccttccaggttatcacaggtaaaagatgtagcaagtttttttgctgccacatgatatgagtcacctgtctttctaacctctggtatctagttcctctttgtctgttacctaaggactaagccagttctaaattcattattaggtcttggttatggcagcacctcactttaaggtgctcaaatatctcaagtagaatagtcctgttgctgcatcaagaagctaattgctggaaaaaacaaactgaacatttttgcgacttaacacaaatttagttttcgtttgcattggaattaggcatttggagggcaggctaccatgtggggattcaaggactcaggcttcttctgtcttgtggcatcctcatgttcaatctgtgtactccatggaatggcctagaaaatggcagatcccatgagcctgacctggaagtgacacacatcactcctgcctttgaccagaactcttatcattccattgaccattatttgatcacatggctccatcctacctacaagggaggtgaggaagtgtgaactctggcttagcacaatcccttagtcatcagtgagccatctctgtcttcttgtgcttacttcaaaatgttgctatgcaggtgaaaactgcaaaattgatctgagagttacttttagagtaaaacatatggtacagatgagagggattgattttttcaaagaaacctcattaccctgagactttgctgaagttgcttatcagcttaaggagattttgggctgagacaatggggttttctagatgtacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccggttttcaaagggcatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggatttggtttgccagtattttattgaggatttttgcatcaatgttcatcaaggatatttgtctaaaattctcttttttggttgtgtctctgcctggctttggtatcaggatgctgctggcctcataaaatgagttagggaggattccctctttttgtattgattggaatagtttcagaaggaatggtaccagttcctccttgtacctctggtagaattcggctgtgaatccatctggtcctggactctttttggttggtaagctgttgattattgccacaatttcagatcctgttattggtctattcagagattcaacttcttcctggtttagtcttgggagggtgtatgtgtcgaggaagaaacagagagccaaatcatgagtgaactcccattcacaattgcttcaaagagaataaaatacctaggaattcaacttacaagggacgtgaaggacctcttcaaggagaaccacaaaccactgctctatgaaataaaagaggatacgaagaaatggaagaacattccatgctcatgggtaggaagaatcaatatcgtgaaaatggccatactgcccaaggtaatttatagattcaatgccatccccatcaagctaccaatgcctttcttcacagaattggaaaaaactactttaaagttcatatggaaccaaaaaagagcccacatcgccaagtcaatcctaagccaaaagaacaaagctggaggcatcacgctacctgacttcaaactatactacaagtctacagtaaccaaaacagcatggtactggtaccaaaacagagatatagatcaatggaacagaacagagccctcagaaataacgccgcatatctacaactatctgatctttgacaaacctgacaaaaacaagcaacggggaaaggattccctatttaataaatggtgctgggaaaactggctagccatatgtagaaggctgaaactggatcccttccttacaccttatacaaaaatgaattcaagatggatgaaagacttaaacgttagacctaaaaccataaaaaccctagaagaaaacctaggtagtaccattcaggacataggtatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatggtagaacattttcgcaacctactcatctgacaaagggctaatattcagaatctacaatgaactcaaacaaatttacaagaaaaaaacaaccccatcaaaaagtgggcaaaggacatgaacagacacttctcaaaagaagacatttatgcagccaacagacacatgaaaaaatgcgtatcatcactggccatcagagaaatgcaaatcaaaaccacaatgagataccatctcacaccagttacaatggcaatcattaaaaagtcaggaaacaacaggtgctggagaggatatggagaaataggaacacttttacactgttggtgggactgtaaactagttcaaccattgtggaagtcagtgtggcgattcctcagggatctagaactagaaataccatttgacccagccttcccattactgggtatatacccaaatgactataaatcatgctgttataaagacacatgcacacgtatgtttattgcggcactgttcacaatagcaaagtcttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcattaaactatcgcaagaacaaaaaaccaaacaccttgtgttctcactcataggtggaaattgaacaatgagaacacatggacacaggaaggggaacatcacactctgatgactgttgtggggtgggaggaggggggagggatagcattaggagatatacctaatgctaaatgacgagttaatgggtacggcacaccagcgtggcacatgtatacatatgtaactaacctgcacattgtgcacatgtaccctaaaacttaaagtataataataataaaataaaaaataaaaaaaagaaacctcattacccattatgatttgattatcctgatagtacaaatagtttagcatctaataggtcaatcagtttaatggacttgagccctattcaacaggtgttaacattgctttttgggaaaatgcctgtttccttgctggctgttgacagcaggtctatctcagctttgagaggctgtgagcatttcttgtctcatggtccctcagtcttgaaagccagcaatggtatgtcagatccttgttatgcttccaatccctttgacttcttcctttataattttttatttttgagacagggtctctgtctcccaggctggagtacagtgatgcaatcacggctcactgcagcctcaacctcaaaggctcaagtgatccgctcacctaagcttccagagtagctgggaccacaggcatgcagcactatactcagctaattattattattattattattattattatttaatatacaaggtctccctaagttgcccaggctgatcttgaactctggggtcaaactgtcctgtgttggcctcccaaaatgctgaggttacaagtttacacctgaaaagccaccatgcccagcctttgacttcttccttttaaaggactaatgtgattagagcaggcccacccagattatctccccatgtaagggtaagtgatttgggaccttagttacattttcaaaatcccttcgtagcagtacctagattagtatttaatttagtaaccatgggatgggaatcttgggaggctatccttagaattctacctactatagttaagtgaattgcctgaattcacatgagtagagagtagtgagtgaagcaaggatttaaaccccagcctatctggcatcagagtctgtgccttttctacctatcaggtgacccctctatgaaaatcagtggtggacattaaccccaaaagaattttctagaaggaaagcccaaccctaattcttaacctagaggaatgtcttagttcatttgtgctgccattacaaaataccacagactgagtaatttatagagaacagaattttatttctcactgttctagaggctgggaagtccaagatcaagaccctagcagtgtcattttctggtgagggctgctgtctacataaaaatgatgctgtctgcatcctccagagaggaaggatgctgtgtcctcacatggcagaagggacagaagggcaaaagggggcctaagctggttacctctggcccttttacaaggcacaaatacacttattagggctgagccctcatgatttaaccatttctccaaaaggcccctacctcccaataccaccacaatagggattaactttcatcataaattttggaggggacaaaaatattcaaaccttagcaagccatataatttaaataattattacatttaaaattgtagatttagtgtttaaaaattatgcaccaaagtaatactgaatctttctgaaatgccaccaccaaagagatagtatgattgtgggctatgtaaacagatctggatcaagtctaagagccaccacttacttgccctgattccccatgcctcagtttctgtaccataagtgggggataataatagtggtatcttctggttgtgctgagagattgaaattataacacttaccatagttcctaggacactgtaagcactcaataatttctaaccacccccactactatcattatcatcatcatcacattattattattattgttatctccaaccttcagcctagatggttgatacctattaaacatattatcaaatatttatactttcatatcaataacatataaaataaattatgttcattcttcagatgagcagaagaggtatcatgccatgatctcatttttaacatgcatttgcttctgaaatctcagctgtagattagtaaatgtaatacttagtaattttttgatctgatgttttctctgcccttcctgtaatttagagtttgtacacttggttctaattctgtcagtgacttaaatagatataaatttaatgtcatagctcatgagaattaatgtcactttcaaagtcatcctctcaacctgcccttctcctttttcctcttgatccaagacccattattctaaggtttctaacacatttcttttcacttatactccagacttgagattgctgtaaacatgaaatttatttttagatctttttgctctgcattctactcagagcctttctctttttgcattttcacaacattcctaggcttctgctcagccaacattttaaatatgacaaaaataaatgccatggagggaagactctgtggcagcaacagaaatgcctgttgagtcctctgtggaatgaagcctgagaccccttgggtggtttaagcagaaatatttgagcgaagaagtgtgaaggacagaggtgtcagaaggaattttcaagagtgtttataaacagtatatgctacagagggtgcagggctactgagacctcaattaggatggggggtgtggttaggagaggccactatggtgcagacatccacccatcccaatttctgtagaagtcagcgatggaaatgcgcagtggtccaataatgttcccattggtggtagagtcagagctttggttttttatcaccttacatggattttacacattattaagacataagctagaggagagaaatttcttattaacaaaacctgaaatcctactagcactgataccttctcccagcacctgcactagccacccatgacatcctctacagattagtgtgcctcctttgctttccatgttaaccttttagcatccataccattccccttatttaaaatagggcttctcaactgagacaccattgacatttggggccagacaattctttgtggtgggggctgtcctgtgcattgtgggatatttagtggcatctctgacttctacccactagatgctagaaacccctccccaagttgctacaaccaaaaatgtctccagacactgccacatgacccctagaagtcacgattgtctgcacttaagaacgactagtgtagaaccccctctttcttctgctctactagtccttccttgttttcctgtataactctgctcaaagctcacctgtacaaaacaattcattaattaatcccacctagctctgagctttttcatcactaagtaccttctgtcctgctgggcctagacatagattttaccaattatgtttttgccatagcctccatttgtaataaatcagtttttgttactccttctgtatgtaaggaaagagtaagtttatgacttcattttaaaaatatctccaaagttcctgctagcatattctgcataaaatggactcagtaacactttgatttagtgagcagaactacttttttttttttttttttgagatagtatctcactttgtcgcccaggctggagtgcagtggcgcaatctcagctcactgcaacctctacccttagcgttcaagagattctcgtgtcttggcctcccgagtagctgggattacaggtgcccgccatcatagccagctaatttttgtatttttagtagagacagggttttgccatgttggccaggctggtttcgaactcctgacctcaagtgatctgcccaccgctgggattataggcgtgagccactgcgtttggccagaactacagttttctattactaccagttgcattgcttgacttttatttatttagcaattttaccattgctgaattgcttcaggattgaagagaatgaatctttagaatctctattgaaataaggaattaaataattgtgatttcttttattctgctgagaacttccaatatactcatttggtgatgaatacattttttaagtgaatattcccaacatacttgggaccactgtagctttcagctatatggcatgtacctgggtatgctgacgccacactattttttgttggagattcagcagttattttgtgtgcagttgacagactttttttttccaggtcctccctgggatctaattttgtaatgctctcagtgttttctcatgtccccttagcatttactctatgcatggaaggctgcgtgtttggaacacctaaaactctgccacctgagggcatttcttctaacagtgggaattgcctgggtgttaatggccatgaaagcaattctcccagcatggtgactcatgccacctataattccagtgttttgggaggctgaggcaggataattgcttgggcccaggagctcgagaccagcgtgggcaacatggctagatcctgtatctacaataaaaacaacaacaataataataatctggatgtggtggtacatgcctgtagccccagctactcaggaggctgagaatggagggtcgcctcagtccaggaattcgaggctgcagtgagtcatgattgcagcactgcactccagactccagcctgggcgacagagcaagaccctgtcaaagaaagaaaagaaaagaaaacaagcagctggttggatggggatttggcaaaaaactgccccagcttcctagtccccctgtgaggacaactctgaggcaaatatatatatatattttttttttttttgagatggagtctccctctgtcacccaggctggagtgcagtggcgccatctcggctcactgcaagctccacctcccaggttcatgccattctcctgcctcagcctcccgagtagctgcgactacaggcgcctgacaccacgcccagctaatattttttgtatttttagtagagacggggtttctgaggcatattctgtactgtctctcagtattacctagtaggattgatcaaattgctcacagaagtaacttgtgtgataacacacctcggttggtttctttcccttctctgtctcaccttccaaataaactacttacactcaaatccttgtttcagactccacttgtaggagaacccaaaccaagaatccatgttataaatatgatgatttaacatgtttagagaaatcttgaactaattcacaaaggcttgttcatgaaatgctgttgatcggtgttgtcaccaaatgttctaaggtctacattctgggtgggccagactgcatcagggactgctgtgcactgatgtgtttgtctgtgatgatgtgggcattgttatttttactgggtttgttgtgagtaaagcttttggaaattatgttttcccacaagttccgcaaatgttttcacattttagaaattgtttgagcatgctgtaagccataactttgaaagtcaagcagtttggctggtgatattatttttaaagaaacaaaagtcttgttttgttttcaattttggcttttgttatgctttgcaatccttttttgctctcatggccttaacttactttgtcttgtacatggttttgcataatactcatggagatatttcatatacatttttgtgtggatatgattgcaataaattttttactggtaatacttcacattctaaagctcttttacatatatttcatttaatgctcacaaaccccctaaacaataggattataatcacagtttaatgatagagaaaaccaagttccagaagagtttaagtgagtttctgttcagcacttttattttgtcatgaattaacataaacattttattcatgtgatcagcaattctacaaagacaacaaagagtgagaatgtaatctccaagggaagcagagtgtgtattagcatagctgtagggcaggggaacttggggatgaatggatacagacctcagcaattgtcctaagtctggtcttctttcaggtttgttaattcaccacattctcatgtaatggaaagagtaaacattctctatatgctagcattattttacaaaatgaacaccagtgaaccagacatgaaagcagcattttcccagtgctttctcaccttccaggaaacctccttcactgttgctgtcagcctctggtggattatcagcaccatgaacactatagtccatattttctgcatcaccaaccaggacaccatgagtaccatgtgttggtttacacacaatctctatcgtacttgcactaaattcgtatctggggtgaagaggaagtgcatcactatctcaaatgtcaacactgaattttgaattttagtggatgctgtttctcccaggagctagaatattgcgtttgatagccagctctgaataggtccctccttgacaattgccatcccttatgttggactcagtctgatttcttgaacctttgcttgttatctgctgttggtacctgaactgcttctatggaggccagttaaccccctttggcccttccaccgacagtgcacctgagttatgactaagccattctgcgctggcaaggattcagttgggaaaacataaaacctttagatatttcaagaagaaagatttattacaggagtgagaggctttctaaagaattgaaaaggacttcaactagcattcaagaaattaggaagataataacagcaggcaggcaccattgatggtctcagatacctactgtacctggaagcatctagcaacacctcccatgggccactggcccaaggctgttcatctgcctgccatcaccatattggactttggcttctcttaggccttgtgaatatatctcatttgtgtgagctcaccctgaactgtatcgcaaggtgtctggaaaatgtaattaccaaacttctagctgctgggatccagagaagaacataaaggaatgaatatagttctgagtagcctactggtagttcaggccatattgtgtttctaggattttctgaaactgatctgtgagcctggggtgcccaaagaagaggatgttgttcctccaaaactgaaggtgctgagaaaaacatttctgatctggggcagggcaatagaatcagggagaaatagcaactggagatgtgatgaccctcaaaattaagattcagtgatagttgttgatgtgaaataggaaaagactagtacctatgcttcacacagagctaccaggaaaattgggcaactccctaaccgtatccttactatacatagtagagtagtactctgagatttccctactttctggtaaaatatgttgtgcactttaatcagctggctgagtgtcttctctactcctgtatgccaaggtcagagtctttggataagttttctccttcagagacaaaccttggaaaaagtctccaggaggcaatgagatttgtccaggaggttatccttgcataggaggtgctccatccagccagtcctgtagggcatgagacctggccaggagtagtagaacaacttttgggattgtttttagtggcatattctacttgtcatgtgattcataacatttgcttccagaagcctgtgcttttggcctagatacaagactgaaaggctgaggcatccatgaaattgacctaatgctgtataaaaatgttactacatgttacaagtcataaagtctggtttattcctcgtagaatgctagcaatcagttttcttttcatcatgatgtgaaatagtctttttatattcataattaggttttgttaagaaattttactgtgttcagatgaattaatattaaatatcaaataatgatatattttttccttcaagaatatattataaaaccagaactctattaaaaaaaaaagttctgttggataagtcaaataaaaagtactatacctaagcacttatgggcccttaatttaagcaaactgaggtactaactttgagtttccttaataccttattaatacttttaatctttttttaaggaaatttgtatggaagttgtaatcaatagtgttctgaaggttttaaaaaattctagttggaaaaatacttcacagagactatacctaatactgaaattttgtttcttttataatgattaacatgcaaagagaaaggcataataagctccagttaattaattggaagttgaattatttaacctgtatatattggaaatcttcctagttgcactgaacactgatttatctattcttgctatctatcattttattgtttttcattggaataaaagcactttttagaccttatgtgaatttttttgttgacaatgataagctaacatgtcaacaaaatgttttataaatgagtagttttagaggctgcctctctttgtgacctttaacacacaatgctttagatctctagactaaaaaaagtgacaagtcaaaactaagaatactcggagacatgttactgaaaataaggcctgcaagaaattattttaagttaaccaacagtaacttatcaaagagtattatgtttcacattgcaggcgaaactaagaataccagcatttgttatggtgaagtttaacttcaaagtgaagtttaacttcactttgattttaagtataaacataagtgtgaatttctgccagttccttctagacttaggttatgatgtgaaattaggaacttgattgtagctgcaatcaagttcttaattgttatgaatgatgaatgtttgcaaagtttccaatctttgcagagatgtgctattctggcttacaggagtatctttctaattagtaggtggatatgtacttatatgcatgtgcacgcatatgagagagaaatacttttctcagttaatgtgcttctgattatatacatcttgtgagatttcatacaattgaaaattagctagaaagaacaataatactgagttttcttcataacacatttccataatgcctgttccattacttttgttatttacatatttgaacttattattattaaattggattatcttatgatttttttaataagtggatattccaactcttggctcacaaaattacagttggtaaataatttcttcaaggaattttaatattgataaattacttatttcaaatgaattcacttaatatcatttttattttcttatgaattttctaataaaaacatatttttcatttcttcctctcttttttcaactcaatgtcttttttaaaaatgacagtaatgtgtggttataattatgcattttttccaggtgctcaatggcccttatgtctcttttaaaaaaacttttatttattgtgggttttctccccaaagcagaagttagtccaatacacatggcatagaaatttcacaattaggcaattaaactagaagtataacagctgacatgtgttcaaagtaataaagttccaaaattagaaggtgaatcaaattaacataaaggcattattaactttttctaggaggcgtgagtttgcaaaagtcttgggtaatttgatttgcttattctcaaaatagccactgaaccttgagtgacattgcgtttcaaaggtgggagccagagggaaggtcactgttagtgttggagtggcaaagaggaggtttaactttcaaatcatctagggtaatgcctgctactctattttgagacttttagctagatggcaagaagtttttttttttttgatgggaatcagaaagttaaataattcctgaatttggaacttcaggtggtttttaaaccttctccttgttttatagtttcctctgttgtttataccttcctaacattcaaatgataaagttattttcatttttaaaagaaacaaatccaaataataatcccattatgtgggattgttgactctaagcattgtgttttcttaatataccaattacatgctaatgggctttttaaaaatctatacaggaacattttaagattgaatgaatgagcatgccatttccattacaagctgctagactgcagtttcacagactactgatgtggatctgagggcagttcctcaaattaatatggtagatccacagttttgaaaggcaattttcattttatataacttctggcatgttcttaaaaagaattacacacacaccttttaagtggttcccccagtgtggctgctattcattttgttgtcatccttggtattcaggtctggcctagtcccttcataatgtattacccctgtcgcttttgctttcttgcccttcctatgagctcctgctctcttttctggtgcttaggtggggcagcacttttcttgttgcatatggatagagtcagccctgcctctggcccctcccaaaggacatgctgtatcacctgccccagcagcttctgtggtaggcccacagtgcttccattttgtgattgttgccactggcctccgtctgaatttgtttcactgccctagccatgtgtggacatccagatgttgcatccttggtgttcatgtggaacaaccaatgcttcctgataccaaggaagccagggctttctgcagcttcccttctttgacatgaaaaacagaggtggatagggaaacttgaaatcactagtccatttttgtccagagctggcagaaaatttgggttggccagatataactttatttcctttggggtcatagccaaacttgattttctttaatacatcaattttcaaaacatgttattttatttttatatacttattaatgttgaatagttcatgtatacatacagataaaaaattcaaatggtcttaaacaatatgtgcttttattaaaggtctcattctcatctctagtcctgagtctaccattttacttacccagagacaagtgatagcaatgtcttgcatacatttccattcttcctgcgttattgtatgcatttataagcatgcacgtttctgaatctatatgtataccacttttgtacaaattatactgcataatttgtatacaatttcttatacttaacataccttggagatagttttatatctctgggtgtacatatgcttcctttgttttagcttttgtttttaagggttttatagtgttccattatatggagattaattataaaatagtgatcccttaatttgtttaacctgtcctctactgatggctatttctgttgcttaggatcctttactttggatcaagggctggcaaacatcttctgtaagggataaatagtgaatattttagactttgcaggccttgtggtctctgttgaaactgcttcactctgtattacaataacagccataaactatacgtagctatgttccaattaaactttgtttataaaaacaggctgcagtccaggtgtggcccctgccctagatgttcagttttgagagactgtcatgcaaaaagtgtttgtgactggcctgcagaaagtgcttaacagatagctgttatttgattgatgggtaatttgtctggaaatttgtcattagaataaggagaatgctaaacagtaaaagatttgaaaaatacatttgtatcaaaaaagaggtatggaaaatagaaaatgcatgactttaggagcatttgactttctggtgtttaaaaaattgtttaagatgacgctttgacttcttttcaaagtgtagtaagcaggaataagaaaattggaggaaggattatctacctctttgtagcactaccaacctttgaaattttgcttcctgctccagtctgactagtaaactcagattcacccacaaaactgggtatggtaacatagctcatggttattaaagccgtttggttttgcatgatgagtgtattttgttgaaaatgtgtgtcaaccttatgatgtccacatacaaatgtcctacataggcttttccctccttctggggttctagagaacacatgaaagtacttctcctttcattaaacactaaacttgatgcttttaaattctttgacgttctgtattagagatgagtaaactaaggcctgcaggccaaattcaacctgctgcttatttttggaaataaggttttattggaacacagtcatatgcatttgtttacacattacctgtggcttccttcatgttacaacagacaacttgggtaactgaaatagagaatatagaactcatgataatgaacatttactgaccctttatggaaaaaaatcttttcaacccgtctttttgattgcactatttttccctcaactttgagaatcgggtgctctcttctctgaagttgtagggaatctattattatttttttagcatggagaacttgcaatcagcatgtttcttagcttttaaagaacaggcatggttgttcggttgatttatcttttcaatatagtgaattcctactttattattattattattattattattattattattttgagaccgagtctcactctgtcgcccaggctggagtgcagtggcgcgatctcggctcactgcaagctccgcctcctgggttcacaccattctcctgcctcagcctcccgagtagctgggattacaggcacccaccaccatgcctggctactttttttgtatttttagtagagatggggtttcaccgtgttagccgggatggtcttgatctcctgacctcgtgatccaccctcctcggcctcccaaagtgctgggattacaggcgtgagccaccgcgcccggccctcctactttatttgttgaacagacagttattaaactgcctcttaaatagttattaaacctgttatgttcaagcctgggaatacaaaggcaaattatattgatttcctgtttgggaaaaaacttgggggccaatgattgacatagataaataaatcagtgattataagggtaacagagatatgaaggaactgttatgggaggaggaaccctccatattatcccggaggacaacaaaggcttgctggtgcagaaaggtgacattttgaaggataacaaggaattggacaaacaaggaagaacacattccaggcaggcagaaggtacactaagcatgtacaaagatgctgagatcttaaacagctttaaacagcttgaggtagtggaagaagcagtgacagtaaaaaaatgggcctcatcatgaaagaccaagtgcatcgatgatgtaagaggtgaaagtggcattgcttctcccttccataccaccacccagccaccagggggccatgacctagagattgctggaacatgaaggactctgatgttctggaggaggtgttgccatctctgatccctttaaaggaaggactaataaagatctgtcgctatagctgaaaaatagctgtggacagggcagacaagtggacaagcagaagcggaacaaaagttcccgataaattcccaaagcagttaactgtagtagagggaatttacgtgacttaactgtagaattctccataaggggagctgcttcatgcaactgcgtaaaatttgtccttttttttttttttttttttttttttttttttttgagatggaatcttgctcttgtcgcccaggctggagtgccttggcatgatctcggctcactgcgaactccgcctcccggattcaagagattctcctgcctcagcctctcaagtatctgagattacaagcgtccaccactactcccagctaatttttgtatttttagtagagacagggtttcaccatgttggccaggctggtctcgaactcctgacctcgtgatccgcccacctcggcctcccaaagtgctgggattacaggcatgagccaccacacctggcaaaatttctcctttttaaactgtacctacagctctttatcttagtgcaactaaagttgataaagtcttcatgatcctttgcagcctagttcaagttaaaaccaagagagaagaaaacaaaagcaaattaagcccattcctttgccaagaagaagtgttacttgatttttatttgcatcctcaatgttccttggaaaataacatgatgtttggcgatgttcaaatgcctgttgacaatcctccgacatcattttctgtttccattgcctcactcagcacaagggctctcataagctttccagtcaacgatgaagcccagatgttatggataagccacagacttttgggggaaactaagcaaacaccaataataaataatgccttgaggacatactacagctcctctctaagtatcgtgatggtcaggcttcatcatttcccaagcagattgcttggattttaattttggcagcaaataacatggagcgtgtgggtttgtaaatggtagctctgtcccaataattccagatgatggggccattccagctttctttaacttagagatttgagcatgcattgtggtaggtctactcaccgtatctgtctagaatgattcagagaggccactcctgggctgagttacttctcatacatatatataattggaggccacattagcctgcagtataactttggaattaagatttgctcaaaaccaaggctgagtttgattaataggttgtaagttagaaacttcctttcttgtgttctgatcccaaattcctactttatattgtggcacctataaaattgtcctagctaaggatgacttgatggtacctaacgtgagactggtttatggatgaagttctttgtgcttacagggttttttcctgataattaacactgggatgaatcgcaagacccatctttgcaaaaggcagtttcttttcttatttttagaggattgttcctgaaatgattttgttcatgttttggctcctgtaatatctctattcatttttttcatggaattttttctttgggtctttttcttcataattttttttttttgcctttcagaaaacacaacacaaaacaaaaaaaaagaaacaaatggttaaaattcaagggattgttgtagctctgagggtaaaacgtgcagcctgttggtgtcatttgttactcatacaaactcttagtattttatttctgttgcagcattggggttgctatctttctcatcatgagtaatctagcattcatgctgcattctattcatagctgtcatactgtctctgacagggtgttttcaaaactttgatctgcttccagaaaagacttttacatgggtgataggatttatggaggaaattttcaactgaataccaggtattaccttcttggaaagagcaaagcatcaaacgtgaatatctcctttttcttcttcctctcctcttcttcctcttcattttaattttatcgaagctcagtttttagtaactttatgtttcctttttattactgtatctttgtactcttcaatagcagtgtccaaggggtagaaatttgattgttgtggtaggggaagaagcaggaaaaactacatatttcaacaaaggtttgtctgactctgagcaagttattggggtacagacatggataagacatagtctctgtccttggaaatttcagaacctagtagggagacagttacataaacagaaaatataacataggaaggaatgaacaggatattctagaaataccaaaggctctgaaagtagggtgatttctacttttaaagaggtaatttaggttctgaaattaaattcctgaaaataagggccaccctagaaccttaccataacaaaattagctacagttagttatgctaatagtaacctctttcctgtctcgaggaactccttttctttattccacaaagagcctcaccttcatggaagatccaaaacaagaaactgtaagtctggttttgactgttggtcttttaaagaaactctgtaatcggcaaagaatgggtccattgcaggaagttgtccaactggatgttaactagtcagatagcagccttgctggggtatagcacaagttggccaattcgcactggcacatagcctggcctcttgggtcttccttgtaactcaaatcactttgcaagccctggtagtttcacgaaagtcagatgtacccttaactcttaccccatacactcatctatcctggaaagaaaaagttgttggatcttggcccactactcaggaaagtgtattgaccacaggttgtatagttaagtaacagcattttgaggaggatgataatgatagtgatgatggtgatgatgatgataacaacattgatggtgctgctgttgctggtgtgcttaatgataaggatatgtgattataatagggtaggaactatatcttatccttttatacctagtatttggcgcagagtagggatttcagaaagtttgtttgttgtggatggagtgagcagttagagtttcccacttaaaacctgacacagagcatgccatcccacttactcaacaccctccagtgaacttccgtttcatcagcatcaccctgtgttgacctatgtattctggctctcctctgatgttactctggtctcatctcttatcactccccagagactggcttctttgtttttcttcaaacacatgcacgttcccatgtggaggtctctgcgtacgctcttccctctgcctggaatgctttcccccaaatatcactgtggctcatttttgttgttgttgtttttgagatggagtcttgctctgttgcccaggctggagtgcagtggcatgatcttggctcactgcaacctccacctcccaggttcaagagattctcccacctcagcctccccagtagctgggggcccaccaccactcctggctaatttttttgtatttttagtagaaacggggtttcaccatattggccggctggtctcaaactcctgaattcaagtgatctgcccaccttggcctctcaaagtgctgggattacaggtgtgagccacgacgccctgtcccaatgtggctcactttttagctttctcagttctctgcttaaatgtccgcttctcagagaggcctcccctgaccactgtgcacccctctctccctcccatgtccctttatccagctttatttttctttgcaatatttacgtattaagcattatttgtgtatttgtggcctatctctgctcactccatctcgactgaatctaagctacatgaggactacctcctttgttttcatcataggcatttccctagaacctagaacagtgcatggcatataggcatacctctgtaaatattgttgaattaatttgaaatgagttaatgaattgcttataccatcagaagacacatttcatgaactggcatgtatttcaggtatctttctaggtttgtctttcttatcaccctcttggttgtgtgagccccttcagaacagagatcctatcagatgtgttttgttgtcccaaaaggagcccagcacaaccccattcacacagtagttgttcagtaaatgcttattcattggtagattgtctcaaaggttcccacttaggagtattgcttttcttttttgctctgcttcaccacatttttcagtcactctgttttccttcctgcgttttgacactttatcaaactgtactttttcactgtagacatctatggggggagagattatacaagagtatttttatttccactctcaaatacatgtggtggattcaggtttaattttgtattattcataccactgcaccaaagaccaactaccaagaaaactgtaaaaaccagagaatatattttctattcttgatgaaataaaggttctgtatgagaaaccaaatttctaacttcaaaagatttaataggttgattcttttttaaaattgacacataatatttgttcatatttaggaggtacatgtcatattttgttacatgcatagagtgagcaatgatttagtcagggtatttagggtatccatcacctcgagcatttatgatctctatgtgttgggaatatttcaaatcttttcttctagcagttttgaaatatacaatacattgtggttaactatggtcaccgtactctgctatcgaaccttagaacttattctctctatctaactgtatgtttgcacacatgaaccaacctctcttcatctcacctccacccacacttcctaggctctggttactattattctactctctgcctccataaaatacactttctaagctcccacatgtgagtgagaacatgtggtatttctctttccgtgcgtggcatatttcacttaacactatgacctccagttatatccatgttactgcaaatgatgggatttcattctttttttatggtggaatggtattccattgtgtatattatacagcacattttctttatccattcattgaacaggatgattcttaaaagcaacttccagctgattacatttaggcaaatacatttaaacatttgctgtggtttttagcatgttagtagcttttgaatatagtacattctgcctactcaatgcccttgaaatgtctttctgaaatagttaaattcatgttggtattcacactggactctgtatcactgcctcccttacccaaaggagtttgactagttacttgctagttgaaaccagcttggtacaagctgacacatttttcaagaaatagttgtgtaatacatgttgatattctttgttcttcctttccttattcatccatttggctcctttcttctttccctgactctattccttcccccttgactttttggaagccattatcgctttagtaaacttaatggtgaattgcttcaagagtaaaaatgctctgcttttcaaattagaaaaggactatttcctgtattcttggggatctcattctctcatagctcttatttaaaacgttctggccaggtgcaagcactcatgcctgtaatcccagcaatttgggaggccgaggcaggcagattgcttgagtccagaagttcgagaaaagcctgggcaacatggtgagacctcctgtctaaaaaaaaatacaaaaattagctgggcatggtggcgcacgcctgtagttccagctgctcaggaggctgaggtcagaggatcgcttgagcccaggaggttgaggctacagtgagacatgattgcagcactgcattccagcctgggtgatagagtgacaccctgtctcaaaaaaaaaaaaaaaatgttctaagcaacgattttgtttatttgttcaagattggattttctacacatttaagcctgatttatcacaaataaagcactttctcacaaaatatattctcagctaattattattttcattagtagcactgtcctaactttataacacataaagttcccctggtcttgtttttaacgtcttgacatatgtatacatttttgaatgactaaatcaagctaattaacatatgcattacctcacatacttatcttgttttgtggtaagaacacttaatatctactctcttagctattttcaagtgtacaatacactgttattaactgtggtcaccatgttgtaccatagagctcttgaacttattcctcctaactgaaattttgtatcctttgaccaacatcttccaatcctccctctccatctccagcccctatcaaccaccattctactctctgcttctatgagtttgccttttttagatttcacatataaattgatatcatatggcatttgtcgttctgtgcctggtttgtttcactaaacataatgaattccaggttcatctgtgttgttgcaaatggtaggatttctttcttttttaaggctgaacagtatgccattgtgtgtgtgtgtgtgtgtgtgtctatatatatatatatatatatatatatatatatatatatatatatggcacattttctttatcagttcatccactgatggaactttaggttgattccatatcttggctctcgtgaatactaccacagtgaacatgggagtgcagatatttgacatgctgatttcatttcctttggatatatactcagtagtgggattgctggattatatggtagttctatttctaatttattgaggaacttccatactgttttccatattggctgttcaaagttacattctcaccaatagtgtaccaggcttcctttgtctccacatcctctccagcacttcttatgtttcatatttttgataaccattctaacaggtgtgaggtgatgtctcattgtagttttgatttgcatttctctgatgactagttatattgagtatgtttttcatatattgaaaaaaatattgaccatttgatgttttcttttgagaaatgccaattcaggtattttgcccatgttttaaatgggttgtttattttcttactattgagttgttttagttccttataccttttctaggtttttgtttcatctatgctgtcttctcgtacagctcattgtatttgtttgctaaggctgctgtaatgaagcagcacaaactgagtggcttaaacaaatgtattgatccacagttctggaggttagaagtcttagatcaaggtgtcagcaaggttggttccttctgaaggctgtgggggagaatctattctaagtctctctcctagttttaatggtttgctggcaatctttggcatcatttagcttgtagatgcatcaccctaatctctaccttcatcttcacatggcattctttctatgtgtgtatctctctgtctgtccaaacttccctatttcacaaggacaccagacatattggattaggacccactctaatgacatcattttaacttgattacttctgtttattccctatctccacataaggtcacatttcaaagtagtgggggtaaggactccaacatatcttttttttggagacacaattcatcccataacactcatcttctgaaatgtcaaactctggagttagtaaaaccaacaaaagtgttcattgcagcattattaacatgggttaataatgggttctctggtttatcaaatgtttaactttgactctttagatatagtaaaactttaactgagtagggtgagaggttctaacagatggaattttctaatttgctggcaattagcctgtagatgactatgcgagatgtcagctctggttccttcagtagaatatacataatagaaattttgatgattaacaatccttctatttagtattcatcctaacctcagactcttcatttcatttcatgagcctgcctacccattatggcaaagtgaagacactgtgatgttgtccatgacatttatgttgttcccaagtcacccttgtgttgtccatgacttttatctcactcctttcttccttgttctaaccactcctccagttcccgaatcttgcttctctcccctacttttgtacatttgtatttgttctgtagatttttttactcaatgccccctaaagaatttatcttagatatgctctactggctgttcctgattcaaatcaaactgatgaatgggccatcctaactagtccttttgacatcagtcaccacaccaatgagtccactcaccagcacacaaactgggcccccttagtttatccacaaagtggagaatttgacaagataatatactgtcctctcatgatatgtattgtgagatgccctcttaagagactttccaagtggctagtctctacctcatctgattacattaacatgcagttattccaatgatcttcctaatgtgtaattctgaaaagcaacttgcattcaaaatccatcaaggcccctccctccattgcccattcaatgaatgcattcttcagactgacatcttaccttcacatacctacctactagagctccaaacaagtagttctcagccttggttgacattgaattacctcaggagatttagaaactaaagatgcctgagccacacccaagataatctaatttaattggtctggagtgtggtctatgcatcaggatttttaaaagttccaatattcagtcagggttgagaactacttgtttagagcaacatgtctccaatcttaatgtgtgcagtaattgtcttattcaaatacacattcttattcagcaggtctggggccagccaaggttcctgtattttttataaccagtgatttttttggtccacactttgcataacagggtgataaacggagctctgtcaggtccgggaccacatttttctcatctttctgtctctaaagtatagtgtagaagctcttagcaaatgtttgaaatcaaattaaattacagcctttccccaactttccaacctttttctctgcatattgaagtccatataagcataggcttatctctttttgaagcctatccctagccacaaccagaaggccaatgttttttactcattcattcaaccaacattttctaagtgccctttatggcctgttaccaagcattctgtagataataaaatgtaatttccacctcaaatttgcatgccctaacaggggattatcctcttggtgtgtgcttcacagattaccagtgctacacaaccaggtgttttgttttaatatgctttaccttcgtaaaatacaaagttcaacacttgggtgtctctgcaatgtcaagttgctataaacgtttctaaacagtgctctcaaattctctccttgtaaaatggcagtaagtaattttcagatcatgttggttcatggactacactttgagtactgctttttcagggcctttccagacaaagtggagtctgtagaccagcagcatcagcatccttgaaagcttctgagaaatgcagaagcttggatctcatcacaggcctactgaatcagaatctgcatttctaggtgatttgtgtgcacattacagactgagaagcacagctccagggcagtggctctaaaccttggctgcatattagattcacccctggggcttctaaaaattctgctttccttcttttgagaattgtctattcagatcctatttgtttttgttgttgttgagttgagctctttttatatcgtggatgttagtccttcattggatgaatagtttgcaagtattttatcccattctacaggttgtctcttcactctgttgattgtttcccttgctgtgaagaggctttttagtttattatagttcccttagcctgtttttgtttctgttgcctctgtttttgatgtcttagccatacaatttttatggaattacttaaggctaatagaattagctgaaagtagtttccaaatgtgcatctctaccccttgctttgcaaccttctgaaaaccagacaatactctgatgtaatttgggaaagaagatatattagtttaggcctaacgtcttaatgtcctgaagaacttccctgtgttttcttctagtagttttatggttttggatcttatgtttaactattcaatgcattttgagtttatttttgtatatggtgataaataggggtctagttttattcttctacatatatagtacatatacacaataaaatgcttttcagccggctgggcacagtggctcatgcccgtaattccagcactttgggaggctgaggcaggtggatcacctgaggtcaggagtttgagaccagcctggtcaacatggtgaaaccccgtctccactaaaaatacaaaaattagctgggtgtggtggtgcatgcctgtaatcccagctactcgggaggctgaggcaggagaatcacttgaacccgggaggcagaggttgcagtgagctgagatcacgtcgctgcactacagcctagagtgagactctatctcaataaaaaaaaaaaagaaatacttttcagccataagaaagtgaaattctgtctttcttggcaatacggatgagcctggctgacattatgttaagcaagataagtcagacacaacaagataaatactggatgttctcactcagatgtggcagctaaaaaaattttgagccaaaggaagtaaagagtagaattgtgggtattagaggtagagaaggtcagaagggaggggaggatggggagagactggttaatgaatacaaacttacatctagataggaggaattagttctggtgttctagcactgtagggtgaatatggttgactataacttattgtatatgtcaaaaaactaggagagaggattttgaatgttcacaacacaaacgataaatgtttgaggcaggagatatgctaattaccttgatttgatcattacacattgtatatattataaaaatactctgtatcccataaatatgtagaattgttacatgtcaactaaacacaaaaggaaaaataattctgctgcacaagctatgtcccaatgaattaaactaaaaatctctgggggtggtccccagtcatcagtatttttttttttacagctctccaggtgactctagcatgcagcccagagtgggaaccagcactaagtcagcccagtgtccatagagtcccagaaagtggccagccattgctctaaccttcaaatcagctcaggttctcagatactcatttattactccattcccttcacttaggaaactcaggaccacagctaaggtattccttagggggtatttaaagaggactgcttagatcagtggttcctcaccttttgttccacagcagttcctgaaattggatgggtgcatctttaaagtgcagttgcagggcctgtgccttttttattgaggtggagcaattattgtgaccctgttctgctcagtaagacataaagaaaatatgctgggtggctttctccctgagagaggagcacagaaatagaaatattattagaaacagaattagaaatagatagaggtccacttcatgactgctcaactggactttttagggtctcaatttctacttgtgtaagctcagattgctcagtgggccaattagtgaatcccagagaagggactagagaacagacctcgtttggaaatactctattatcgtatttcaaatgtgggccatggactagcaacatcagcaccatctaggagataattagaaatgcagaatctcaggccccaaccagatctgtgaaatcaacaatgttcccaagtgatcgctatgcacattcaaatttaagaagtggtggtctctaagaggcagaatatattttttctcaaactacttttcagttcccctgttttccttctgctgtcatggaagatgagcttgccacaaagggaagctatgaagaatctagcacattcttcccttggaaattcaaacacccatttccacactgcagtggaagtgttgtgacatgttctattggaaaaccactacctacatgccatcatatggagccataaactatttttaggttttctggacaggccaaagattctgctgcccaaatgattccaaagaacgtgaggctgatgtgtctcagattttcttgtaattcttgcatttctaaaaatatcttgggtgtttgatgttgagttcagccctgttttactaacaagcgaagcctttgtatttactgtctcatttggtaggttattttctccctttttatttccagtgacatgtcatgtttcctgatactgatttatcagagaagtagaacaagaaattgattcaacatgcataatattttattgaatgaccatctccatgtaaaatttttcttggagtttgaagtggggaagaatgttggatatagacctggaaaagagaaggtatggtggaagttcaagtttcctcatttttgttagaggagtttgaaagctgccagcaagtgtttaacaaataagaaggcagccacctgagatagtctattgagataggaagagtgattgtagaagacaaacagcaacccatggtccttcaaagaaaaaaaatggcatgggcaggaattacttaagtctaatagaattagctgaaagtagtttccaaatgtacatctttaccccttgctttgcaaccttctgaaaaccagagaacactctgatggaatttgggaaagaagatatgtgagtttaggcttaatactttcctagtctttattattatattttacaggaatttcataatatatattttaaagattcttactaccatgattaaattctgcccagtatgatgatcaaaaagggcttactgaatggagaaagacatttgtgtaacacctagcagtcatttattgcaaagccaataagcgccaggcattagggatataggtataaataatgtcccagcataaaaggcaaatatatatttatttgccaaatatatatatatatatgttttactttatacatatttttcaggagttcacagaaaacaatgaaataacccttaaatcatagttcatttcttaattttcccagtaggagaaggctcatttttcatgtttttctttattattttgaaggcaggacttcaaaaaggaataaaaacagaaggtcaattgcagggcaaatcacagcggctccgttcttgcatatccagatgggcatcaccctcgtttaccttcctaaattgggaagctttacatcctttcacaaaaacatgatccataattattttgttgcagttcacttttttaaactggtagaaagcatgctgttaatgtgatagtaagtacttactctgtgaataataaaattattaacatttcaagcctgcattttggggagttaccttgagcccacattgtgccactcttaaacacatcagtgcatgcagtctttggggcagctccctgaactaactctcttgttgtcattttagagatgttgagattaaggtttagggtatagttttctccaaatctcagctataaataaaggatagagtgaggatgtctgcctgacttctatgcttaagcttctaaatgttgccttgcatgctgtctgttttgtgatctgagagtcatagtttatctgctattttgaagcacaaattattttttttaagaaagcctgatagctttatctgagaggattagctcctactatgcaaaaccttgaagggaataaattatgggaataaactagacagctacctgaatgtttgtattttagatttcaaggttattgaaagtactagagatatacctcagtctaatgtttgcaaataagaagcacaatatctccttgaagtcaagatttttgaaaggcgttattacttggtaaattaaacattagcttgccaaatagattttttcttattctggagaattacataatagaatcatgggtattttgtacttgccaagaatcacttcttgtaccatgtagaacactcctgactccctgcccctcatcattgtatagctgaaaaaatcagagaaggaaaggcacatgccccaggtcacacaacttgctggtgtctgaaatgagtgaaacctgagaggttgtctagtccacactgcaatggatctccagctgaacgttaaacataattatgaactatctacatattttttgtaggaagtttcagagtgatgagatcatttcttcaaaggttttgtttgtttgtttgagataatgttttaatttctgacaaatagcgttggccctattagaagacttgcgttatgtaagtctagcataaaatatttatcatatccttcatttgctaaaatgtttgatcttcttaccactgcatcaaaacaggctgggttctgaaaggctgatggagagtcaatttattcgcaagaaagaaatcacacgattcaagtgacccaagatgtcagtgtgaaattaaattccaccagagaactgatgatactgagattgacccttgcttgaaacaaataagatgaaccatgaagtgaacctcattccaaacatggcatcaacaaacataaatgaagacctaaaaagtgacttgttttgggtgccagatttttcaacctcaaaactgaagtggttgtgaagccaatttcaaaatgacaggcataacccaacctttagggtttattggaaacttgattatgttcttaaggcctctcagatttttggcatggtttaaacatttgcctctctgtcctacatatgataaatctgtggcttttggctaaagtctggcctgtggaactttacccatgtgtgaatctcaagctttcaaacatgttgcattcttctaaataaacattgggccactaggcatctgctgttaatgtagatcctgtagtcatgcattgttttttatcatttcattcattatttctcttcatcttttactgagcattatccattacatgggcaacatacctttcacatgttctgtgtttcgctttccgtgtgtcatgattatcccaaatgcctaaaaacaattgaaccagcctagatataagaaagggggccatagggagccttaagagtgaagataccttctaaataatcaaaagttgaattacacttgatatggctttagcattaagtcaatttccttgtacacttgttcttacaaaattgggtaatcaatctataacaagtatctgttcttaatgccttgctgtgttactcagagaatcttgactttaacagaatattttaaaaattcagcaaattaacaaaataagcactagaatgtaaaactctttctgtccctctttctacacacacatacatacacatttgcagttgtttacaaggtgtctgggctatgcacatcgcatgctgtttaggagtataggctttagagtcagacagtctcgggtccaaactcagctttgtctagtggcaatgtcacttgttgccactggcaggttcccatcctcatgaaagcaaccaagaggggaggataatacttaccttttggagtttttatggtctcagtgagctaatttcagcaaaatacctttgcattgtctaaactggggtctctcaacttcagcactattgacattaggaactggataattctttgtggtggtggtggtggctgttgcatgcattgaagatgtttagcagcatccatggcctccaaccactagatgccagtagcatgctcctcccctctgaattgtgacaactaaaaatgtcccatgacattgccgaatgtcccctgttgggcaaaattgcccctggttgagaactattgttctaaaattatacaaaataacctctttttgctaaagcaaaataattgttagacattctaagactcagaagagaaggaaacttgaaatgaatcaagccactaaggacatttgaactgagaggttacatagaacagaagctctaaggggaccccaagcatccccatctaaatttccttctctcctaaagttccattggtatctgcaataaatcaacattttttgtaaaatccacttgctccatttctcaaatcattgcttcatctctcatttgtgaagctattgtgtttgattactcccaaatacaattttttttcctacccaaaggagacccttcccactctgcatcctaaagtgtctgggtgtcgactcatggtcagtaaggtggttgctatgtagattaatgtgcgctagctgatattttggtttgctctcctggcctattttgtcaagcttggagggttttctaactttgcaacttggactcacagactcctagcctcaaagaaatattttcacaccagccttaagttcacatccaagatgtgacagattgtgtgttcttggggtggaagtgagagggaaggggaataaataaacccatttttaggaagtatagtcagcacttacgcccttccatcatgcctttctgaaggcattgcctcaaacccagacttgaagttgagcatactgcttaaattaggggattggggcaggggcatgggcatgatctacccataaaccatagatggtttcttccacccccgcattctccctcttctgactctattgaccactccctctccccaccaattctctctttttattttcttggcaccagaaaatcttttttttttctttttatcgaggtggtgtctcactttgtcacccaggctggagtgcagtggcgcgatctcggctcactgccaacctctgccacccgagttcaagcaattctcctgcctcagcctccggagtagctgggattacaggcacccaccaccacacctggctaattgttttgaattttttgtagagatggggtttcaccatgttggtcaggctgttttcaaacccctgacctcaggtgatctgcccacctcagctggcctcccaaagtgctgggattacaggtgtgagccactgcacccagctggaaatcttaagatttaattgtcttccagtgaatgagctgagagaaataggatttatttaaccagagttgtcttctcctcttgggagtgagaaaaaaaaaaaaaaaaagtagggctttgcctaaccattatttacagctgtagaaaaccaaatgcacagtctaaatctaagtaaggaaaaacacaaacacaaccttagaagatagaaatcattcacaaaaagctctgcatttgtatttcagtatgtgatgttatatgctttcagtccagttcaactgacattttgaaaccaaacgcttatacagtgtttgcagtgattttaaaaatattaatcaatgttatcctcatatcaatcctatgtagttgttattattactattatccccatttcacagataaggaaattgaggcatagataagtaacttgcctaaggtatgcagctagtagtggtggctctaggatttcacatttattgagcaatcagtaaatgtgctcagtcttgggcaacaaagacaagtaagaagccaagcagttttgtggggaagacctctgaatggttaatcctgtgatggagtggtgagtgctatgttaactgctggattaattaagcctttttaatttctatatttctgatcatttgatatccagagccttgctgatcctgaagggactgcccctcccctgggagagctagctaattcctagggatggtaaacaactcacttggaattatacctttcctatgtggaccaaccaatccagagcccataccccaaccacctcatttattgggctctcacagggctctcaaacccttgccctaatcaccccaggccaggtaccagacactagagatggaccctacaccccagagtccacttaaattattcaagctagccaatcctaagcctgctagccctgcctcacccattcctttccacacaaaccacaataaaggctcttgcccatgttttctccttgcttcctctttcccctgaccagccctggtgcttccccatgtggccctatgtggtgtggcatgcctctcctcttgggaactgtgtgtaacaagctgttttcccaaaggcaattgtctactgatctgttagccccactatacctgaataataacaaaacttacatttagaaacatttgcgtgcctgtggagccccatgcaggcactcaggagacaagtacagctggacgctgttttcaagctgctcacagctgtgctgtactgggccacaaaatgcaattcttctgccatggttggtgcacagcagctgtttggctccccactggcctggtctgtgtaagtgtaacagatgacttccatgccgttcttaaattacagcccagagaaatcagttggtttaaatagtctcacttatggactacttccaacgccctatgattgctttgtcccttctttatttgaaggttcaccatgttcttctttacagaagtacactatgttcttctatagaattttctgcatattctctcaagccttcttggtgccaataagccatcttcaacaatgaaagccactggtggctgctgggtaggagttggtcacctttggagatcccaaagagggatctaagactctctcaagctggggggacatcaaaatgaccagctatttggccaaggaaagacagttatctgtcctatgggtaattttgcttgtggaactctgctctctaccccaaaggtgaccatttgccatgattattgaaaagaggattccagatctgggcgaacaaatgaaatttgaggtttcttatagcatgggaccccctcctcctcctattagctgctctgtaaagctgaagtattgctcctcatggtaacttttcttatttaaaccttttcaatattgcacttgttgaggtttttttttttttttcttttcctttttttcttttttgacagagtcttgctctgtcacccaggctagagtgcagtggcgtgatctcggctcactgcaacctccaccttctgagttcaagtgattctcctgcctcagcctcctgagtagctgggattacaggtgcctgccaccatgcctggctaatttttgtatttttagtacagacggggtttcaccatcttggccaggctggtcttgaactcctgacctcatgatccgcctacctcggcctccctaagtgctgagattacaggcatgagccaccgtacccagcctgaggtttgttttgttttgttttgttttgtttcactttttgtccctggataaccaatgagattaggggcttattaatctcctctggctagttatctccattaagcttattgattttcattctaaataggttcaaaagagctgtttatagacttaactaaaggcttaatggctggcgatttggaggtctgtatcctttgccagagtgaggataaagtcacattcctttttctattcccaacccctcctaaaacagtgggaggccgtagttaggcactccactaacatttattgaatgtgggtattttctgatgttggatcgcttaggctagttcagaagtgggagctgtggtctgggtctctgtgaaacatctcctgagaggatgagaaaaagctgtttactctcgagtgtctgagtttatgcccatgtggatggttagcgggtctgtcattcagcagggtaggcaactctgcagaatgccatggaaattacctttcttgaaatccatggaacaattttaagttgaaatcacagtaatgaaacaaagctgttatggggatggtgtcaagaaagttcagtcatattccaaagtcctctcaatttgcatttgaagggtggtgcattaattgtctcaatggctcatttctcagacagttgaatgataaattgttagaactatagcagtggttctcaaccaagaaagatattgcattgtctggagacatttttgattgtcataacttggggaatgttactatagtaacacctagtgggtagaggccagggatgctgttgaacattttaaaaggcacacagtgggccaggcacagtggctcatgcctgtaatcccatcactttgggaggccgaggcgggtggattgcttgaggccaggagttccagaccagcctggccaatatggagaaacaccatctctactaaaaatacaaaaaaattagccacgcgtggtggcacacacctgtagtcccacctacttgggaggctgagacgtgagaatcccttgaacccaggaggcagaggttgcagtgaattgagatcacgccactgcagctgcactccagcctgggtgacagaacgataccctgtctcaaaaaaaaaaaaaaaaaccacacacacacacacacacagtggtccccacaataaaaagttttctggccccaaatgtcaatagtgccaaggttgagaaatcttgatctttattaatctaacatctggattagtttcaattaatctatgctgaaaaaataagtgttcagaatctaagaaatggagaaaatgattaattaaaaatgaagtaccttaatatttttaaaattagaagcatttagacattcagtatttggtttttattgtacacattataggagttaattctttattaaattgagaaaaaaattataaaaatattgagttcttcctgaaatctgcataaagaaaagagccattctgggtcttctctgtgagtaattgaatttttggggtacagcttgtgttagttactcttctcctaaagatacattttatagacaggtgctcagccataaagggccaggaaaatcaaagaaaatataatttaaggtcttaaagtccctttttattatcagatttcactgagtgtgggcacatgaaacatgagtccatgatcttctgatagtttcagatgtctcagattagaagatggaaatgactgattgtttttctcaaatgatctctaagatcaatgagccagtccaatgtacatattcaatatttaaaaagatcaaaagttgctgttatcatgatatagttgatttttgtttctcttgtttgtacactttgggccatagagaagctataagagacaactctgtatcttttagaaatgagcatatatttacaaggagaaaagcctttttatgtcacaaaggatactagtatatttatcaatttctaggcctttaaagtgatgtctttagtcctgcagttttcaaagtatggtctgaggaactattgggtttttttttttattcccaggagttccttgaggtcaaaattattttaataataatatgaagatattgtttgtgttttttaattctcattctctcaagagtgtgccataagagttttccagagaccacatggtgtgcaatgaatatcatgctgatagctaatagaatgtgttcttgtgttttaaaactttctcagttttaattcctaattcaataaatagcaatagataaaactcacataaacacaagcttttggaacttccaataatttatgagtgtaacggggtcctgagaccagaaagttatgagaactactgctttagtgattgacagagaaaatgaatcaagttgaacaaaagttcagaacttgggatatttcaaataccatggctaataacataagccagcatcatcttttattgctttgtagatattagagacacgaaaaacccttggattctgtgccagagcttaaaagaactagaagcaattgtttctgagttcttgtttcaaatccagtgtctgatttggagttgtgtaatctctgtgccgttgacattttgggcagggtaattctttgctgagaggagctgtcctgtgcattgtagaatgttcacaacaaccttggtctctgcccacttgataccagtaggaacctcagttgcaacaactaaaaatgtctcaagacattgccacatgttccctggctggcaagtcacccagttgagaaccactgtctcttaaggcaaagtatctgttgtcgcgacaggacgtttctgattccctctcattgtttagaatttattcacatagccattcctaattgtaaataggctgggttatctaatatttattctagatgggtatatgccagctaaaattggatgttgtattactgtgacagaagaagagaacaagtattgagggacagctcccagttttcatcatgtgtggaaagagaatctatgcttgaaatatttgtgatggtgatagcacattctatcaagtctaggaaaacaagtcactggattttactgaagtatttaggtgtaaaaaattgaaggcccttccgtgaaaaagttctaattggtaatttcattttatgcaaacccctattatgttattatttgagagagttcaagcgtactttttatccttggtaaatattacacagtaaaaaattcaaatatcagagacaatacaaaaataattgtacaggctctttgctttctttagttacgtttttgtccagaaatatgtttttgtgcatattttcataccacaagttaaattatttttcaactttcattaaggttttatcgtctctcttgatggtgattgttcacaaagaaacaaaatatttatctattaaacagagtgtgatttgcatgaggttctcccagaagtagcacctgagtcaaggattcacattcaaggagtttatttggagaataaaagtagaggagcggaggtgtgagacagagaagggaggaatccaataacaggtgtactgttgagcacatttccactttaggagatgggctgcaatcccattagggaaccctataagccagtatagaatacaactcagagttatcccacccaacggacaaggacactgaggtatttatcctccaaatctcagctgctgttggctcagggcaacatccaggggcattaggtccctggcacttctggctttcctttttttccctagtcaagagaaagcttataggcagagagctgcttatgtgtgaagctggatgtcatgggatgtcctgaagcagcgagtgctgagaggacatgatggggtacctacagcatctattccaccctctacactggttggttggcttggctcactcaccagcctctggcccaccagccttgctctatgttatgttgtgggcttactaaggtcagataggcaaaggaaaatgagctgaagctggacctcaaaaggatgctgacaaaaatccttgcatgatgaataaatggtgaatgaacttcatcaatgtgatggtcaggaaaacataaacattaacaaaaatatgaagctagttttcaggagccatagcaatatagttttaaattccaacccaaaggatatctgcagagcaacaatgggaaatggaattttttgctgttgtttgctttgaacatatcacagattcctcttctctaggatgttaatcagggccatcttggatcgtacttactgtcagatgtaagccaggccactgttaatgagagactggaatgcagccccagaatcggtgtctgcttcaacacagatgggcatggggatgagagatgccgggtggttatggaatatggggaaaaaatatggtgacttaaaggagggcagaggcccttaaaacttccttttatagtacatcaaagctgttgatcattgaggagaaaaagcttaaggtgggctactgggacctgccgctttcagcaagaaggctcattattttgaggataagtaaaacaagtagcctcatgtaaggatgaagcgctcttcagtagatgttggttgagtccatatggcttgcagaacatcacattaaagtttgctgactcattccatgcaagatttaagcaattttcccaaggagacaatatggctgtctccatataaatgggaataattctagaaggtaaacattagtcagcacagagaatgatttgatgaagagatagagacttctatgggtaatgggggcagacataacacagatacatgggaagcagggtggctaaatgcaagtgtgttttaagccaacaaaggtagcagtggccatggtggaggaactggagagaggggccacttgttgataatttattcctaccagctcttattgcaataaaaagaaactatgtaataccgtatgtggttaaaaatttgaaactaataagataaaggaggatgatggtgaaatggggggaagaaaataagatggtatcagtatataaaaatgcacgctatgagatactgtctccgcactgttcaatatagtagcccttaaccccatggagctgttgggcacttgtaaggtgctgagtccacattgagatgtgctgttagggttaggtatgcacactggatttcaaagactaatatgaaaaaatgtaaactatatcattgataatttttatgtagattacatgttaaaattatgataccttggctacactgggttaaatagaatatagtttaaaatcagtttcacctgtttcttttcacttttttaatgtggctactagaaagttataaattacatagtggctctcatttgtggttcacattgtatttctgttggacagggctgttcgctaccatggcctgtaccagtggttctcaaagggggatgattttgcccccgagaagacagttggtaatgtctgaaaacatttttggttgccactgctggaggggagggatgcttctagaagccctctagtgggtagaggccagggatgtggtcaaacattctatgatgcacaggaaagcctccgccatcaagtattatccaaatgtcaatattgccaaggctgagaaactccactttacaccatagatatagggtactgggagcccaatatggaggtatagtattaacctaagtgtgagggtgtaagcatcttctctagagtgtagacagtgggacccataataacacccttcactgctcaactgcatgtcaacaggcagtacagcaagcacctgatattgatgttatttaattcccatgagagcactattgcggtaggcagcatctccattttgaatctaagtcagctgattccagcttatgggctttatcgcccacagagataagaactgtaactacttcaagtctcttgagtccatttatttctttccattgtaagggcctactatcctagataaggccacctaactagtctctagtcttgaccacttcagtcctccagttctttctccatgtcacagtgatctttccaaaaatccaaaacctttcaatatttctataattactctcaggatgcagcccacattctttatcatagtctagaaactattacttggtttcaacacatttttgtcaaggatacacaatgtattttggacaaaatatggtaagaatcacaaaatgactgcaagatgatgcatgttaatggctgtcactactagagatgcatcttgaagacaggattggtgacctttctctctgtaaacaaagacttttagggcagtattttgcttatgtgggacctgtgaacatttgggtaaaacatgtttatgcaatttaaatgattatcaaaccaacaataagtttattgaaatgagaagattttaatttgggaatttgataggaagatacatgttgtttgttatactataaatctacaaatgatcaattctttggagggagaggttctgatttgtatctttttctgtctccagcaataacgagtataaagtaggttttgatagttccaccttaattaaattacaaactttgtgatgatcctgaaatgtgtattttgaataagggatcttaagtgccacctagtggcaatgaggggatatattacacattacattacaaaatgtattagttttgaaattataaaggatcttaagtgccacctagtgggagtaaaggattatattacacaacatactacaaaatagagccgttttgaaaatgtaaatggtcttaagtgccacctagtggaaatgaggggatatattacacttattttaaaatatgttactgaaaagttgtccccttctcggtggtagccccagtatgacttaaacgctgtgaatacaaaaatggtatctccttaaaattatgcattctcatcttctttattcagtttacctgtctgtcacactgccctctggacatctaattttttaaaaaagaaattttttgtatgagttgaaacagatgaatcctgaaatctgagtgaaattttgaaactgcaagtttgtttctctcttatgtaagagtccaatgaggatatttggtggacagccttccttgtagtgacttggggatccatgctcctcccatcttgtagttcagccagactttagggcagagatcagcaaactgtttctgttaatggccagatgggaaatattttaggctttgtggactttctggtctgtgtcaaaactactcagctttgcctttgtagtgtgaaagcagctgtatacaatatgtaaatgaatgagtgtggctgtattccaataaaagtttatctttaatgctgagattggaatttgataggtttttcatgaaatagtcttctttttaatttttcttcaaccataaaaatgtaaaaaacatgattagctcacaggcagtgcaaaaccagtttgttaacacttgccctagggctttggaatccttacttccagccagaggctggagaaaggatcttgcatgggaagtttttttctaggccagcctgtaatcagtcaagcaccatcccattggccagaacacagtcacatgatcacagacagggtggagagggaataggttttggtgaacacatagcagtgtacccacagtctctaacacagtccaccctgttactttaaaaataaaattttgttattcattcatttattctttatcagttgatgccatttcttagccatgttcccttggtatttatcattacacgcacatgttcgtgaacatatccactttaagaccttgtctttaaactcggtacgtatgtataaagtgattatgatgaacataagaaatggcatcagttaataatgaatgaatggaattgtatttttaaagaaataccatgaactgtattagagattgtggctacagtgttgtgtgttcaacaaatctttctctaacctccacccacatggttgaaaacaaaggagacttcgaaccccagctcagtgtagcaccaatgcctcaatagcatccttggagcagagctcctcaaatgagaatgtgcatgtaattgtctggtaaatattaccagcacaatggggcctgagcttcagaatttttaatactggttatgctgatgttgctggactgtggaacacactttgagttgtaagaataagtgtactgagctaataagagaaaccacgtttcttcatctctgtaatcaccgatagttttgactgtaatagctgggaccccaggcagctgtctggattttggagaaaatgaggatataaagggaatgtgaactgaagctcaaagcttgggatagctatggattataataaattttaaagcaacaacttgcaaacaaatgggtattatgtatctgatgcagttcaggttttaaaaataaatcttacagccaaaaaaaaaaagaaccccctgtcattaatctaggttgacaaacatgaaagaaaagtttaggaaagaaaggaaacagagagatggggaagaggggtaaggtgagtgggtgggtggaggaatgtcttagattgactagagaaatgggttttgcttcatgggattttttcatatttccaggagagggcagccagtccccactctaaaaacaatgtaaacttttacatttgcatctaccattttcagaaagtattgtgatatacagtgattttttaaaaaacttacttctgtccattctattaaccataattggaagctcaatatatacgaagggcattaaactaagagtcaaacatctgaatttggaaggtcctttttcctagatcttagcaattctgtacctgcaggcaagttgatgaacatcctagattttttatatgtaaattagatgcagtaagactagatccgcctcctggaaggatggcagataattaatgaatattgtttgtgaaagccctgtatgaatatattaattcattcatctatccattcacttgttcagtcacacatttaagccttaacgtgttgcagtgctggatgtcgaaatacaaaatgaccgtcacacagattctgccttcaaacaacctattgctaactgaagaaaaatagtatgattatgctataattgaactgcaaagtgacagtctaataaggcttggtaggagcaccctctactgacaaccctgacctgctgtccttttctcccagtacttggcacttcactcattccattccagttacataggcctcccccagctgttcctcagactcaacaagttctctatgttttggggaatttgaatttcgttttcttgcctgaagtgtttttcccttagttatccacatggctcatgctcaaggatttttaaaaaaagatctctgctcccttgtacaattcttacagaggccactcagagtacattatctaaaatagcacctcagttactctctatttcaccctctctcagtctgcaaattaagatgtcattccctaaggcatccattgtatgcaatgaattaacttctctcgtatgtatcgagaatggtaatagctgtgcatcatccttgggaaaattgagaatatagtctgtcaaagtactttctgtgttctgtggtttagatgaagatagcaagttgagtccgtgttttactttgctttataacagttttcacttaccaaacacaatattatgaatatatttaatttgtttttctctcctttctcaccattagaacacaaactctaaaaaggtaggaaccatggtttgttcaatgttgtatctgtagcacctacaccaccatgtgccatctccagcttggcatattgtagggtaggcaatacacttttgttggatggatgagtgtgaatgacgaatgaatggatgaatgaatgttgagaatgcactcaagaggtaactcttgatctgggtcttgtaagatcagcagaattttccttggtagatggggatgggaaaggtattcagacacagtatggtttaatgccacagtcttgtaaacttgagagagccatatccaggtaaggcagtggctttctgaagtggcaaatccatacctattgtagttttcctgatttttgtccttctttggagagtattatacactgcatatacattgtattattcacaatatatttttgacagaaataagttgtatttcctgagcagacacctccacttgttgatggcctgtgtactaaggaaaatacagattttaacattagcctaaataccacataattagaaatttaatctactggggaaaatatcattaaattttcatactgcatatattactttgacttatcagagttattcttctcttattaataaaagaacaaggtgtcagtttactcactgattaaaataatcatattattccatttcaagagcctatgttttcaatagtgaaatgcatgtttaatgatctttagatccatgctactcaaagtatggtccccggaccagtgccaattcttagatagtccttgcaggtctgtaaggatatatgcaaatcaagcaagagtaaacatttagaaacttttatagaaatttggcaccataattttatatctattgaacctaatttttaaaactgggcttgtgtttcatgtgcttccctccacccctttttagtaatttattttatttttattacattttacaaaagtatgattctgcaatggattggaaacaaacaagcaaaccttgtctttcaatacaggtcatttgagaaacactgctctagagcatgattcgtgcactgcctttagtcccacaaagcctaaactatagggaacactgagaatttagcttggagtcgaactgaccttaaaccaggtgacagtgcctgttaatagtgctgatagctggcatttatcaagcacttactatgttccagacattacactaaagactcgagagatttcccttgcagcaagggcctgagaaaagtaaaagtagatgggggagagggagattgtgtgtgtgacatcagaagcacacacagatgtttcttgctctatccaacttctttcagggatagaaagtctagaatgacaaccactccactgacagttacactgatttgacatccattttcttttatttctgggttggttttagtaatgttttggtaatataagccattaagcttacacatgggtacaggaaaggctgagtttcgggttgtttgtttatgcatgcatggatgccttggagacctggtggagaacccaaaagcttaatagcggcctttgcttaaggaaacctggcctacttcacccaggggcaaagctattagtgtccagaatctgggccctgttgcataaagatcttgttgtaactggttcaattctaggagggctggggaaatatgttttttagaagccttgaaatttacaacctcattgtccattgtggtcttttcaaagcattcaaagaatctgcattgataacagtctgtggattaaaaggacaagcaacctttgctatagtttcctgcatttggaaaccctgtggaccctgctaggcaacccttttggtaaaaggtaggcagcgaaatgcaagaatcggtagaatctacacagcatctgggctaaatcagaagtatgccagaataaaaggggaatatataacatatgcccttggtaagctggacttcactagcagggcttcatctccctctgtgctgaaaggttagcaaatattttatctaaacgtgccacagaaaagcaccataggtattgtctattggtagaataaatagttcaatcaatagctcagtgtagtttaagttgaatttaataagactttggaagcagatggactaaaagaaacacagacacacacagaatttggggcccttgttctgtagcgattgctcataaaagaatgtgaatctttagactacgtttcctaaaaggaatccagccatacttatcgaaaattttaatggaatttataaaaactgaactgaaacttgtatccacaagtccttaagccttttgaccacctctgtgattaggcatattcagctaatgtaactaattgccagatttagcaaatcactcagttacatttgaatttcagaaaaacaaatatttttacagtatattccatgtggtatttataagtagatcccatgcaatgctttgaaaagaccataatgcaaaataaggttgaaaattccagggtttctaaaatcatgttttccccaacccatctagaaccatgcaatatttgggacatatttatgctaaaaatattcatttattatctgaaagtcaaatttaactgagtgacctgtattctgtctggcaaccctaatctagtgtcattgataaaaagatgtgggaacagataaaaaagatgcagcagacaattggttaattcttttttcttttcttttctttttattttttgagatggaatctcgctctgtcgcccaggctggagtgcagtggcacaatcttggctcactgcaacctccacctcccgggttcaagcaattctcctgcctcagccttccaagtagctggtactataggcgtgtgccaccacacccggctaatttttgtatttttaatagagacaaggtttcgccatgttgcccaggctggtctccaactcctgaccttgtgatccacccatctcagcctcccaaagtgctgggattacaagtgtgagccactgtgcctggcaacaattggttaattcgtatttgaaatctttatacatatatctcacttgaactttacaacactcatagaagaaggatatattaaaaagcttgttttacagatatggaaactcaggcttgaagaagttaagtcatttgtctaggttcaaacagctacttgagtcagagaggtaagattcaagatcaaatttaactctggagcctagacacttaaacatatcagtgtaatcttaagtgacatttaataatactttggaagcagatggactaaaagacacacacacacacacacacacacacacacacacacacacacacacactcctcatattagcaaagcatcattaggactaattctcctttagtgttttccaaccattatatcaatggtttctaaacttttaaattatggacacctctcctccattttaacctctcatagttagaattactaagcatggtaattttagttgtctgatataatataatgacagaaattagcaaattaatttgtcaatcaaaatgaattcatatataattttcacaacacaagtagcatctaacagcatatgaaagacagtaaaacataccttcagataaattatttattctagaaatgatgttgagtgtgcaaatagattggaggattcccttatataatttgaggctctcccactaccacctcaaagcagtcatgtcccacaagttgggaatctataaattagagaaattaaatcttagagatagacccaagatgaatgaaatttctttccctgaatgtagaaatgaacccaaaggaaaacaactactgaagctggggagaaatgcaaggtgaggggaggggagggtcagtgatttaattctcagccacagcaggtgcttctggtgtcctgcctgcttcagcctgaaggctttatactacaaacattggcaacttttgacttgatggctttctctgccacctctccctactcatgtacagctgacagtaggacagcagggaagtctggaagtggttacacctagaaagcaacacttaacacaaccagcttccttgccctttgagtgggatgactcagagtgaagctttacccaatctcccagaggcccccagaaggactaagtcccaggtgcccacagtagtcaccagctcattaatgcatttgaattggtcaccttcccttcctcgtctcactttcatcctttcccagtgcttcctgggatcttctcccaattaaactgcttgcatgcaaattcttatctcactctctgcttctgggagaactcaatgttaagaaatggactaaggaattttatatttttgaaccctgccataggtatcaataccagaaaagattagctctctgttacttttctgatcctcagtgccttgagaattagtccagccttttgaggataagcaggttggtgagcctggttaatatcagttcttcatggaggggcccatgtggttactaacaacatgggtaaatagagcctgacgtaaattaattatgcttacgtagattttttcctctgtaaattttggtcattataaataaagaattgataggtttttgtacacagtacatggtgaataactgctgtccttcagtgctccactcctagcatctttatttgggcattttctttggactgaactataaaatataaattagattaatttattggatgagaaagttgtgcaatgataaagcagaacaatgtattcactcagtcttatgccaggcagtatggggtagtaaaagcagaatttaaatgggagttgggagcctaatttctgcatggtgtgtaacacctctgagtcttattttccttatgaatcaaatgaactctaataatccattcaccaacaagtgtctatgatcttttccaccaataaaagtcccagtgtcaattgcagagttgaaaaggattgtagattatgggcagacttcaacatctcaagatttcctgctcaaccacccctggaaagagatcatgcatgcagtattgtgaatacctctgaagatgagtaagatgagtatatggtaagataggctcttcaggggacacttgacaatgtctggagacatttttggttgccaacaaccggagtcagggaagatgctagtggcattagtagatagggatgcctctaaacatcttacaatgcaggggtccccaatcctctggtcatggaccagtaccggtacatggcctgttaggaatcaggctgtacagcaggaaatgagtgatggacatatgagtgaaacttcatctgcatttacagcagctccccatcacttgtattaccgcttgagctctgcctcccatcaaatcagcagcggcattagattctcttaggagcatgaaccctattgtgaactgtgcatgcaggggagctaggtggcacatgccttatgagactctaatacctgatgatctgtcactgtctcccatcatccccagatgggaccatctacaagctcagggctcctactgattctacattacggtgagttgtataattattttattatatattacaatggaataatagaaataaggtgcacattaaatgtaatgcgcttgaatcatccagaaaccatcctcctcccctccggtccttggaaaaattgtcttctatgaaaccgctccctggtgccaagaaggttggggactgctgctatagtgcacagaacggtcccccaaagaccaagaattatccagtcccaaatgtcattggtgctaaggttagaataagacaacaaatagaccaaagcatccaatggctgaaagcaatagaaatttaatttttgcatccataacaatctagggtagttcaagctagaccagggtggggttgtgggagtgggcaggtagacccagctctgctctgtgagaggatatcaactgatggcatgattgtcactttcagtatattgtttccacagctataccaggctccctccatttcagccagctgaaatagggaaatggtatggaggaacatgtataggaggtttatctgggtaaaatccggcaataacacacacgtcttcctctcatgttccattgactagaaatcagtcaatgcaaggcaggctaggaaatacagtgtggactaatccattactcagaaagaggaggaaagaatattctgcctactagttagcaatctctgccctaatgtgcaactacatcacttcttttattataataataagagagataatagcttcaggttttgagtacttgtattttatgaatttgtatatattttgcgcatgttaactcaattttcccagtaccctaataagctacattctgttattagctccattttacattttaggaaaccaaggcatgaatggttaaataatttctctaaaatacacaataagtgtcagagcctgcttataaacccagactgtatgatgctaaaacctgagttctacccattataccgccattcctgttttctccttgagtaccgtggttgtttctactattgaacccaaatctgcctttccacaccctccccctccacttgctggttctacttttgttattggggagaaacaggacaatcttacttagcgttttcaatatagacaactagaggcataggtggaaatcaaggtaatggccatgggggctggaaagaaacaggcagatgtaagagatgcagactccataggagaattcaatggcctcgaatttttttctaaggtaactggaattctctaactgttaaagaaaattgattctcacattgattttgtatcctgagactttgctgaagttgcttatcagcttaaggagattttgggctgagacgatgggatattctagatatacaatcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcactatgatattggctgtgggtttgtcataaatagctcttattattttgagatatgtcccatcaatacctaatttattgagagtttttagcatgaagggctgttgaattttgtcaaaggccttttctgcatctattgaaataatgatgtggtttttgtctttggttctgtttatatgctggattatatttattgatttgtgtatgttgaaccagccttgcatcccagggatgaagcccacttgatcatggtggagaagcttcttgatgtgctgctggattctgtttgccagtattttattgaggatttttgcatcgatgttcatcagggatattggtctaaaattctgttttttgttgtgtctctgcccggctttggtttcaggatgatgctggcctcataaaatgagttagggaggattccctgtttttctattgattggaatagtttcagaaggaatggtaccagctcctccttgtacctctggtagaattcggctgtgaatccatcttgtcctggactttttttggttggtaagctattaattattgcctcaatttcagagcctgttattggtctattcagagattcaacttctcatggattagtcttaggagggtgtatgtgcccaggaatttatccatttcttccagattttctagtttatttgcatagaggtgtttatagtattctctgatggtagtttgtatttctgtgggatcggtggtgatatcccctttatcattttttattgcgtctatttgattcttctctcttttcttctttattagtcttgctagcggtctatcgattttgttgatcttttcaaaaaaccagctcctggattcgttgattttttgaagggttttttgtgtctctatctccttcagttctgctctgatcttagttatttcttgccttctgctagcttttgaatgtgtttgctcttgcttctctagttcttttaattgtgacgttagggtgtcaattttagatctttcctgctttctcttgtgggcatttagtgctataaatttccctctacacactgctttaaatgtgtcccagagattccgctatgttgtgtctttgttctcgttggtttcaaagaacatctttatttctgccttcatttcgttatgtacccagtagtcattaaggagcagattgttcagtttccatgtagttgggcggttttgagtgagtttcttaatcctgagttctagtttgattgcaccttcagctgataagcaacttcagcaaagtctcaggatacaaaatcgacgtgcaaaaatcacaagcattcttatacaccaataacagagaaacagagagccaaatcatgagtgaactcccattcagaattgcttcaaagagaataaaatacctaggaatccaacttacaagggacgtgaaggacctcttcaaggagaaccacaaaccactgctcaatgaaataaaagaggatacaaagaaatggaagaacattccatgctcatgggtaggaagaatcaatatcatgaaaatggccatactgcccaaggtaatttatagatacagtgccatccccatcaagctaccaatgcctttcttcacagaattggaaaaaactactttaaagttcatatggaaccaaaaaagagcccacatcgctaagtcaatcctaagccaaaagaacaaagctggaggcatcacgctacctgacttcaaactacactataaggctacagtaaccaaaacagcatggtactgataccaaaacagagatacagaccaatggaacagaacagagccctcagaaataataccacacatctacaactatctgatctttgactaacctgacaaaaacaggaaatggggaaaggattcactattcaacaaatggtgctgggaaaactggctagccatttgtagaaagctgaaactgggtcccttccttacaccttataaaaaatcaattcaagatggatgaaagacttaaatgttagacctaaaaccataaaaaccctagaagaaaacctaggtaataccattcaggacataggcatgggcaaggacttcatgtctaaaacaccaaaagcaatggcaacagaagccaaaattgacaaatgggatctaattaaactaaagaacttctgcccagcaaaagaaaatactatcagagtgaacaggcaacctacagaatgggagaaaatttttgcaatctactcatctgacaaagggctaatatccagaatctacaaagaactcaaacaaatttacaagaaaaaaacaaccccatcaacaagtgggtgaaggatatgaacagacacttctcaaaagaagacatttatgcagtcaacagacacatgacaaaatgctcatcatcactggccatcagagaaatgcaaatcaaaactgcaatgagataccatctcacaccagttagaatggcgatcattcaaaagtcaggaaacaacaggtgctggagaggatgtggagaaataggaacacttttacaccgttgttgggactgtaaactagttcaaccactgtggaagtcagtgtggcgattcctcagggatctagaagtagaaataccatttaacccagccattgcattactgggtatatacccagaggattataaatcatgctgctataaagacacatgcatacgtatgtttattgtggcgctattctcaataggaaagacttggaaccaacccaaatgtccaacaatgatagactggattaagaaaatgtggcacatatacaccatggaatactatgcagtcataaaaactgatgagttcatgtcctttgtagggacatggatgaagctggaaaccatcattctcagcaaactatcgcaaggacaaaaaaccaaacactgcgtgttctcactcataggtcgaaattgaacaatgagaacacttggacacaggaaggggaacatcacacactggggcctgttgtggggtgggggaagggggagggatagcattaggagatatacctaatgttaaatgacaagttactgggtgcagcacaccaacatggcacatgtatacatatgtaacaaacctgcacattgtgcacatgtaccctagaacttaaagtaatatatatatatatatatatatatatatatatatatatatatatataaaatcaattctctaactgttaaagaacattggccctttgtcagatgagaaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtgtaaggtgtaaggaaggggtccagtttcagctttctacatatggctagccagttttcccagcaccatttattaaatagggaatcctttccccattgcttgtttttctcaggtttgtcaaagatcagatagttgtaggtaagcagtgttatttctgagggctctgttctgttccattgatctatatctctgttttggtaccagtaccatgctgttttggttactgtagccttgtagtatagtttgaagttaggtagtgtgatgcctccagctttgttcttttggcttaggattgacttggccagaatctacaatgaactcaatcaaatttacaagaaaaaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccactatgagatatcatctcacaccagttagaatggcagtcattaaaaagtcaggaaacaacaggtgctggggaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaacaatgatagactggattaagaaaatgtggcacatatacaccatggtatactatgcagccataaaaaatgatgagttcatgtcctttgtagggacatggatgaaattggaaatcatcattctcagtaaactatcgcaagaacaaaaaaccaaacactgcatattctcactcataggtgggaattgaacaatgagatcacatggacacaggaaggggaatatcacactctggggactgtggtggggtcgggggaggggggagggatagcattaggagatatacctaatgctagatgaaaagttagtgggtgcagcgcaccagcatggcacatgtatacatatgtaactaacctgcacaatgtgcacatgtaccctaaaacttaaagtataatttaaaaaaaaaaaaaagtgcactgttgcaagggaggccttgaggaagagatttttttgaggggagaaagcaaagaaacatcccttagttggaaggcactgttactctgatggagtagacatgtgcctttccaatacttaaattctgaccaagaaagacagtaggtcaaaaaaaaaaaaaaaaaagaaaaaaaaaagaaaattgggccaggcacagtggctcatgcctgtaattccagtactttgggaggccaaggcaggaaaatcgcttgaagccaggagtttgagaccagcctgggcaacatagaagaccccatctctacgaaaaacaattgaaaataatagccaagtgtggtggtatgcatctgtagtcacagctactcgagaggctgaggcgggaagatcatgtgatcccaggagttcaaggctgcagtgagctataatcataccactgcactccagcctgggtgatagaccaagaccctgtcaaggaaaagaaaagaaagaaaagaaaattgaagacaggaggacaaactgattttggttgtggatgagtgcgtgggtaaggaagatactgataatttcaggttttaaaatgttaggttaaggtatttggggctgggatgttgcatgattattttatttttaattttttaaagtttttatttttattttaaattccggggtacatgtgcggatgtgcaggtttgttacataggtaaacgtgtgccatggtggtttgctgtacctatcaacccatcatctaggtattaagcccaggatgcgttagttatttatcctgatgctctccctcccccaaccccaccacctgacaggccccagtgtgtgttgttcccctccctgtgtccacgtgttctcattgttcagctcctacttataagtgagaacatacagtgtttggttttctgttgctgtgttagtttgctgtggatagtgacttccagctccagttccatccatgtgcctgcaaaggacatgatccatttatcacaaacctacagccaatatcatactgcttgatgattttaaaccaaacacataggattaaagttcaggagagagatgagggctaaagataaccattttaacattctcttaatagacatgacagttgaacctatggaagtggaaaggattcatgatagagaacagtgtgcacgagaagataagattaaaagcagaaattagtaatgccagttgttttattggctctgattcctcacctaccctcgcatccacacccttgtagaatttgaagttccatgcacaaaaaggggagagtacgtaatacgctgccccctgatgtttagatctttgacttgctttggccaatagataaggcagtagtgacagtgtgccagttcctagcctaagcttaagatattttgcatgtgtctgtttgttgtcttgagcctctgccaagaaggtcatgcctgggctaaccaacttgtcttgggtaaaggatgaatgacatgtgaagcagagcccagcctacattagccagcctcagtctacctagacactcatgagctacatcaatgcctcttgtcatattgttatgggcctctgagatttcattatttttgtgattgttattattgttatgcagcatggattttgagttctggagagaggctcgcggatagatatagaagattattttccaagaaacagtagcggaagctgtgaaagtgaataggggccttgaaggagaatacaacctgagaatgcctacatttacagttttggaggaagtgtggagatgacagagaaggaggctggagtctagaaggagaagacagggttagcacagcctttagatttggaaaaatatttgcataatcatatctttaccatttactagcaatgtgaccttgagcaaaatatgttttaaaaacatacaaaatatgtttcaaaagaaatatcaataaaactgaaacattaaactcccaagtcctcagttttttcatctgcaaaatggaggaatgaggacctatgttgagtattgctacaacgagtaagtaaacttatcacggtatgtgttaaatctaatagaatgcacagtaaatgttagctattctctaagaaactcaatagttatgatagctaaaatgttgcatacatacttggtgagatattgaaaatatatttttagaagaaaaaggatgcatctcaaaagagaagaacaaaatgaaaccaaaggctggggagagggaggaattgggagttgtttaatgggaatagagtttcagtttaggaagatgaaaaagttctggagatagacgatgatgatggttgcacaacaatgtggaagtacttaacgctactgaactgtacacttaaaaatggttaaaatggcaaattttatattatgtatatgttaccacaataaaagaaataaaagagaaaacatttgaatgaaaggaaacttacaaaatgtaattttaaaaaatacttagtaactaacttttcgactgacaagtattagatcagagatataataagtgctcaatcgctgtttttgtaaataaaaacatggtagcagagagagttcccccagaaacaaggttaggagtagccacagtagattgacaggagaccttgatggcctatctctactcatagccaattaactttaataggaaaattgttgattttcatttgggatatcacgtttgggggtgaaacacccctggggggtggtctggcaatgcagaggttcatgggggcttttgactccattttagtaatttagtcttcactttttgttttagaaataccaataacatttcataaatcatgtgaggttttgagataaagctcaactaaattttagggaatgttttgtgcaaattgtttactgtttctgaaaaggacatttctttcattactaatttgtatgaatcattttgtaataaacaagatgagtttgtgcccacgacaatgacacatctagttcttttaataaaaaatatgttttagaagaaaaataaataaaaatgaaacattaaggaggcagatgtccaaaaacatattttaaatggtataaatttccatggcctataggtttttagccaagcgcagaaatttggccaagattattgagggaaagctttggttgttaaaaaagggggaggtatagttatgtgctccagtaagtatataatgtatagctgctactcaaactgataattttgatgaaaccaaaataatgttccctaacatgacactgtgattgacacagagcctagggaatgattgcttcaggacgcaacttttccttcttgataaatgtattaggaaaatgtttaggaatgatttcacaaacttatgtgtaccttagtgacttatatacttttactttccaagaaagttcttccttctgcatgaaacacatatcctgcttttaaggaaattatactagaactgggaaaagtcaacagagagcaatgtaagacaatctatcttggatggcatggctaccaccattctacttcaggtccatgacagacattactaattgatcacaacatactgttgctgagcctgtgtacaccctcgctttttcaacgttgtgctccaagcagccattgtcagttatggtttttctgtgagatggaacccatttttcatcccgtattagaccatatggctatgagaatttacagataggagaaaccagtgagggtggaattcaaagcctcatgggaatggatagtaggatcaagcacacagaagtaaaatgtgtggatgagtgtgtgtgtgtgtgtgtgtgtgtgtgtgtgtgtgcaatgcatagacaaaggtgaagagggcaatattagggagattcagttgatttgttgtacagtaattatcaagaactttggaaagtaaaagtgggtcaaatcaagaagatactgaaaatcacatagaggactttaagtttccaattattcaaatagagaattgtttgataactagacgagtgaagcctgtgcataccaaatagatgagaaatgggatatagtaggcataagaggccattgggtctcaaatggaggcaatttgtcttctcaggggacatttggcaacatctgaagagattttggttgtcacagctggcagggtgttgggaacggtggggtggtgcggttctgctgatgccacggccagggatactgctgaacatcctatgttcaggataggatatcccgagaggatattcccccacgacaatgaattatccaggccaaaatatgagtagtggtaaattgagcaattctgctataggctaattgctgtaatctgtaaccccaaatctcagtgatttaatacaacaaaatccatcttgctcatgaaaagacaaaagcaagtattttaggtgaggtagaaattctgggagttctccttcaagaagtcactcaggaattcaggcactttccgttatgtaaaaccactttttttttttttttttttttttttttgagacagggtttcacttcgtcacccaggctagagtacaatggcaaaatcttagctcactgcaacctccacttcctgggctcaagcaattctcctgcctcagcctcctgagtagctgggactacaggcatgtgtcaccacccctggctattttttgtatttttagtagagatggggttttgccatgttgcccaggctggtcttgaactcctgagctcaagtgattcgcccttcttggcctcccaaaatgctgggattatgggtgtaagccatgatgcctggcctaagccactgtctttaatatgtagctaccaaggtaggcatggaaagtgaaggagagtgtgttcatagagaagtcgtccttgctcttacctgccttggaccagaagtgacctatcaatacactcacattcctttggaaagaatttgtcgcatggttccacctagatgcaaggtgcctaggaaatgtggtttatctctgtgcccaaagataaaaagaactgggtctcatacgtttcagtctctcccatactgggagagactggacaaataactcagctagaaaactattacggattcagtgccaagttgtaagcacctgggcaagtgatggcataaggacagagggcttagcaagagactccatttaacaggtaaaacagtgcaagtgtccaaagtaagtcaacaatggcaagtcttggatgttacgccttccaactaactataatctctgtaaacgtggtcttgagtcttgctgctctttgaagtctcaacttgcttgggcacaggtttatgacccacagtccatgcaagaaagtatggatatatagaaataaagtaggaaagaacaaaatcttgtgggtttttttgttggtggtggtttgtttttgctggggggtcctggaggagggaatgattacttaagatttcgaacatgatgagttttcagtaatggtagaatattctaagagctgggccctaaaccattagataagagggcagtattgcagatgtagttttggaggcaatcatcagttgagtggatttcactactatatccctggagtccagttcagagcctgacatggaatatatggttaataacattttgttaaatgcatagatcaacaggtatttgactaacataaataagggaaatgatacttttccctttcattaaaatgaaaataaacctgatgcttatatatctttgtttcagttagctattgatgtgtaacaaaccatcccaaacctcagaggcttcaaacaatagacattgattatttgccatgtatttatgaatcagccagatgatctgtctggtcttggctgggctttcttatgcatgtgcagtcagctgtaggtcatggagaaggctctgctgatcttggctacctctttcatatgtttggaagtcagcaggtctagggtggtcatgcctgagaaaactgggttcttttccatatggtttctaatcttccatcagattctcctgggtttttcttatggtgtggcaaggatctatgagagaaagtggaaacactcaagatctcttaagatctaggctcaaaactgaagtaccatctcttatgccaccagatgttaactaaagcaacacacaaggcctgctcagattcataggtggagaaatagacccaactcttgatgagagtaggtgcaaagtcacatttcaaaggttgtatatatggagaaactgttaataggctccatcagtaagataaactcaccacagtctgggaggaggttgctacatagtgtggaaagagagaacactaagcttgatttattcacttctgagcatcctgatctccatggtaattaatgagatttctaaaataatttccaggttatgtttttattactcttgatcagtgaagaattaatttgaaaggcctaaggtttaccctgcactttaaaagtaaatagctatcacacaaaactaatctccttataggttaaatcctgtcacaacttgccccaaatgtatcctatccattttcatgtcatggtgcataaagaaaacgcgtggtggctcacacctgtaatcccagcactttgggaggccaaggcggacagatcacaaggtcaggagatcaagaccatcctggctaacacggtgaaaccctgtctctactaaaaatacaaaaaattagccaggtgtggtggcaggcacctgtagtcccagctactcaggaggctgaggcaggagaatggtgtgaacccgggaggcagagcttgcagtgagctgagatcatgccactggactccagcctgggtgacagagcgagactctgtctcaaaaaaaaaatcataattttgtggcacgctagagtaaaaggacaaggctgcttgtgattatggggctctgacttccccaggtctgtttcacctggctggttcaagggatgagttgattaccacctccacacacctgtaacccaccagcagagtgagccaggtaggatgttctgcaatggaccaaaatatcaatgggtccagggaatcctatgacttagttgcaggatcaggcatagaggccaggtctctagaccttcagtcccatgccttctttatggaacgatgttgtcttcagagatatgtctttaatcagcacatgtttctcagttatctgctgttagccttgaaatgtgcaagacacctgaggggaatgtatacactgtacaaggcatggccactgtcctcccaggggttaggaaagaaactctcgtacacccattttgatttcctctctgggtgcagtatcaatcggtataaagtctaatgcaaggtaaggaggcaagtgccatttcttctggagtagcaagcattgcaaaaatgtctccttcctctattttaatcactgtatttggatgcaaaataatccagcatagcacaggaaatataatcaatttactcaagaatccctggcaatatgatacaatagcaggcttgtataacccattcaggaaccatagatcctctgattcttctacgtttgtgtcattttaattatgctcatttcctgtaatgcaattactaataattatttgccgctctattgtaggggaaaatcacttacatattgctgcatagtaaaccacttcaaaacttggtggctttaaggagaatcaaaaagctctttttggaaagagctaggtagtaaatattttcaggtttgcaggtcatatgttctctgtcccaactactcaactctgcttgtagggctaaagcagccataagcaatacataaataagaatggctgtgttttaataaaactttatgtatagatgctgtgatttgaatttcataaaattttttaggtgccacaaaatcttcttctgatgtgttttctacccttaaaaaatgtcagatccttgaatggtttgctgatagaagctggatttggctcgaaggccttaattttccatctcctggcttaaaacggccatcactatcactccgtagtcttcagattggttgggagtgcacaatgcaagcttgggcttttttactctgattcaggttctagatccatgtgaccttggattcttaccaaaatgggaataacttttatccttgtgtattcattctgggacccaggatgggtggcagcagcttttttcatagctgtgacacggaaaagagtacaagctcaatcatccaagtgcatctgtggcctcaagctggctaccatgtcattggccattccatactatcgcatggccaaatccaaaatcagcaggcaggaaaatatcctctttagtgatagaaactacatagggtatgaattcagggagccatgaagaattggggccactggtgccgcctatcacactcaccttcccttttctttattgaaaaatataatgatctccttatttttcctccaactttcttctagacagaaaagaagggcatatataatctattttagattatttctggaggggataacttcctatgagtacttctcttagtcatctgcaggaaaatgctgtttataattttgccctgatccgatatctgtcatgcaggaaagtacacattacatatctttggacattccacagcttaatctgatacaccaaaggtcaactgaatgttttccttgagagaattttgaaacaccaactgctatctctgaattttctttgtttggcatctaaaggtatccctgttaccctagaggtcctctcattctgaacacagggaggtgagaggagttattcctggaagtggggcctatgaaaccactggaccttttcctgacaattgctatacccacgtcactgagcgaggactgtttaacctagcttttcttgcctttagccacattccttccactcaccatttgttgatgcaacttttaacacaggacaaagtgtcttatgtttttctaaccatctttgctttctggattttcttttctgataaccttctggattttagacttacgatttcaaattcctgaatggaacatttctcaaaacaaaaaccactttttaaaaatatgtaccctgaatttaaaaagtaatagtgaacagaatgtagcaaaatatcagggaggactgagaatgtgaaggtccacctgataggctaggagggtcacttagcttggcagagcctcagtgtttgcatatgaaaagaaaagtcactcccaacttggaaataatttgattctgaggttccacaaaatgcatatattcagaattctgtgtagaatttgaggtacaacttaaagaagacatctctgtcttctatatataggctgtatattgggccccaaacattatttttcagctccctagctatcccccttcttttctacttccaccccttcctggtcctaggtacagaaatctcaaattttattttgtttagctgaataatattagttgtggagatgctcttaaatatatgatgaatggcaaataaagaatttgggggagtttccccagtatgatgaactctgttaactgtcattgtagggatgagatattttgatcaaaagatcttctcatgggattatgatcaacactgtaagtagatcgatcacttgtttgcagaggtttagaatcaatagcataacttagtacccaaactcagatgggtataatttgaagttttccttaatgattccaatatcaaggttatcactatgttggtgagggatggtaaataaagaaacctaaatgataaaatgccaaatggccaaatggtgactaacttaccatatagatcgcatgtgtgatgcgtgatatgtgtgtgtgtgtgtgtgtgtgtgtgtgtagtatgagttggctcaggcatgaggcacattttggaatttcatcagcatttgaagtagtgaagagacgaggaagctgagattcgaaaggggtggggctgaggaagtgatggttgaagggatatctttgactccagagactatgccaagcacaggaggcatacagtggaagactggagaggtgagcatattgcagaaggactccagtccttgggtgggtccaaaggcagctggagtcagtccttgggagcaatgaaattgtcaggctaggaataccccagccaagttgactggtatgcagcttagaaggaaatggaaagacggacttagtggcatggagttaggagttggggttacagtcggggtcagggcaagcctgcatctctgaaactacagctatttcttttctccctagggttgccaggtaaaatacaggctgctcaggtgaatttgaatttcagataaataatgaataatattgccagtatgaatctgtcccaaatatagcatgggacatacttatgttaaaaattagccaggtgatgtggctcactcctgtaatcccagctacttgggaggctgaggtgggaggatcacttgagcccaggagttcaaggttgcagtgagctatgatcgcaccattgtatcatagcaacagagcaagactccgactcttaaaaaaatactcattttttatgtaaaattcaaatttagctggatgtcctgtaccttatttactaaatctggcaaccatacctacccacatccatgctaggtaaacaccctgtacttttctttccttgtacctttccattatttgggtgatttcttcatttaataattgtctccctcttgagaaaccaagttccacgagggtgttttgactttcagcatactttgtgcaaaaacataggtgaggctcaagaaatatgtgttgaatgagtgcatactactttattagcagtgggactataagtaccactagaagtctctctgaggctgctggccaaagttctactctataataagggctttaggattttgtcagtagaggcaactgcaaggagctgggggcaaagtgggggattgacagtcccataacttcatcattattctcatatttaaatacacatgtctgcctgggggcacaattgcctctgtggaaatccacagccctagatggaaaatcagatggcttgccctgtcattaattggcacaatggctttaggaaggttcctcaacctttagaagcctcagtttctttctacaaaataggagtgaatctcctgactcatgggcactcacaaggattgagaactcatgaggtgaaagtgtgtattggaaataattatgctgtttttttaagaagatacaaatgtacactttatgccgcagaaacagtagaggcccctgagataaatttccctgtcacctgagcaaatatcccttgttttaaagacacggagactgagatgtggaatctttcttattcaagcacaccctcagtcactgttcaaaagctgtgctgccatgtccatcccaagtgtcactggaaggtcacatcctggagagtgtagggaaaggagtccccctgcaaagagccaataaccgcccttatttctgaagggtcacagagtcacaaacctctagatatttcttaggaattcctctccccttcagaatgaggctttaatgactcaactttctctactgaataatcagtaggggttcaagagtatattaatagatcaggctcaattaaacaaacatttctggagtcctacaaggctctgtgcttagggaaaacagtggagaaaataaagatgattaagacactatgtactatgaaaaaatgctcaccatcactggtcattagagaaatgcaaatcaaaaccgcaatgagataccacctcatgccagttagaatggcaatcattaaaaagtcaggaaataacatgctggagaggatgtggagaaatagggacactttcacactgtcggtgggactgtaaactagttcaaccattgtggaagacagtgtggcgattcctcaaggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccatcaatgatagactagataaagaaatgtggcacatatacactatggaatattatgcagccatataaaaggatgagttcatgtcctttgcagggacataggtgaagctggaatccatcattctgagcaaactatcgcaagaacagaaaaccaaacaccacatgttgtcactcataagtgggagttgaacaatgagaacacatggacaaagggaggggaacatcacataccggggcctgtcgtggggtggggggctaggggacggataacattaggagaaatacctaatgtaggtgataggttgatgggtgcggcaaaccaccatggtacgtgtatacctatgtaacaaaactgcacgttctgcacatgtaccctagaacttaaagtatatataaaaaaggagactatgtactgtcttaggaagaaaaagcccccactcagataatgctaatgtaagagcaagacaaaggctgaagagaagaagcaaacgcttctgactgagagttggggagaatcgtgggagacttcagggaggagggtcttgtaggttgcatagaattgatgtaatccccgttcaagctcttctgtgttctttttttaacttttattttaggttcaggggtacatgtgcaggtttgctatataggtaaactcttgttatagcggtttgttgtacagactattccatcacccaggtaataagcatagtacctgctagttatttttttctgctcctataccctccatcctcaagtaggccccaatgtctgttctcttctttgtctccatgagttctcatcatttggctctcacttataagtgagaacatgtggtatttggttttctgttactgcattagtttgctaagaataatggcctccagcttcatccatgtcccggcaaaggacatgacctcattctttttgtgtctgcatagtattccatggtgtatatgtaccacactttctttatccaatatgtcattgatgggcatttaggttgattccatgtctttgttattgtgactagtgctgcagtgaacattcacgtgcatgggtctttatggtagaattatttatattcctctgggtatatacacagtaataggatttctgggttgaacgttggttctgtttttagctcttggaggaattgccacactgctgtccacaatggttgaactaatttacactcctgccaatagtgtataagcattcctttttctccacaacctcaccagcatcttggtattttttgtctttttaatagtagccattctgactgatgtgcgatggtatctcattgtggttttgatttgcgtttctctacttatcagtgatattgaagttcttctgtgttataacactcaataatagtatgaaacctcaagttcacgaatctgtgccatttacatgtttgactaacccaagcataaaacaaggggaacacaacctgcctaggctgccacagagagccaaacgggagctcataggtgaaagcgtaatgcactatactggtgggaggttggtcttatttactggcttgtcatctgcctagtttggactctgttgcgccttccttcattatgttggtctttacggggaaaatttcagggaagctcccaagtttgctcaagaaaagccacccagactttacagtcattttttactttgaaaaaaacaaatccaatcatcttccagatgttttcatttaccaggtctaaggaggagaagtacaaaaaggaagacatgctaacttttgggtttactcttcccattaaaacttctccaatgtgacattgaaatatctttctagcattgttggtggctgttaaccatttttgttcattttctccccatgtgtttacctccaggaaaggcatgaaaccaccattgtccattccctgactttaactgtgtgtctcttcagtctcagtcttctggctcagtaagccagtgggtgtgtatgtgttttcctcattcagctaaagacctgcttatttgcacttaatgtgagtaaagatatagttggggttttaatcaataattttcattgcatcttctttaatagctttttggtgaacaagtttagatatgagggtttaaaagggttctacaatatttatttatatagttaagagacggattcttaacgggggtaattttatccaccagagggcatttggcaagatctggagacatttctgactgttacaactggggagtggtgttggtgacactgctggcacctggggggaagaggtcagggatattgctaaacatgttacaatgtgcagcacagcctgacaacaacaaattatctagtctaaaatgtcaatagtacagaggtggaaaaaccctaatttaagatatgtactctacctgctttccaaggaagcttaacaaattaaacataataacaaaaagtaattacaaataaaagtagaactgaaacagaatagaaggagcagaagcaaggatgtcactggagtcctgaaatgacttaatcattagggttgaatatttgattgagttctgtatttcccaacaaatgagaaaaaaagaaacagttcttgggtagcccccccccaaaaaaaattgatacataactccatcagccaagaccacttttttttcctgccattgattttaaagagaaatatatcttgtagggcattatatgtgggacattgtataagaaaatagataatttttcaaccacggttttgcaaaagacacagatgtgtgtgtgcatgtgtttgtgtgtgtgtatgtgtgtctctttgtgtgtgtgtgtgtgtgtgcaaatggatatttctggtctaaattctctactaaaacggtagcagacagtataacattaggttttgtgagatgaaattcatttctttgagttgcagaactaatacattctgggtattgtctttgcttgtgatcaaatgaataaagagtcgtgtctctgaagatccgagagagagaaagaacgtttccatcgaactttgggaatctctccctggattatcaaatgactgcaacgagtctttggcaagggctaaagagtaatcaattcatggtagcattttccagtgatcatccaaagtgtttgaaatcatttgatagtgtttattcctagtctgctgtggatcagtctatttgttaggctttggggacaaaaagattattaaaatgtagtccctgttttcaagtagcaggagtctaaccctggcaagaacatatataaataatcatgaattaatacacacagtcgaggaatgtgcagtgtgccatgggaacccaatggaagaagcgaagtttcactgaggaaacaggagatttgaactgtgtgggttattgaagaagtcttcacaagtcttatttgtaaatacagctgatccttgaacaatgaggggttaggggttcctaccctctctgcaatataaaatctgcatatggctgggcacggtggctcacacctgtaatctcagcactttgggaggctgaggtgggtagattgcttgaggtcaggcgttcaacaccagcctggccaatatggtgaaaccccgtctctactaaaaatgcaaaaattagccagacgtggtggcgcacgtctgtaatcccagctacttgggaggctgaggcaagagaatcgcttgcaatctggaggtgaaggttgcagtgagtcaagactgcgtcactgcactccagcctgggtgacagagcaagactccatctgaaaagaaaagaaaagaaaaaaaagaaaatctgcatataacttctgactccccaaaaacttaactactaatagcctactgttgaccagaggccttgcagataacataaacagttgattaacatgtattttgtatgttatatgaattataccctgtattcttccaataaagtaagctagagaaaagaaaatgctattaagaaaatcataagaataaaatatatttagtattcattaagtagaagcagatcatcataaaggttatcatcctcatgtcttcttgttgagtgggctgaggaaaaggaggtcgaggaggggttggtcttgctgtctcagaggtggcaaaggcaggagaaaatcagcatataaattgacttgcatatttcaaatgcatgttgttagagtcaactgtattttataaatgtatgaaatgggtgcagaaaagtatacaaatcataatacacacctcactttgttttcacaaagtggactcacccatgtgactatcatcagatcaagaaataaagcatcatgagaaatagaactccagaaacttctcaggcctccttttccaggcattatctgcccctgtctgccaaaggtaatcattatcccaacttgtaactccatagattaattttgcattttatacaaatgtaatcacatgttatatattactttgtgtctggctttaacatttttgtgacgttcagattgtcacatgtagttgtaattaatgtacttttcattgccatgtagtattccattgtatgaatatacaacagtttattccattgatgaacatatgagttatttccaggttttggctattgcaactcatgcattgttgtacatgtttttaaataaacacacttgtgtattgcatgtgtctatacctggaaatgaaattgctgaggcttcatttgtatataaacacacacacatgtgcacacacacacacagttgatctttcaacaacacaagtttgaactgtgtgggtccacttgtatgtagattttcttctgcctctgccaccctcgagacagcaaaacccaaccctcctcttcctgctccttctctacctactcaacataaagatgatgaggatgaagacctttatgactatccactcctacttaatgaatagtaaatatattttctcttccttatgattttcttaataatattacttttttctagcctactttattgtaagaatacggtatataatacatgacatacaaactaagtgttaatcgactgtttatgctgttgataaggcttctggtcaatagcaggccattaaaagtaaagtttttggggagtcaaaaagttatacacagatttttgactgcatgggagtttggcgcccctactcctctcatgttgttcaaatgtcagttgtaatttagttttagttttccaacctgcttgtacaaatttattctaaccaacaatgtattagagcaggaactggcaaactatggctagaagacctgttttgttttgtaagatcacagctcactgtagcctcaaactcctgggttcaagtgatcctcctacctcagcctcccaagtggctaggactaccggtgtgcaccatcacacccaggtaattctgtaactttttgcagagttgggatcttgctatgagagaagggtggtctcaatttcctggtgtgaagcaatcctcccttctcagcttcccaaagtgctgggattacaggggtgagtcactgtgccagcttgtaagtaaagttttattggaacataatctcagtttctttttaatgtattgtctatgtcagttttcctgtggcaagggcagagttgagtagttgtgaaagcaactgtatggcccacaaagccaaacatatttactatctggccctttacagaactaatttgccaacctctatattagagttatgagggtttcaaaaccttgccaacaaccacgctgttgactgtttcatgtcagctcttctagtgtgtgttctggtgggtgtttcatgaatcatgttatggcattaatgtccatgatcctattgaaatcttcatatacattataaatagagcttacaagagagagttgtcattatggttaaatgctgagctccacttgagattctataaccttcccccccaaaagacttgatttattttatatgatttttctaaagtgtatactagtaatttcattttgaaaaaaaggtttctctttgcttcttctttttttttttttttttttttgacagagtctggctctgtttcccggggtacagtgcagtggtgccatctcggctcggctaactaaaacattcacctcctaggttcaagcaattctcctgccttagcctcctgagtagctgggatttcaggcatgcatcaccatgcttgggtaatttttgtatttttagcagagacggggtttcaccatgttggccaggctggtcttgaactcctgacctcaagtgatccacccacctcggcctcacaaagtgctgggattacagcgtgagtcaccgcacctggccttctctttgcttccgaaacttaagttgtgggatttagtgaaaaattattaaaatgtactttggaaaagggtattttattctcagtggagtacagcttagtaggcaagtcaataaggagagggaacccccatggatgaagcaggtagatgaccaagtgacttgggaagtaccttccaaagaaaggaagggtccataaatatttattgatagaatgaaaagaagaaacagtggttcaggtggctcaatgccctttcaagtactttcattttataaaatcacagaaaagtttctacatgtgactaaacaattttctcccttcttcagatatcctcctaaagactctgttagaaaatagtattactcttccagtaagaaaattatgcaaataaaaaaacccacgagacctaggtatctgaatcagtctttgagaagaaagctgatgtgcacactcattaaactgcagaatatggctcagtaagtctttctgtctcaagattgtttccagctgaagtcacacttggcaaatctgaatgcctcagaatgtaaagatggcccttgtccaggggcagacctccatgccgctgcttcctcttcccatttgcatccagcagtgcctgggagaggcaaggatcagagtcccttcaggcagtaaggatgaaatagatgaaaaatgagaacattaacactgggaaccagaagtcagggaacctagagcccaagatagcaaaaagatgtgagaaaacagtcgttatataaacacctaaaagttggagaaacctttgctctttggagaggaattactgcaagaagactattgagaggatctttaagtcctggaggccccagaggggaatggagagggagaatgaggagacaccattttgtttaagaaagcaaaggagtggagaaatacaggactactattttgaagataaacaaattaatagaaaaaaagtcctacagtgtgtttagaaggggaaaaaaaactgcttgcctgaagttgagaaaacatttccataaatgtaaacttcacaaatatcttcacatcaagcacatgactgactaaagatgaatgactcccaattccgcaataaacattagggttcatctacacacacaagtcagcttgactcaatgtattagaaggagaaaaggtcaagtcaatgaaacaaccagtccttagagtgccaagtacctgatttgcctgcatgttttcgttttcacttgttttggcattcttagacatagccagaaaatattacaacagaaacatctcattccaggatgttattttagttagtgggacagggaaggggagaagtgctttcctagatataacttagttgataggtaccctggttcttaaaatctgtattggaagttaccagagaccctgaccaaatgcagcatagtatgttcatgccaaaatgcctcctcataaatatgtacaattatatgtcaaataagcaaaagaaaaaatgaaataaattgcttccagatattgctcttttaccaaatggtttcaaaacatggacaggattattgaggtcacctcttctacctgtgtataattgttttatttcaacaacaacaaaaaagtatttgagaattgggacattattttatttttttttaaattccctttgcccacagatgcttcgatatactcaaactttggtttactttttactatttactctgtgaggtaaatgttaccccactttgattaaaataagaccaaagttcaggaggctgaaatgagtagcctaagatcttatggtagggagggcacagacaggttttcctactctgacacccccactggactgagcacatagtgggccctttatcaatgtcttttgaaggagtgactgactgaatgcacagatggtgagagtggaatgaggtggagctgagtttgtgatatagatactcctccttctttagtcatctggcaacaggcacagataaatttttggagttaacgaaagtgaaagaaaatgagagtatgtatgaagttctcatccattgcatgtaaacatgaaagcctataaattgtaccacctctatggagagcaatatagtggtgtctattaaggtggaagattccaggctcttgaatcatcagcttcacttctaaatacatactctagggaaattctcatatacgtgcatgagactgttcattgcaacattatttgttatgggaaaaaatcagaaagaacatacccttatgagaatagataaattaattatgggataatatttcagtaaaaataagtgaaatgggccaatatgtgtcaacatggataaatctcaaattttggcaaaatataatttatatattgaaattcaatcaaattcaagcttacagcaacaataatgatatgctgacttatattctagtatcctattctgattgcaagataaagaggtggcagccaattgtgcacaactttggggattatacccgcatggaagaatgtcgtgtatgtgagcatcattgtttggtgtgttaaagtgaaaaaaggaaggttgagaaccattactctagagttttgttgttcaagtagtgatcaattaggaagaaaaattttcatgaactctgtcttagctcaggctgctataacaaaataccacggactgggtggcttaaacaatgggaatttatttctcatagttctggagactggaaaatccaaaatcaaggtgctgacagattcagttcctggtgaggcctctttacctggattgcaaatggaccctttcttattgtgtcctcacatggcagagagagagagagagagagagagagagagaaggagggagggggaagggggtgggaggagggaggcacactctggtctttctcttctcataagagtactaatcccatcatggggtcccaccttcaagacctcatctggacctaattatcttccaaagaccttgccttcacattccattacattgggggttagggcttcaacatatgaattttagggggatacattcagtccataacagattcccagtgttgacttactctaattttactgaaatagggctatagttatttatgtaagactatgaataaacttcttatgttcagaaatcttatctatataatccaactaagttatttgtatcacacaaacatggctggatgtattgcattagaaatttatgtttctgatgatcttacttaaaatacaggcttcgtagcatacagtaaattcactttgatggccctcagggaaccacaaaaagttaagtcctcctcctccacagcagttgaagccaaagcagaagaaagaagatctggtgatcactaaaccaataaaagatgtatccatagcagagaaaataaacagaatttcaaatatgggccccaaaagaaagtcaccaaaatagtcaccacaacttgtagggctgatgtgtgatacagcttcccactaagcagctctttggtgctacaaaataaggggcaggaggatttatgtattttatggataatgattctctgggatattcctctattgcattgaaaccacctactactaaatctattaatcaaaacaaatactttatatgtaacaatcagtaagtttcacagtagtaatattaatttaatttgacagatgatttggctttgttaaaatccagtgatggatgtatggttaaaaaaaatgaagacttgggtccaactccatgctttgatttcaataacacaaatgtagaaaatgtctgtctgtataagaatgctttaaaatgttacaaataagcacaataattctttttttttctagttcaaaataatctgaatacatttaactgaaatgaatcactctcaaatgtcaactgtaatgaggaacacttgataattttgtgaatgtccctcatttatttgaatataaagataacacacagctttttttagaatcttatagtagcagatatataagataataaattttgtaataagcagtagctcattcttgtgctaataaaatattacaagcacaaaaagataggatatacacaagaaatcttcctgtgtatcagctaggctacttttggctgcactaacagagtacatgattgaaagttgcttaaatagtaagaacattttttatctcacataagcatggcattagatattactgtgtaacaaattatcactaacttagtggcttaagacaatacatatttattatctcacagtttctgtgggtcaggagttcagacacagtttagctgatttctttgcttcagaagttatatgaggctgcagttaaggtggcagcctgagctggggtcttatctgaaggctcaactggtgaaggaaggccctatttaccagcttaccctagttgtttgcagaatctccttaaaggccatttgactaagggcctcaccttctcattggcagttggctggaggccaccctcctccactccttgcctcatgggtctctccaatatggcagcttactttatgaatgcatgcaagccaagaaggcaacagcagaatcaactgtcaagacaaaagttacaattctggcaatgacgtcccatcacctttgccatattctatttgttagaaggtgctatggagtctatttgttacagcacctttgccatatttgggtagaccagctcacgctcaaagggaagagattgggtaggggcataaataccaggaagggaaagaggagaatccttaggaccaccttagagtcagcatgccacagacataaacctggagcatggttccaggattacctcagggactcagtgactacatttacccagatacagttcatctctcttccctggctcagagatgtctctctccatgtagataggctacagccttaccaggtgctgtgtgaaagagcatactcaggtgaagaaaagagggaatttcaatttttgttattttggaaaaaaacctttcccaaaagtctcctgggagaagtcccgtcaagtctcatttatcaggattgggttgtgtgtccatatccacattgcaaaggagtctagggaagtaagggcaaggatatggcatttttgccctcagtaggaggtaagtctctgccagagagaaaaggaaaggggtgggtgggggcagaggctgggaatgttccaccaactactaaaagacagacttctttaagggctaccttgtgttaacatgataactgaattttctgcctctattctccttacttgagatgttcattcatatagtgcgctatgatgtcattgggtctttacttggctcaaacattattgtacagacaaatgcaaatataggtcctgagactgcctgaggttctctattactgatatgattatttttgttccaatatttcctaaatatgttaagctagttataaaattcttattcttaaatctcttatctgtaaatgtttttctttttgtacttcttcaaacaaaagtgactggctccttaacttccaaccatctagagtcatttatttagatatgcaaaggtaatcatgaaaataaaaatagatggtagaatgagcctttgatctaccctggcttttctgcaaaactccccagataagtacacaaagggtgagttgtttacaaaaatctctctgtaatcagagcaggacctgtgaccttcagcaccttagactatgagggttccagacttcctttcaggttcctcaaagcctggtgaccacctctcagaggtgaacttacttccagtcaacctagctgaccactaggagtatgtgtgaaatgactctgaaagcatctgctcttgcagaacttcttttcaggaaccaaatctctactcttttatcctataatttgctgttgttgatttggattcaagtgaataaacttacatttatccttttcaaatacagtcttatttattaggtccatttgccatgaccttctgaatcttgcttctgtaatctctcttaattaatgtaaggctccatgttgtgttgaccacaagtttttatagcatgtccaggcatgtttaccaactgagccaatgctcagttacgtcccaaaggatctgaccattttgtgtggattttaaaagaaaacatattagaaggaatacactgatttttatttgttcatttaatgcagtggttctcaacctgggttggaggggaggatttgtccttcagaggacatctggctatgctggagatgtgtttgttgtcacagtggaggagggaggcatgttacttgtgtctagtgggtagataccagggacactgataaatattatctaatgcacaggatgccaccatccctgtaacagaaatggtcccaaacatccatactgctgtgttgaggagcccagttttcatttcagaaatggagctgggcatggtggcatgtgactgtagtgccagctacttgggaggctgaggtgggaagatcacttgagcccaggaatttgaggctgcagtgagctatgatcctgctattatactccagcctgggtgacagagcaagacccatctcaaaaaaaaaaaaaaaaaggcattctgttttgtatgggaaatcttacataacctttttctgtcagtttgataggaatttttacgaaatattttgatgcttgaatgtagagcccaggtcttactatatttacgtgcgtctttgttctatttctctgttgagcaactctttttgctcttacatctggactccacagctgaatcctctgcttacttgtctggggcccagataccctcaggaatccgaccctattgtccataccccaaaccactggcagttggtaacacaaacacagtcacaccaatgaatagtaaggtaaggaagtgtcaatggacacctaccaccactcctgctggcttctcaatgctattttggccaccatgaattgtgccatctcattgtcctattgctctgcgtcactctccacgcatttaaagtgctggtcaggagcattcagctggctaagcctagttcccatgatgcagtctgagcttttgggatgggctctggaccagagaattcatgtgcatcactctttgaatctattcaataattactgcccctcattgccatgtttgttgattctccagaaataaccacttgtaacagtttgttgagtgtttttgcaaacattttcagtgcatatacagacacatacatagtatgatatactttttatattataatgtgcatataagttaggattgcttaagctgctataaaaggcctccgtgattcagtggcttaaaaaaaatgagatttgttttttctctgcatcgtggcccaacatgtatagtccaggttgataggaagctgtgctccaggcagtcagctggggacccaagatgacactggctttgccatcttcaacatagtccctcaggtcactctggtggtcaccattttgtctagtggtaaggagtgaaactgagtatgaagaagacgtgcaccttgacttaagagacaaggctgggaaaaagcttacttacatggctatccctaactgttaatggggccgagaattgaagtgtagctgggaggccatatgccaagctacaattctattgtatacaagaaatgaagaacaaattttggtggatagcgacctaatcatctagttcattctttctctctcctctttctctcttaacataaataggactatagtatacaagcacatttcattaccttcaacattgtccatgttagtatatataaatattcctttttccacaactatattaactatattattcgtgactcttatgagaatcgtgtataactttcccctatcaggtttatcaagttggtcttttgagtacctctgtttgtttagctgttcattaaatgctcagcacgtataggacttggtcagtagatagcagtgctctttgaatggctcactagggttttctttttaagccattcttttctagtatagaaatttgcattctgatatagaatgtttggtttctaattatttaaaaccatatattgcctaggttttcttctagggtttttatggttttaggtctaacgtttaagtctttaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcgaaaactgggtgaaggacatgaacagacacttctcaaaagaagacattaatgcagccaaaaaacacatgaaaaaatgcttaccatcactggccatcagagaaatgcaaatcaaaaccacaatgagataccatcttacacctgttagaatggcaatcattaaaaaatcaggaaacaacaggtgctggagaggatgtggagaaataggaacacttttacactgttggtgggactgtaaactagttcaacccttgtggaagtcagtgtggcgattcctcagggatctagaactagaaataccatttgaaccagccatcccattactgggtatacacccaaaggactataaatcatgctgctataaagacacatgcacacatatgtttattgcagctctattcacaatagcaaagacttggaaccaacccaaatgtccaacaatgatagactggattaagaaaatgtggcacatctacaccatggaatactatgcagccacaaaaaatgttgagttcatgtcctttgtagggacatggatgaaattggaaatcatcattctcagtaaactatcgcaagaagaaaaaaccagacaccgcatattctcactcctaggtgggaattgaacaatgagaacacatggaaacaggaaggggaacatcacactctggggactgttgtggggtggggggagtggggagggatagcattaggagatatacctaatgctaaatgacgggttaatgggtgcagcacgccagcatggcacatgtatgcatatgtaacctgcacattgtgtgcatgtaccctaaaacttaaagtataataataataaaataaaataaaccatatattaaagaatttttgatttgttctgtttattattgcactgttaaataacaagggtcattaaaatgatacactgcaaattgcattctgttttccaagtctagagacaaatttgaattcccccaaagcctgttctggcttgcttttacactgttgacattcctcagaagaggcaagaataggcaaataattatgtgatgcccatttcaattccaacctcttgactgcttcattctcacccttcaccattcacatttggcattacaattccaacattaaatattctttttgaaaaatggttaagtttttatctgatgtttcaatgttgatatactatgattgggtcttattgtccaaagtgaagtcaaattcgtgtttaagtaaaataattctagcatggtttcctcctacctcccacccattatttgaaaagtgacaagaaaatgtataaagctggtaataattgaggcatttctaggcttgggatttccaaaaactgtgaatagccataaactggcaaatagaaggagacctggaaacgaattgcagtttgaaatcacagcaccatctgggacaccattttcctaatagtattagttttctattgctgcataacaaattaccacaaacttagaggcttaccatacacctttattatctcacagtttccataggtcaggagtccaagcacagcttaactgggtcgtctgctcaggggtcccacaaggctgcaatcaatgtgtcagctgagctgcatttctctctggggcttcagttcaacttccaactcatgtgattgttagcagaattcatttctttgtggttgtaagatcaaggtccctattttcttgctgactgttggctgggggctacgctcagcttttggagtccaccctcattccttgcctcctgtcccttttccagacctctcaacatggcaactcacttcctcaaagtcagcaagggagagtctcttagcccagcttgctaagatggagtcttatataatggaatataattatgggaatggaatcgtatcacttttgctgtattcggttggtacaaagtaagtcacaggttctgcccacactcaaggggaagggattgtataagggtgtgattcactggaggggggtcatcttaggatatgtctgccacccgtatttctggtttaactcactaccttgtttccatttcaccttcagtgcccttctgatgcctgtctggtgcctggtttcgaattcctacctgtctggtcctcacattctcatggttctcacatgcttcctgattaccttttaccttacatttccaacaccttcacagaatgcatcctgctacctgtctctatggccttcttttctctatggtcaagtcaccaatcccttggctctgctagccctctccttttagtgttcaagcacagcatgggtaaatgaaactgatgctgttatgttgaatacctcctcctcctggcttttctactcatttcagtggtgtgatcattcttcaagtcaccctaagtcaaaaccatacagttattcatatcttggacttccctaaaccaggggttggcaaattatgacctgtgagccaaatttgatccacatgcctgttattgtaaataaagttttattggtgcaaagccatacctatttgtttaagtatggtttatgcctgctcttgcactacagtggcagagttgagttgttgctacagaaactggcctaaaagctgaaaatatttcatatctggctttttgcagaaagcatttgccaacctgtgctctaagctgaagaagacagattgtttcttttgcatttaaaattccaatagcgttctttccttaccttcttttccttctgctattgttcaccttggttagtgcttttgttgtcatacacctgaattgactcagccatctcctaattgggcctcagcagctattcagagcttctcttctctgaagcccttggttcattgctgttgtttgagcatctgaagatcttccttgtctagttctaaattctttctctttatttttctatgctttttacagaaactcatcttccctgggtgggctgagagcaaacactggctcaaatactttacccagttttgcatgtatgattcattaggaacttctcataaactatctggatttaacagttatgtcttactctacataagacctagatcctctatagattattataaaatcattgcacacaagaattatgtcttacacgttacatctgataaaatgcttaacgttgagttgagctggacagagaggtatagaaggtgtagaccagcggtccccaacctttttggcaccaggaacctgttttgtggaagacaattttcctacagaccagggttgtgggggggatggtttcaggatggaagtgttgttccacctcagatcatcaggcactagttagattcttataaggagtatgcaacctagatcacttgcatacacagttaacaatagggttcacactcctttgagaatatcatgcagccgctgatctgacaggaggtggagctcaggtggtaatgctcgctggtctgctgcttacctcctgctgtgtggcccggttcctaaccataccagtaccaggccatggactggtactggtctgcagcccaggagttgggtacccttggtatagactgttgataggtctttgtgacaagctgctttactatttaaaaatgaaatagagctttgtttcattttatatcgtttttaatggtggtgattaaagatactttaaataaatttaaacttacaaaaaggtcgaagtaatggtataaggaactttttctctaaatcatttgagagtaagtttccaacctgatgccctatccctcctaataatttattgtgtaattcctacaaaaaataaccaaaatactaccatcaaaatcagtaaatgagcatggttcctgatagccatttagtccctatgctctaacaagtttaactaattgtctaagtaatctcctttgtatcaaaaagatctagtccaggatcataagttgtacttggttgtcatatctctttactctctttatatttggaacagttcttcagtattttttgacttgcatgactttggcattttttgaagagtattggagagctgctttgtagaatgtaaaattgtatttgtctgatgattccttataattaacttcaagttatatgtttttgatatgaatatcacatttgaagaggtataaatatcccattcgtcatcaaactttcactcactagttttagtggtgtttcttggctaaattaattattactgtgttagttgacatttgataattttctatttccatcactcctataattattatttggcattccattacagggaaaacaattcatctcttcctatttgttcatttatatcaccatggactcatggattcctattctattcagtgggttagaatcctttactttcatttattttgatgctcaaagggtcccacatttagcagtgggataaggttgcctgataagatatagaacacccagctaaatttgcatctcagataaacaattaataattgttttagtaaaatatgtctaaaatcttgcatatacatgcttaatattgcatggacatacttaaattattagttgtttaactgaaattcaagtttaactgggcatcttctatttttatttgctgaatctgaagccctgaagtgggagccccttcaagatgcttactgtgttctttcaatatgtccccatcattctttgaatacttccttgatttctggcccaacaaaatgctgtagcctcacctcgtacctttcttgctccagctctcaagccacttccccaaagaaacctggctctgtttagtgtaaaatggtatttagaaaccaagatctgtacacagagtatactcattactgttgaatgtcacaactcttagaccttctcagtggagagatccagggcaatctatgtatttatctatttacacatatgcatatatgtacatacatctacatatgtatttacttctgtatctatctctatgtattgaaaaatcatgacttcacaccaatgcttctaattccaatctagtaccacatgaacatttctcattttccttttctacttctctaacagtgagaaatgtggtcctcccaccctccatataaccataattgatcaattacccccatatgtacccaatctcccattgccaccaccagcctccacatccctacacggatgctttgctcacctttcttgggctctgacaccccaccctgtgcttcctctcactgcctcaggctccaaaatcccataccaagccactgccagtaccacttctgccaacgtggcacatgggcaccttattcacctgattcaggcttcaacatcccatgccaggccagcatcatcattcccctgtgtggatgccctcttcatgccacttgggcttgatccccagcaacagaccaccctgagtgaatgccctcctcatgatacttgatacactgtgctgagtcaccactcctgccccacctgatgcagatacctgtcctgcaaggcctgatgtcatgggtcttggattgaattgttcaggaaaggaaggagggaaaggaggaaggcatttctcaccatgtaacattataactgatttattattttttataattgatttatgttttcattctgttttcccctcaacctggctcattcactggcagattaccttattacaagaacaatgcttgctttatcataagcactcagagattatccatcgaatgaaaaagtgagtgacttaatgaacaaatgaatatgtagagagctaaagtttctacatatgcagaaaataaattttaattctcctaaaaaattattttctcttggctcttgaacttacttaacatctgatttaggattcacccatggtaacccaatgattgtttggggttttctacctcacctagcatgacatctgggcaagtttattttcaggtcactataacccagagttttcttgcaagagtatggtcaaaacatcatttttccttattaggaggtggcttgtgtgtgttgagctcacatttcttttctcacaggcttctcttgctctcatcccctgtgcagacttaatcatatgcctaccggtgatttctatatactgagatcaaaatcagcttctgtttcttatgctatcaaataaaatatctgctctgtaaaactgcttctacatataaaagaaagaatcggggaccagctcttcaattggtatgaatgagttggagagaaaaggcagtaaggcacccacccataggcccccaggggtcaggaagcaatgttcgatgttttccttctctcaccagctagctaaattcttgtggaaaaaatcccttcctcacgaacctgcaaattgaagagatgtagcaactgggctcactgatcctacccaccccaatcctgccccaagtcatcacagggaaaatgagcagtgcatgtgtgaatgggtatggcatataaaattatattttcatttagcatttattagagctgattcaaaaaatcacatgaaactattataaattgctgaacagtttcaaagtttattttgcttatgtgtgtggaagagagacaaaagtagatgagaactttaaaaataatgtttattgcatgactaaaaacttgggagctgagaagggagaccaacattatgtaagctcagaatatttttggaagttaaatggcatttcctacaattttacttccaatgcattcagctgatcacctctctgaaaacaccttgtgccttgcataccttttttggaagcttacttctccctccctcttctcttctaatactctttccgtgataaatcctcattcatcctggaagactaggcattaaaaacattttctgtatgaaacttgcagtggctttcaagtgagttcattagaacagtggtcatgcattagaactacgtatttacactttgtctccactattggctgtgaacttccagacaggggaatgttacatctcattttgttttcttttacttaatgttaaggatctcatatatacataattgggtaattacactggctagctcatgacacctgagtgatatgttttttttttgttgttgttgtttgtttgttttccattctcagtgaatgtcttcagtggcattgagcacaagagtggctaagaatggggctaaggacttaggcacacctggtctgaatccctgctcacccacttaactgtgtgacttggggcaatttatgtaactttttgagcttctgttttctcaaatgtaaagttagaaaaataaagcccctatttaatagtttttcttttttatttctgagtgttaaatgtaatattgcaaactaaatgctaaacatgatttatatgacaagaagcagccagtaaattttagctttttaattttttaatggagtggggctcaacagatacttaatgaatgatacagccattaagctttttagaatcccaattatgtatccaatttgttttatttattttctttttctcttttcttttcttcctcttctttcttttccttttcttcttctcctttctcctctttttcctctttttccttctcttcttcctcctcctcctctgcctccttcttccttttttctcttcctccttctcctctgctctcatttttcttcctcttcatcttcctccttgtcctcctcttcctctttcttctttttcttcctcttcattatcatcttccttctctttttcttcttcctcctccttcgattctccttcctcttcttcctcctcctcctcctacttaatcttctctaaaattctcctctctctctcctttctttcccctttcccctcccctgccctcctctcttttttggacatctctgagcacagctgctgcacataccagggcaaagctgcatcagatgccaaagtcttttcaagggaagccagttttcaagctcgggcacactgacttttaggatacaacccaaatactattaaataacaaaacattaagcttctttgcagataagcctggaataccttattctctaggtttttaaatttaagagaagtggaaccaggcactttacaatttgaaatgttatttcaaattattctcatagcagccctgcataataggaattattattcccactttacagataagagagttgaagacggtgtcactataagaattaacattagtataagagcagtctctcagctctgtttccctccctgctggctttaacttcttccactaaatatgtctttctccctatagtcataaaagataatcacaatccaacagagacatccatccctacagctcatgatcccaaaggaagtgagaccatttctattacaacatccaatttattaaccagtttcatgggagggctatgattgcctttcatctcaggatattttcattggtaagcagaagagtaatcagcagtggcttaagtgaaaagaaaagaaaaaaaaaaaacatttgattatctcacagagctagaagtttggaggtaaggggctcttgggttgagtcagtgactcagtgatagcaggagctgagcagtgtcttgtaaccctcttgagttcatgctcatgattgcagctccaagcatcacttcttcacctcagcatcataaggaggaagaaaggatagaaaagaggtcattcctctgacaacactcttattttgggggatagaagatctctactctaaaacccccagtggacttctctttatatcccattggccagaagtggggcacgtgtccactccaagaccaattattggcaagaagcgacggagttaacatgagtggtttacaacaatcatggctcggcatctgaggctaagtgaagggacagcttttcctgaaaccaaaggttcctgcctcttgaacacattgcaagttctgtgtgcatggcaggagagggtgtgtgtacagatggttgttggtaaggcagtggtcaatatctgctgcagcccattttgggtcatatgtctatccctcatatctgctgagggcagcacgaagagttctgccttcgactgtgttcctctggtgcagtctctgagagtaggattaacaggaaaaggattggtcaggaaatattcttgggaaaaaatggtagaggaagtgggatgaagaagagagggaggctccacagagttcaaggtctcataaaattcaccccccagaggataacttaagtgcaactccacagagaagtactggggacagtgtagaccccactcagtgctgtgttccccatcgggattaccccaccaacactgtggggaggggatataaatttctgggcactcctggttcttcacatgtgcaggcaaaagagattctggaagtctgtgggtagttctctaaccaggagacacaaggctggccgtttggagtaagagcctgttagagccactaagcataacactggggacttggaggggatatgagctgagccccaaggacatctgccacagggtccatgacagtccagaccagcatcaagtctgcaccccagagccacggtgtgggtgggcattgcttgatggttgccaagtgaaccaggacagtatgagcacaaggaaggtggccccctatggaaagaaaaatgctgagaggtcaacatctcaggacaccaactcatcagccctctgcacattccccaaactcattagggtgcctccaggagaggtcttacgtgagaacgggaattttggctgcccaggtactgtgtggaatctgctggattctctttatctgcagctgctgggggtacgccagctgtcagtgatgacttctagtgccattcctcttttccccatttaggcttttcttactttttagctgagagtagagtttctcctccccaagtactattgatatttgaggctgaattattcctcactgtgggggactatcctgcgcactgtagaatatttagtagcatctctggcccctctccacttgaagccaattccaccagcattcccccaccaaagttgtgacagatatcccctagaccttgttaaaaccactcctggtggagaaccaccggcttagaacactgggctcctgcaactgtagcttccaggtttcacctgctaaattgggggaaatgccctctaagctgtggaactctatgaacttcatgggagtttgccagatttagtgtgactcttattcttagtgagttaatttgtcatttgtgtcttgtttcctctgtgctaggggaataaagaatactggacctgtattcagaatttcctctcccttctcacatttacctgccattagtgagctgaggctttctttccttagaattagggttgccagattaagcaaataaaaatacaggacatccagttaaattggaatctcagaaaacaaacaatgttttagtaaaatatatcctttgcaatatttggaatatagttatactacaaaagtatgtgttctttatccaaaaccaggtttaactgggtgtcttgtagtttatttggccactgtacttggcacacattctttctctaaggactccactaggaaatgcctgcattactgtattctggtgcactcatcgtatccttcaatcatggagtccccactctgcctgttggttagcttgtactccactcaccgtggcaccacaacttgggctgtttctatcacagcactttcagcattgctgctactttccatagtgccctgtcccttcttttagcttttgtgtctttctgcaaattgattatatggagttggattaaggcctgcagtcattatatgtgggtgtgcgtgcatgtgaaaaaaaattactcttagcttccctaagagaagctcatgggaatcgaatcattgagtaatacagccacggaggatcctggggaaggaattctccagcattccacagtagcccctattctgaaagcctctagttagtatcaccatgaaaatattagagggagaggaaaaaaaatcctctgtaaatagtagcactccaggggagatcctagtaatttgcatttttaagaccagatgcagttaacctttcatatattgtacatattttaggatgatttttttctaaaagatttattaatactatcattgcctaaaagatcagctgatttgtgagttatttgaataaaacaaactaaaaaataagggaaataaatgttgcttgtcatcttccttacattcattgtggcagaaagggcagcaatgagctcttgctagataagagaactacagcagaggtacaggatgcagcatcatgggaaccagaattcatctgagagactcaataactctgatgattgtttatttagtaacccaggggaaatttggcttgagttacagtgtgtgtattgctgagttctttctgtgtgtcttggttatttcaactaaaaaagactggggggaggaaaagcagctaacatgctaaaactgtaatgattacttaacattacattttggaaaaatggctttactgaaatgtaattcacttatacaattcacgcatttgaactgcataattaaatggcttttagtatatttacagaggtgtacaaccataaccacaatcaattagaacatttttatcacaccacaaagaaactccatatccattagccagccatcactccccatttctcccactccatacctactcatcctcagcccctggcaaccactaatctacttgctgtctctgtggacttgcctattctgcatatttcatataaatggaattatacagtatgtgattttttttggtttctggcttttttcatttagcataatgtttttaaggttcatccatgtcgtatcatatatctatactttattctttttgttgccgaataacataccattgtgtatatcacattttacattcatcagttgaaagtcatttgtgttttcagttttgggctattatgaatactgctgctatgaagattcacacacaagtttttgtgtggataggcaaaacgggcagggaaacaaactagagaaagaataaactgcagaaatccaagtgagaacaattaagagctcaactgtcgtacatttccctttcctttccttcccttcattattaccctgacttaatccttgcccagccttcctttcattttcacagtatcctgctcccaccctaagcatgtgtatttcaaggtaaggctttttgtggagccaaattgaagggggatcacctggccagatttgcaaatgtaaaggcagactggtacatagattctccctccacggtatacccccgacccccagtgaatttaagaaccaaatttaatatatagattagctcttgattaagagcagtggggccaaggttcacttttagtctcaaggtccaggagagatgagcttctgtagcatcagctgggactggctacataattggcagaacccagtacaaaatgaaaacacgaggctccttttgaaaaaattattagaatttcaagatggcgagagatgagccttaaaccaagtgcagagcccttctgagcatggggctgtgtgcacaggtcatgaacccatgaagccagccctgaaaagagttctaagtttgaaaatatctagattccatctgccatagagtaccagcctgtaatcagaatgtcacatttgcagatacttcctaagcagctgaatgtatacaatgacctgttgatcagagggatgctaccctccagaaatgaatgtgttactaggtgtctccaacattaaatctctttggagctgtgttctgatgagctgaaccgggatgttgcccttgctggttgtacagtcataccacttcacatttcatgatagcaacaataaaacaccatgaaagatgtgttgcttcttgtgcggcaggcactgtttgtctcatggcctgtgagaaaccttccaagacacagcccttcaaactcaggaccctgtaagtcagattaactgtgaccacagactacatgagttgttatgagtaactctgggagaaagccgcctttcgttaaagtggagactgagtggattcaaatgcattttaaaacatctgtcatggccagattgccatttcaatagccccattgcctgcctggagcttttgcatgcatgagtatttctgctaggaaacagaaaatgtttggattcccaatttagaatcccttctatgagttcaaagagtttgggcttacactgctcagcagtctcctggttttgtttctttgtgccctcatgaaactagagctctgtgtcactttgctctaggaagaattttgttgttggtgaagaatattcttgatagttagcatctttgaaatctctatgaaaatgagaaattaagcacaaatgaacacaagctctgctgaactctcaaccccccaatctttctggcttcaaattttatttttatgggttttttttcatgctttgcaaggcacaatttagtaaaacacagcaatattaaagtgtacgtcttgaagaaatttgagaaatgcacatggccattacccagattaagatataaaacatctccatcaccccaggaagtttccttatgcctcttccagttagttcccctgctcagaggcaactgccatcctaatttctatccacatagattagtgctgcctgtttttgaaatccatataaatggaataatactgtatgagttaatgtgtctttcactgtacgcaatgcttttgagactataagttgttgtggacatcattagtttgttcctttattgccaggtagttttccattgtatgaacacaccacaatttgtttatctactctcctgttgatagatatttggggagtttccagcctttggctattacaaataaagcttctgtgaacattcttttacaagcctttttgtggacatacatactcatttctcttgggtataaagctaggagtggaattgctggttcatagggaagctgtttatttaactttaactgccaaagaagttttccatcaatgtacaggagttctaattatttatatctttgccaacacttggtcttgcagtctttataattttagtcatactgaagggtatgcatttatatctctttttaaaaaaaatcacttttattgaagtatgattagcatacaataaaatatgccatcttaagtgtgtaggttgactaagtttggcaggtatatatatccatgtaaccaccacatcaagatatcaaatatttccatcaccataaaagaaactcttcatgccccttcccagtcagtgcctggtagcaggcaaccactgatctattttctgaccctacagattagttttgtttgtctagaatttcttagcattggaatcatattgtatgtgtattttttggtctagcttctttatctcaacatatttttgagattcatgcatgtccttgtgtatttcagtaatttctttttattgttgactcatattccactgtacagacatatcacaatatgtttacttgttcatctgtggatgaatatttgagttgttttctgttttgtgctattatgaaaacagctgcaataagcatttgtgtacaattcttttggggacatatgttttcctttctcttgagtaaatacctagaagtaaaatggccgggatatatggtaagcgtatgtttaactttataagaaattaccatacagttctctaaagggttgtcacattttatgcttccatcagcaaggcatgagagttccaattgttccatattcttaccaacatttgtcattcatacagtaatcatacagtatagttttaaattctagcaagtttagtggtatctcttgttttaattcacattttcttgatgaatagtgctgataaatatcatatcttatgtgcctatcagccatttattatcttattttgttaagtttccaaatcttttaccagcttgaaaaattgtttttttttttttatcatatttgaagttctcataactgaaaaattgtcaatttttgagttgtaagatctctctgtatactctggaaacaagtcacttgtctgatataagtattgtggatatttttttcctagtctatgtcttgccttttcattttttaatgatatctttcaaagagcatgaattttaaattttgatggagtccaatttttaatattttcatctgttcttgttgggtttttcttgtatcttaagaaatctttgtataccacaagattgcagaggttttcttctatattatcttgaaaacattttatagttttaataattacatttaggtctatgattcattttgaattcatttttatatatggtgtgaagtagagggacagtttaattttttaagaaaacattgttataccatcattttttgaaactctctcctttccccattaaattacttttgacacctttgttgaaatcagttgactatattatgagtctgtttgtggattctctattctgtcccattgttctatatgtctttcttcatgcaattatcatcctgtctttcactgtacacaatgtcttgatttttgtagctttatagtaaatcttgaaaccagacactgtaagtcctataatttggttattcctattcaaaatgtattggctaatctgggttcttggtatttcaatacaattttataatgtctgcaagaactgatgatgggattttgattgagattacactgaaattatggtttgatttatttgtcttttttctttcctcagtaatatttttaaattttcagtttttaggttgttgtgtatatctggctaaatttattcctgagtggtttgtgtgctttgattaaattatacgttgtattgtttttctggtttcatctttcaatccttcattgattacaaatagaaattcagttggttttggatattaaccttgcatcctgaggccatgctcaatctacttatagctctagtggctttttaaagtagatttctggattttcttcctacataattaatacatgattgtcttttctgggaaaaaaaaaagcttagtatttctcctttgttttcaatgtgtatgtcctttatatcttttgattgccttgtaacactgtctcagatatcttattcaatctctctgtggctttaatatgcatctccttgctgagcaccttttcatatttattgacagtttgagtattttgagaatttctcgatcacgtcttttttcccattcctattgttttgtttatttgcattatttgtaggaattttaaaaatctaaatacaagtccttcattagacatgtgtttttaaaaatttctcctagtctgtggtgctttttttttttttacttcagcaatgatgtcttttcatgagcaagagttgtttttgtttttaatttgatgaagtgtatcaaattttatattctaggaaatgttttcctacctcaaagtcgaaaagatattctcctgtgtttttgtctggaagcttttaagtttttagatcaatgattattttcttgaaagctctgtgtgtgtgtgtttgtgtgtgtgtgtgtgtgtgtgtgtgtgtgtgtgtgtagtttctttaatattacactcaaatgctttttaccatttttatgggtaactttggcaaagatgaaaattgtataatatataatgctggtaattggattgggaaagaaacactcaagatatgctgctggaggtgcaaatgcatacaacttttttggcatgggtaggaaaaaattcagtaataagaatcaaaagctgtaggaaccaaaagccttaaagatgttaattcctgaaactctataggttcatatcaagacatttatcctgtagaaataaccctgggtgtgtgctaaaatttagcttcaaggatgtgttatcacagtattttttaaaaatagggcacaagaagaatggaaacagtctataatagtggattgattaaatgatcatatagcgctattatggaatactgttaaaccactgaagataatactgcagaatattgaatgcctgtctttgtctgttttgtgttgtgataaaggaatatgtgatgctatgtaatttacaaagaaaagagatttatttagattatggttcttcaggctataaaagtactatggtactggcatctgcttggcttgtggtatgggcttctgtgctgtgtcaaaacatggcagaaaaggtcaaaagggaagtgggcacatgcaaagagggaccaaacccaggagtatcctggatttataacaactcatttttgggaaaaataattcattcccttgagaactaattccatttcacaagagctagaactcactactgcaaaaatggcaccaagtccttcatgagggatctgcccctatgactcaaacatttcccactaagccccacctcccaacaccaccacactgaggatcagagatcaacatgagatttagtgagggcaaacaaactgtatccaaaccatagccatgccatagaatgccacactttaaaatgaaaggcaaattattattgccatttgttcactgctttataattttaatttgtccctttgattgcatatttttattcttctgtatgactaagaaaaagggcttcttgtcccctgccaaagagttgaaagcatgccagagaagtgccaccatccaaaacatttctcttgctgtctagcattccatcttctgagttacaatgccttggtccacttataatttggtgagatttatacatccatttaaattttcattagctggatatggaggtggatgtaaacaagaagcattgattagatctagaaaaggtggtatgtggacccaaagaagcaccaatagataacgctgtagacagacttggggatgaaactgttgtgtactccctggaattttgctgactcagctgtggtgtggtgtgagggtgacacctttagaagactgtccaggtctctttggagtagtgtgtgcttgtcaagtttacagcttgtgggaaagggtaatcagaacatgcaaaggctcaatcaacctttactgaggctccctcaggcatggtactcaggcttcagggcccagagggtacatattgaatttcactttgcaaagaacccagcattagagcctggaccccaggagcttgggtctagtggagcagttgagcagccaaaaggagtgttgagaaggcagctttaacagggcatatgtgttcaatatcaactgaattcagaaggtcaagctgctggagttcttcatctgattaaccttcatcattcaaatattctgtgctatagcttttcaacaggaaattcacatgtacttaaaatgtactttttttggcccaaactgtctaaatgtgcattgtgttagtttcctagggctgccaaaacaaatgactacaaactgggtgttttaaaacaagagaaatgtattctctctgtcagttctggaggccagaagtccaaaatcaaagtgtcagcagtgccatgatccctgtgaaggtgctaggggagattccttccttgcctcttcctagtttccagtggctcctggcaatccttgatgttccttaacatgcagttacatgactccagtctctgcctccattgtcacatggacttctttcctgtgtgtgcttgtgtctgtatgtgtcccctcctttttctgtaaggacacccttacaaatttagggccctcccgaatccaatgtgaccatcttaactaattacatctgcgaagatcccatttctaaataaggtcacatacacaggtaacatggggttaggacttgaccatatctttttgggagacacaattcaacccgtgatttcaatcactgtttaaatatcccttttggggttactatgttgtactgtacattcctctttcttgcatttttgacccctgtatgtaccatgtcttttgttcataagatgactctgagaaaccccctaggctcttctctggaattcatgatgaagataattcttgggtttctataatcatagaaacagaatgttcagctttagctcccgagagacttcaagtgctggcaatgtttggagggaaaccggatgtgagaaaatggtagggaggctaagggaagatgaggtttctggccatggagctgactagggcagcggtcaggggtgacctattagaagatgagggtacagagtggggccaagaattagagattgagcccaaacaggaatgcagcacatctggcctagttggaggcaggggtggatctccagcagaatatagacaatgggacccatcttggcagacacctaaaggagaaggggaacttgttgtccatgtccagtctattagcaaggcctcttacctccacatcaccatgtgacagatctgttcagtgactcccatttccttcactaaaaccctatttctgctcccacagtctttctcctagactaccaatttccccttctattcaggctacctcaaattgttctccaaagagcaactgaatcatcttttcaagcataaaccctaagttgctgtatgatctggcccctgctcacgcattctgtgtcatcacacctcagtcactctgttttctttatgttcctttaacacaccaagctccttaccacctcaggaacttttcacccgctgttcccactgcctagaactctctgccctcatatgtcaatgcctgattcttggccttctccccttgaaacaaccttctgtgaccctccagtctaaagtggtgcctctccatctctgtccatcatccaattttattttcttcatattgcttaccactatgtgaaattattgaattcatttatgtcagtggttcttaacatggagggattttgtctccccagggcaaatttggcgatctggagatttttttgttcttacaactggggtggagggtgctaccggcatctagtgggtggagaccagggatgctgctaacatcctacaatgcacagaaccaccctcacaacagggaatcattcttcccccagtgtcagtagtgccaaggtggagaaacctatttatttgttgcttttgtattctcaaatctgtgcttaacccttttgaatgtatatcccaagaaagcaggaaagcaaactggtatgtgtcttgttcgttgctctgtctctcccccagaacaatgccctggtcagagttggtgatcaaaaaataattgatggattaatgaatgcgttaatgactgaatgaatggtctcaagccctggatctgtcctttcctagctttttgagcctggggacatgtttttaagtgaattaagccattgctgacctggttcagcctcagtttgaggtaggccctgtatccctgggtctcaggatcagactattacattgtccttcccccaaggatgattccctgcatcccccaggggtacagagatttttcattatctttttcagattacagaaagaattttaaaaatgtattactttagacaagtctgatatttttatgaaattaattatttccatccagcaataggatatgattcatttacttcagtcttctttagtatcatttagcaaaattttataatttattcacatacacaaacacatgcacatatcgttaatgcacatttctgaataaagggattttcatttttcctattgttgtggtccaaaagtagactgttgagttttaaacatattttttgctatatttaaacaattctaattaaatcctttaatggttatgaaaataatagtaatatatttccaagtttacaatttccatttttaattttctttgatcaagtgattttttaagaagaatactgttgtttcttttttatttttaactttcaagtgtgaaaggcttttgttactgttgttgtttctggttattttacaattgtctctttataattactacattctttttaaattgatgatgagctggtctttatattttagaataattttagatttacagaaaagttgcaaagattgtacagataattcctgtataccctgtacccagtttccatttcttctaatgttatcattttactttactgttctctcatcctgttttttatccttgtggtgggccaaacctttcagagactcagctactaaaagatacattttatatttaatatgaatagagaaacctgtatatgcaaacaagaaggaaagttgtctaggaaggaggtagaagtaaagccacattgctgtttccaggtttgcaaggcccagttcaaaatgagaatgcagagccccttgttcaagaaatattaagaatttcaagatggcagcagcagagcatttaactcagcacagagccctttgtactgtgaagccctgagccactgcctggtttcatgcctgtgaagctacccctgctgttcctacagttgaaagtaatctttcaacttcttccatgatacaaatacctcagtaagttaagggaaagtgtcctgcacgaccaagctaaatctactcatatttgagtttttctagaacactcaaagtcacaagctttgcagcttgcctgccttctaaatctaagttcaaaaggctttgagttgaggacaatagtattagctaccctgaaatggcagtgaagctaattctaaaataacatccacattagctcacacaggctgatattttctttgctgaagatcaggcaaatggagtgtttgttttgagtgccttccaataatacttacaagtagccaagaatgcttgggctcttggaaactgtacctatgcccagaggctcttggtgaatatatttttttaaccaggtttactcatttaacttgtccaaatggggcactttcacaagggaacccatcagccagtcatttctgatgaaataccaaaaggacctgtgaggaaatgaaatacgagaggtcttggtaaactgacattttgaaagtatctgggaaatacattgctggaaattggtttagcttcatcatttatttatcaatgttcaacaacattgtatcttgaaatttgagggtacaatgtccacttacagtatttggttaactgtgctagccagatagcaacatacctacaacttacaacatacacaccatatgtactacataattccagttaggcccatcttcccttctgcatcccttctgcactgatgttctattcatcatggtgaaaaaaaggtatcctggatctgaggctgcttcctcctgtttatgcaacatgggcactggctctactgtggaaccgaatcccattagatagaacagatgtacccacctctctctcctgcctcttttgactcacaagtgtgcccccctagtttctgggaattaactcccactgagagcaaatggacaggtgacctatgagaatgacattgggataggcttttcttctgctattattcccttccttgtatgtaggcattgtgtgcaattagcgtgaaaatctaatactttacatcctcccacccttggaccttggaccttagttcctgggttgcaaagaggtcccaggttggaccttagttcctggggtgcaaagaggtaattgtcacttatagttttgggctgtattttagtggattagagttgttagaagtctgcaagagatttcaagtaaaagactcctcaggagactatgtcagcattctatgggcatatatgcatgcacatatctatgtaggtatgcacacatttgagtatagtatggtacttgtgtttttaaaaaatcaaatttgtttaaaacagtacagaatacgtcagttcaaagagcaaaatagaaaagtaactaattaagtttctagaattagaaatagaattgccttaaagattgctttgaatcatttatttttaataacatcatcacatttgttttctaagaaaggcctgatttatgtgcagattatcttcctagaattctgacatagtttcttaaaaagcattatcatattctaaaagacttaatttttgttgtgtcttagccagttcaggctgctctagcaaatgccatagactgggtggtttgaacagtaaacatttatttctcacagttctggaggctgggaagtccaagatcagggtgctggcagattctgtgtctactaaggaccttcttcctgatttgcagatgcctgccttcactcatatcatcatgatcatctctctcatgtttcttctacattagtgtctttataagacatgaattccattcatgaaggctccaccctcatacctaattacttctcaaaggttccaccctcaaatactgtcacattaggtattaggccttcaatatatccacttcaaagggatacaaacattcattgcatagtaccttgacataactacatttttgtggctttccctttttgtcatttagaaattgccacttagcatcaattctgtgtttcggactttgttggaagaaattttctcaaactggaaagcaaaaaacagattagaaaatgttttctagaagtcatttcagatattttaagtacttctgctactaaacagataccacttgattaatatttttgccaacaatgtccatctcagataaatgttctttacattttaaaaatattacttttcattaactattgagtagattcaaaataaaatttgtggttaagaaaagaaggacgtgatggctagaacactagaaggtaccaggatttaaggaacagaggtggaagagaaaaagccgatgaaagagagaaggcagaaggctttagaaagattactgtgaaatgaaggggcaggggctgagctgcattcagcataatttcttcaaatgtatcatccaggttactgattcagctatgcttaatctacctttgaaactgttcgttgagtttcatttttgtttcatttcttattatattgaaatgtatacacacaaaagtatacaaattataaatgtacagcttcatgaatttgcaccaagtaataacagtcatataactagcaccctgatcaagaaatagaacatcattggaatcctacaaacctcccttgtgcccaatcatgatctccaacccaccatctccaaaggttgctaatattctgacctctaccaccatcagttagctttggccatttatttatttatttatttatttatttatttatttatttatttattcattcattcatttaagacagagtcttgttctgttgcccaggctggagtgcagtggcacaatcttagctcactgcaacctctgcctctcgggctcaagtgattctcctgcctcagcctcctgagtagctggaactacaggtgcatgctaccaagcctggcgaatttttgtatttttagtagagatggggttttgccatgttggccaggctggtctcaaattcctgggctcaagcgattcacccatcttggcttcccaaattgcttggattacaggcatgagccactgtgtctcaccagctttggccatttttgtactttatataaatggatatctacagtgtacccttttgtgtctgattctttgcttatcgttatatttgtgagtttcagcctcagtgttgcattcatctgtagtccattgctccttgttgctttgtggcatttcattctatgtatataccataatatatccattctactgtgatttgtgttaagagttgttttcacttgcaaagtttaaggtaggaaattttcctgcctttggttgagagagggctgttctcccttaccataaagatacatcctttttagagacccagagtgtttttttttgtttgtttgttttgagacagggtcttgctctgttgcccaggctggagtgcagtgagccatgattgtggtgagtgctaccacatccagctaatttttaaatatttcgtggaaatggggtctcatcatgttgcccaggctggtctcgaactcctgggatcaagcaatcctcccgcctaggcctcccaaagtgttggggttagaggcatgagccaccatgcctggctgagtcccagctttatgggaaggactgtcccattcaacttgttaccatgggcaagcctagaattcgcattttgtccactgaatcctgtgaggtcaggaaaacagaatttagattcaccacattcaacaaatgacttcaaggcaagcactggctgtagggctgcaatgttcttcctgattattttgagacataagtgttctttacttttttgtccactcatgcatattttaaatagggctttaaaatacattatccaacatccctagttgttttctgtggaaggctggtgtgggtattcattctgccttactgtaagaaacatatatagacatgtactttaaaaatgccccttgtgtttgggtgtggtggctcatgcctgtaatatcagaactgggggaggttgtggcaggaggattgcttgaggccagggattcaagatcagtgtgggcaacatagagagacctcgtctctacaagaaacaaaaaattagcctggtgtggtggtatgtgcccatagtcccagctactcaggaggctgaggtgggaggacagcttgagtccaggagtttggggttacaatgagctataattgtgccactgcactccagcctgggtgacagaacaagactttgtgtctatagagagaaacaaaaaggcccctggatttgtgaaaccaatgtatctattataaaatttaaaacaagtgaggtgtggtaatagtttttttttttttcatattctttctcaacctatataaggataccaaagaggttataattttttaccgaagttgtcctcttctggttttgtttgtggagagtaaatagtttatttcaaaggcttagacttgtgtcattttaatatttccctcacaaatcattttgagtgattcatgcacaaaatatttttaggagctactttttacattgttttgaggtaagcctttatgggtttccaaagatggtagtacaggagtcaggagtgaaaggaaatgtgtactctacaaagagaaatatgatcattgacattcaagaggcccagaaaaagtgctctgcaagttcaaaggagaagtttacttccttttgagtggatcaggaaagtctctgtgtaggaaaagacatctgaactgggcctcggaagatgggcagggttaactgttctcatggaggaggaggaagaggaagaggaggaggagaaggaagaggaggaggaggaagaggaggaggaggaggagacatactcgtctgcatgagttcaggtaggaaaatatagttgagtttgtctggaagaatgcattcatagatttagaactgtgctatccaacgtggtagccactgactaccatgtggcttttgagcacctgacatatggctcatgtgactgatgaattcattttaatttaatataatttgcaatgaagtgaaatttaaacttttaaaaaagtgatgctgtgttcagtttttggaaaagttttaagtacgtttggaacaacttgggtatgtgaatctattcttgcaatcatatattttatgaagtctaagtccagatcaagtatttctaatgaaaatccactgtccaaattgagatgtgctgtaacaatgtaaaatatcttattaataattatttatttacatcaattccatgttgaaatacgatttgggatatttgggttaaatgaaatatatagttaaaaagtcagtttcaactacttatttttacattttttatctgactaccagaacattttaaactacatatatggcttgtatcacatttctattggacagtgctactctacagagaaggttgaagcataaaatgagagtgtcttgggaactttagcaagttacttatcttctctgagcctaagtttccttatctcctgtggtttttgcttcatacaagtattgagagggcaaaattagagttgcacgcaaagcccatgttaacacagtaacaacgggctcaataattgggtatcattattcttttatttaaagggataaaaaggtagacaagtaagttctgtagaaaagggaagggacagtgagagtatctgatttataaagtatgtaatggcatgggcagttataaggatcatagacccgaagatcagtgagtaatgagtgatgcgtggcgacctggcaaacaagattaagaaagctgaaagataacagatgaaccgtgagggatgaaggtggtgcagtcagaagattgttctaggcttggaagccggttctgactttgccgtggatagatggggaagccagctcacttactatgtctctttgtagcatctgaagaatgacatggccagaccaggtggccacccagattactttagggccaggtatttaacttggtagaagaaatggaagacaaatttttcataaatgttggtgttgctccttacatgaagctcattatagttaaggaaacagaagcattttatctaaaggtaggtctaaggaacttgtgatgacgtattgaagaaaatgagcagtgaaaacaaagaggaataaagtcttgaaagaagagattggcacattctttagctttgcagttgaacttgcttggcaattactggagataaggaaaagaagaagggtttggccaaggtttgttaatctttataaacaggcaggaacatcctgtgccttttcccctgtaattacagtttatgaatatttgtttgagtgttaggatacttttttctttgccttttgatacatccttgtgtgtactccttgtttatctgtgacttagtttcagttttcatgtctatgtgcttcagaaagtcagaaaaattaatcatatgagcttaaaatgccgatcaagaaaagctcagcaagatacattgtattgaatgcagtgatttcttttaaaataaaatattaaataatttctgcttacctggaggtaagggaatagctttgtaaatattccttttttggagaaagttccactgtggtttatattcagccacaaagagggcatgcttcttatattatatctcaaggtggaattcattttgcatgtaaacaatgtgtagatgaggatgaggtttagccgcatctatccaaaaactcaaagtaaccatagctgaaaaagataggaagttattattttctgatttagatgagactggaatagtgacttcacatttacctgggacccaggtttcttcaagctccctcctccatcttcctagcacatgtctttcttctgaagggcatttcatggtttaagatggctgttgctttggcagccaactacgaagcagttgacttataattgaaggccatgttgtatttaaagaatgtatgacttcgaacactaaatgcggttcatagtttagcttagtgaggtgctgtctgtgggaagcacgcaaagacagacaccgactgaacaggcagttgtgatgactttaatggaatcacattttcaaagttatgtgcactcccagggggacacactcatgagtgcaatgtagcatgtaatcaaatgtttgaattacaggctgggttcagtggctcacacctgtaatcccagcactttgagaggccaaggcaaagggatttcttgagtccaggagttcatgacaccagcctgggtaagataatgagaccccatctctacaaaaaatcaaaaagttagccaggtatggtggttagtgcctgtagtcccagctacttggaaggctgaggcaggaggatcacttgagcccagaagtttgaggctacagtgagccatgatcgtgccactgcactccagcctgggtgacagagtgagaccctgtatcaacaaacaaacaaatgaaagaacaacaacaacaacagaaaaccacaatagttgaattatgttttttcataggcattctcccatttttccctccatcctccctctccacacgccccacccacaccttttccagaacacccatagttgaattcaaggtagatatatttgcacgttacgtaacttcactgtatagtgaggtctccctactcctccaacaccaccttccactctgctcaggtgatctttggatcctgcagttctgtactggatgcagaaagagagaaatccaccaatgctaatgggagacacctaaaaggaatcataaagtaaaaagatggatacccagatttctggctgggacagactgcatttctcagccatggggcagactgcaagaggagagatacaagaatacactcaagtactttcaagggtctcgccactaccttttaaaagccatttcagtcagccatgcagttagtggaaacgcctgtgacagtctagcaaagtgctggcagaggtccagtttttgctcacactttttagctttgatggtgtcaccataggtatttgagtttaaaagttggaagcaaatgcatcatagaatccttaccacacaacattataaatttgaatcccatgcaggtaaagcctttatattggatttgagggatgaaatggctgctttctaagatttggagaatcagaatgttatcccaaatctcattataaaaatcaaattaatcgatttggagtgaattgtcaaacacagcacgatggtaatgttttctttcttgattgagtcattaaactacaaaatcgctgctatgtttctattctgttattccttaaccacagctgaaataaatttggaaagtgttttcagacagttgggatggaggaaacacaaggacgccattactacactgtacaaacaatgcaaaggtcgctttcccacatcatcccaaggcttgctgttaatctgggacaaacacagttagatattttttgatggagagggcattgtcgtgggtggagaagagatgaggcagttcccttcgacccagctgtgactcagctcaggtcacaacttgtggccttaaatctcaaagagaattagatgtgtgtgatttcacaagttggactttcttttattgaacctatttctaaagcacaagaaggaaatgtgcagcctaccgtgcattaaaaggccagtagacactcttactatctgtatcccctggttccttttgtgtctcataaataaaatatctctacaaaaatatggaaaatatcctcgctctaaattaggaaagcagccttgctttaatttccttctctgcaagttggcagctgggtaaaagaaaatattttgacttccagagatgctattgtccctccttcagcctccctcctagccctgggcttcaggcagtctgcagggtgttctttctggccagtctctggtcagatctgatatgcttcttcttgagagaggcccctgtttctcagccagcagaggctgcagtggggaagagttgctgcctgcaggaagtctaaagtccagtcacatctttcagctccatccttagcctacaagataggaatgtggtttccttgataatgttctgctgaactgtcttgtacacaagataatgtttgcttcatcatccctgaaatatgtttccaaagcttcgttgtgatggtcaagaagcagtccgtaccttggagagaggcccggggaatgaaattcagagagacaagtatgtcaaccccaccacctcattcatgtattcattcagtaaacaaagtgtctgaggttctactgagtgtccagcaagtgtgttaggcacttgggggatagaagtgacaaacacagatagctcccccctttgtgtggctacgagtctaagaggtgacccagacagcactttctgtctctctcactctcttgcttttgctcactctgtgtgatcttgcccctccctatctctccaatgatttcttctataactcttgtccttagtcaccacacaactgtcacactgagcttcttactctttcgtgaacatgtcagtaattccttccccacagcctgtatactggctcttctctgtatatgaaaagatttccacagggtgggctccttctttgtttgtctcttcccaaccagcttgagttacgtgagatcacttgactggttttgcagcatggactgtgaatggaagtagcatgtattactttctggccaagaaagtaaatgaccctccagctctgtctaagcaatctgttaagatggtggcatctcagtttggaggaccctcgctcagctggagtccattagtaactacaagaagtagagcccccgaaaacccacagcatcactgaaaaatatgtttccattgcattaagccagtgaggctccatggttaatttgttaccccagcataaccttacctgactaataaataagctcatttgagtggagtagacaccattattattctcactttacaaatgaggaaacaggcacacagaagtaataatctacctgtagtcacacagctagtaaacagtagaactgggatttgaacccaggtagtctagctcctaggactgtggtaaactgcacaaacaatgcaggaggaggcacttaaatataattaggtccaaccaagggaagtacggtggaaaattccagcctgaggaagctattctggagtggtacacacagcaggatctcaataaatgttaaatgaatgactggatctttttaaggagcagtatattcaattgttttggctgcataagagagtaccacctagtggcttaaaatagcacacatacattatcccacagtttctgtgggtcaggaggccaggaacacctaactggatcctgcactcaggatcatacagggtcatacaagggtcctatgaccctaagtgaacgtatcagccagggctgctgtctcatcttcagctcaggatcctcttccaagctcatgttgatggcaaaatctagcttcttaccattgcagaaataagatacccttttcttgccagctgtcagccaggggttgcactgtgctcctagagtccccttgaagttccttgccatgtgaccatctcacaggccctctcacaatctggcaacttacttctcaaaggccagcaggagcatctctctcctgtaggctactatggagtcttacacactgtaatataatcataggagcaacatcccatcacctttgccacagaaggtaacctaatcaaggggcagactgttccatcatattcccaggtcctgcctacactcacatgggaaggggttataccaggtgtatataccaggggatgggaatcttgcaggccatcttttaattctgcctatcaaaagcagtgaacaaggatcaactataacactttttttttaacactaattcattggctactcactattaaatgcacaacctagggctgaagtctgtgaatggtcacatattaaatagaccatgtaagtcacacctcaaggaaaagtaagggagttaagacaaaatacagaactcacacttggcccatgaattagaaacttgagtaattaaagacagatgttctgtagggtaattggggtgaatgaaactggtgatttcagtatatgcaagctaatctttccagaaccccttttcaaagttcattttattgagcaatagtttaataaactgcatccatttcaagtgtacaaatggatgaattttgataattgttgtgaaacgaccaccacaaaacaatagctaaacatttccatcaccccaaaaatatatctgatgccccttgatagtccagatatttctctacaaccccaactcccaccaggtagcctttccagccccctttaactgtccttttaattaaataaaggcagtatggtacagtggtttggcactcaatacttgagtcagaatgtgttgtttggatcttcctttccctactttcttgctgtgtgaccttaagcaatttactaatttctgcctgcttcagttttatctaaaaaataagatagtgcttctctgaaagatagtcatatctcgaagaattcctatgagaatcgatgtagttgatagatgagaagcctaagtagttcttggcacatcatgagcactaaataaatgtttaccgtgttttttattgttattgtcaatattgttcagttcaattaaaaagccactataaagatggctagtagaagttaatgttcattaaaatatatttatgtcttttcctggagcactcttcccccagatataagtactccaactccctcctcttctttgaatattttctctaatctcaaactctgattgaagcctaccctgaccacattatctaatactgcaagcttcctcaccccaccccatcccacctcctctttcctgatgtttccctaccctgctatagtttttacttctccttagaatttatcaccattaacatcctaaataatttacttatatattatatttactttttattactatctctccttattagaatgtaagctccatgaggacagaaatctctgcctgttttgtttgctgatgtaccccaggctcttagaacaatgcctagcacatgatcagcgctcaggaaatacatgctaaataaaagaaattggaacctgtggcctaagctttatttatattatcacatataactcttaaaacaaaaccatgagatgtagatattatcactaccttttgataaatgaagaaaataaatcttggagagatgtagcttgtcacaatatacacagtttagttggtgctactccaagacatactctttttggctgtagtataccatatggaggagcttggaggaaccctagggtggatgtgacgagtcagacattgttgcccagctctagtaacccacaagcaatttgtgtgtttacatgcactggattttggatccactggcttatgccaagccaattccttattcctgccctgctgcttttgaaagtactggagtggcaagaggccgaggcatatttttgaaggatgagctcattccctggcccgcagccttactaaagtcttcagtaaatctattgaatctatggcaggaggttcagctgcatcaaatttaggattatcttgctttaatacagctaagactgcagaataatgaagatttggaccatcatataactctgaatcagggaccatcttaatacaggaaagatctttaaagtatgactcccttccatttttttaggctgtgtctacacatcacaaagtaaagatgtcagttatggacactaactgatgtgggtttatttctttgctctatctgtcttggtatggattttccagaactagaccctgggaccaggaattgagttcaggtagtttatttgggaggtaactgcaggaacacagtgagaaagtaaggaagacaaggaaaggaggaaagctaatagaagctatgttaatgagttggttactgctgtgggaaagtggggctaaatgcagctgagggcctgtgtagaacacaattcagaaatgtcccagtgaggggtgatgatgcaggggtattatgccatcatctgtaaccttttctgggcccttacctcccctgcacttccagcctgaccagtgcaggtgacctagtagacttccattgccggagatcgccctggagcagtttgaatttaggggagctgtctgcagctgacctctattgaaaggcagttctccatgtgtcgctggcatttctaacatcttgtgaacagaggcactcacacttttggaatatcttttcaaaaatatttgtttagtgaacagtctcaagagggatagaggtcatgtctccctctagagagaagggcaggtttgttttctgtccctaaggaagagaatgtcttccttagggacaaaggttaggcaaacttaccatccatcacaaaagatttcggttctctaagctcagagatgatgtcctgtaatgcagtccattatgtgagcaggtgtcacctgactcccataagtcaccttgtagggactggggcttggagggactggagcaaatggtgatgctctggctattactattgttgtgaataatatattgtccttgatcttggactcaggtgtctcatgtcttctaacagcatccatgaaactggcagaatgactcattcgcttgaaagtagagtaaaatttcagacctatcacagtttttggggacctccatggtggatctaggggatatgcacagggttccagctgtgactaccaaatgctatgcttcgctctattgatagcagtattaacaggatagtacaaaatctctgttatgtcctgcatgtttgattgagcctcagacctaagcattgtgttcctctaagtagaccagccctcttttaaggataaaaataatattaggggcaaaacctatgagtgtgtagaagtatattgcctattgaatactcactatatatttcattttttcaaggcaagacacgttttctattttgtaatatttggaatagaatagattcactgattagtgaacattgtaattattcttttctgaattaattatgttgaacacattagaaaattgctaggattgtcttttgtaatggaggtttcatgttgtttccattttcaaggagttctctcacgtactgtggtatgcagagaagggttgtcttctgctgggcccaaggaggcatcagtgggcttgccccacctccaccccttgccactggttaagttgggtaattgaagttctttattctatgaggccaggtctgtcatatatcacaatttcaccaatatgatctggatctgtagctaaattctgtcccatttcaaagttttctttgttctttcacccttgtcacattcttttaatgacattgggcagggcaggtctctctacctgttttttgttttcctcgaagaaaatcttggacacttggaccctttccttagcaacttcaaaggaaaataattagtttggattttgattgaaattgtaaaaaatctgtaaaaaatggggaagaattaacatcattattgatattttgtcttcatattcatgaacatgttatttctctcattttacttcaggcttctttagtggcttacgatagttaaaatgtgtaattttctacataaaatattgcatattttgattttgtatggtatattatatattattttgcaattataaatggcacagtttttaatattacagtttacaactgctggctgaaagtttatagaaatgcactttgcttttgtatattgaaattattgcagccaccttactgaactcttgttaattctaataatttatctgtggattctcttgagttatctatgcaggaagttatatcatctgcagattataacaacaggttagaaattttaaaacactttcacatacattatgccatctgattttcccagagcaagtattatcatctccattatagaagtgagaaaatagatcaaaagattttaagtgacctgccataggtaccaggtaccaagttattgaggtagaagaatctagtctcatgtcatcttatttcaatccaacactgtgcctcctaaaatcactcaccttgaaaaggagatgaaaactacaattggagagaagccacggatagtgggggtagatggaaaagaggaaaataatttcacttaccatgtgaacatcaaaatatcatgaattggctaagtcttgatttattggccatagggacttacagactcctttttattttttcccgtttgcaaggtttaatattattggtatgtctataaaagtaaatatttcagttttgtcccaatgctactgaagtaatgaagtccttggctgcaattacacaactgtggcaagatccagctactgcagttgtaatggtggcctcataagtggtaggaactagtatcagtaactattctgcctctcataatgctttgtagaatgacaaagatgtcaccaaagagtctatgtttatgtcatcagaaccattattgcaaaaagaaggtcaccatttcttcttttgtcttcactctgcaaaatctgcaaaagtactttagagtttggattcagtaagagtatatcccatttcttcctgtggttattttcaaaagaggcctggaaagcaaatagaggaatttccatttagtaaatataggaatttcttccactgccttggagaatatgttttctctccaatgtcaagtagatatattggaatctacccattggataataaggaaatagagtctaggaaaactcaagagcaattaagtgttggtttccatgtttataataaagatctggcatctccccaagttgtgcttgaaaaaaatatgttttgttataaagccaaacagctcctattcccaggtagttcaatattggttcatagtctgcagtgattccaattatgaaaccaaactggattgaggtgtatatactgaataacaaatattttacaccatacatgtcctatgacatgagatccgtctcatcccaaatgctatctaaaatgcccagtgcacaccaagaacctcttaaattcccttgttgaaccatttgtttcatatggaagtgggaattacggattttcaagcaggacttctggttgtcactcacatgaggcagagctagactggctgtccaatcagtaaatgaaatgatataaacctaatcacctccaagacctgaaaaccacactccttgattcttgccaatacaactccatatggaaacttactatacaaaatactccaatgaattcaagtgccagattgttggaaaccttccttaagaaaaaagaaatctcttttattcaggtaattattttctttaacaaagacaccctcagttttatttaaggggcttaaaattaggtgtcctttctctttttctttactctgaatgcttcaaggaaagtattttagagcttatattttagagtgtgattttatagaaaaggagcttcatcgtggaaggttccatgcaaacccactaatgtttgaaatgatcctttaagaaacagcttttggctgggtgccctggctcccgcctgtaatcccagcactttgggaggccgaggcgggcgtgtcatgaggtcaggagatcgagaccatcccggctaacacggtgaaaccctgtctctactaaaaatacaaaaaaaaaaaaaaaaaaaaaaattagccgtgcgtggtggcaggagcctatagtcccagctactcgggaagctaaggcaagagaatggcatgaacccgggaggtggagcttgcagtgagccgagatcgtgccactgcactccagcctgggcaacagagcgagactccatctcaaaaaagaaacagctttttttggtttctgggacagcatgagacaaagccaaggaaagaagatgagaaaacagctgaagtgcaaaaccacaagagatttctcaggaagatacattattaatgcatcttaaaatgttatcattaccaagactgagagttgacatgtatgtttgcaggctactttgcttactcttcttttggaaatactaaacaaaacaaaagcaagtggattgataggcttttttacgaaccttgctgagcaacaatataccttcagagggctggggatgtatcatgtaactcatgtgtggcttagttttagaagagtcaagagaatactattggtacaaccagaagtaattttaaaacaagtcatttacttgaacttcttggaaacaactaaatatttaatacccagaaatattgcttacaatgtcttctttcctctcccatcaccatccttaaacactataaccagatttgtacctctttcaagtgctcaaaaatctcaagtacaagttttgcaagggtccccgttggaggccagggcaggtacatgctgaagctggacaagccagaagatctttaacattctggagaagggagtatttaggaacattcctaagaattatatatatatatgctatatatatactatatatatatattatgtatatatatagtatatatatgctatatatactatatatatattatgtatatatattatgtatatatatagcatatatatatattatgtatatatatagagagagagagagccaattccacataaaactgcagaaaataaatgtaataaatcccaaatcaaattttagcttgaccacttctaagttctgagttgacaaagtgtagctaattatttctgggttttccaaatctacactagtgtttccttattttgaataggggcttttaataaatgcctttaataaatgcttttaataaatgcccatgtaaggatgcctctaagtcagtcttgcagcatatattagtgaggagtagatttggaaaacttgactttccacaactctgcaagactgagaaaaattgtagaattcatttagcttctgtttggcttccctttgctatttatcttaataactaagtgagctttctgcccttggacaaagcccaggggaccagtcacacagagagattcttgtgtgcaaatgcctgcttctatgaaaaaatctctgtagagtaaaattcattagctgtcatggtatgtgagcagaatattgaagttttgaaggttgaaaaattcaattatttgcttgttgagaagcatgcaattcttcagaggtatcattctgaatggaagtttttgtaaaaagaacagtaagcatagcatcggtcagaagagccagatttctcacttttgtatgatcttaggaaatgcaaccactcaatgtgtttccggatattcctctgattaggttctgtggatgaaactgttacatggactgtaaaacattgtagaaatataaaacatggcctggtgcggtggctcatgcctgtaatcctagaactttgggaggctgaggtgggcggatcacctgaggtcaggagtttgagaccagcctggccaacatggtgaaaccccgtctctactaaaaatacaaaaagtagctgggcatgatggtgcatgcctgtaatctcagctactcaggaggctgaggcaggagaatcacttgaacctgggaggcggagcttgcagtaagccgagatcgtgccactgcactccatactgggcgacagggtgagactcagtctcaaaaaaataaattaaaaaaattattattctcatttatcatgtacctagtccataatagacatctaatagatattccttgaatgatttaatgaatgaatgaacaatgtggttactctgaacccattgatggaatatttaggatttcagattgcatccatactaatattatatctcctgccagaagtctggggtcaggggttgatacgtaattgtggtttttcttgttttcctaatttttgcatgagtttcttttgttatctgttgattttcatcttaagtgtcaaacataaagagtcatttcaattcaacagacatttattaaacccttattaaatgccagggaagacatcatctctaccttcaaggagtttccagtctagcagtaatttcaaacatgtaaaggagtggtattacagtggggcagattgttaccaaggtgctatgcatcatggagaaagggcattgtcttactctggggagcaggggagtgacacctgtgcggggtgcagaaggtactgtagacagagtgagcagcaaaagcaaagctgaaagtatagatgagtgggggttgtgagtctccagaatgttgttcttcagaactgttacttgtattgctagattcgctttcatataaaccctctttcaacttgaggaaccacgtttgaatatttatcatcagttgtaactaaggttttacttcttgaactgtaatgcttgagtggactgattgttctgtgaaagcaattagcaaatcaagtcagatggcaccagaaagctgcactgtgaactcaaggggtacagaaaatatactccggctttgttgctatggtaacaagtggttctcctgcgttttagttccattataggccatggtgataacagtttctctttgggtaattatgaaaaataaaggagagagaaagaaaagccacatcttggtgtttgcccctgcgtctaacagctgcattttattcctgcaactgttaagggtattggaatgaattcttgtaaggggcagctattgtgataactcttccctgaggatccatgtgacattggctttatgaacacttccaatgtgtgcaggttacagggaggctaagcatccctgggcaagctatgctgcacagccagatccacgaatgggaatgctggggtctctcacctgcactcatattaacagccctcttggtaattctccagcaagatgccatcctttggaccagtggtttgcaacggaggtcagcggtggggaaatgggggaggattttgccacccaggggacatttgataatgcctggagacattttgattgtcacaacaatggagggaggtgtgcaaatgacatttagtggacagaggcccagggtactgctaaatgttcttcaatgcacaagacagctagcaccacatggagttatctgcccacaccggttcatagtgctgaagattagaaaccctgctttggaccatgattttcatcttttggaatggctggcattcaggaagtactagcagaaccagtgtatgaatctgatgctgtaaaacggatttcttcggggtgagttttctgtgacttcttagaggatgtcggagatgttcagccttggaagaacgtgcattacaaagggcaggctcaccagagccctgcagtgaagggctcatctcacactagcatgactcagaagcccagcaggctcaggtgctcagttccagaaaaacatttctcttctcctcatattgtattacttgtttagaatttcacgtaggtagctgagcacgttgaaatgacacgtttgttgtatttagtttgaacaccatatgttgacggggctgcaagcccaacaagctgtttttttataggatttcagctatcaccctttcatcaacctgggatcaaacatacaatagatagcaaaagaacacacacacacacacacacacacacacacacacacacacttattatttgttctacaaaggggatttcaagcataaatcacttatcacgctctatgcaaatatcaacgacctgtcagcttacttcttatttttctgggaagctctcccttaaaggagcaagaacaaactgccttgttgttggtatctaggggctgttctggtgacaactgtgagtgtccatggtcgtggaatgtgcccactcatcagccatttctgtcagggtgaatatctcacctgtcacagggaaaggatatcatacctgtgtgtcttagagtgttccccagcagcattgtggagcttcacagcctgacatttttcttcctagccaagatgtttctgacatgtcagtccacgtatgtttactcccagttttgcctaaggcgcctatgatcactgatgccagtcagctacaaatcatccaggaatccttccaaatccctggaccttgatgcatccatctactaaggctttgttagcacatctccagcagtgtgccagcccctgtgctgaaggatgcagatctaaaaatcaggaagttgtggctcatgctttcaggggaacttggtaagggaaagaaggcacatgtagaaaataaatgatgacttttaatccaagagaaggcatgtacaggggcagcgtagcccaaagaggtaggggtgcattggcctgtgggtgtagaggaggctccactagtggaggtgtgactttagagctcgagcctagaagcctagtgagaatgtgcccaggcgggagagaaaagctgggatgcattcctgggagcacaaaccaatgtgaggtcttccagggactcccaaacaacacacaatggctgcctggatgtcagatttctgttgctaatcagatgtaattgaactggcacttgagaaagacagttttggcagtggagagtaagctatatggattggggcttgcgaaggtggggatggcaggccaaagccagggagaccaatgaataaaccattggtggtgaggacacaaaggaaataaaacgtatagattcaagagagaattctgacatggggcccactagccttggtggcttgttgggttaggggccaaaggtggtgtctcagctggcagtgacaaaggaaggctagtgaagaatacgcttctcatagctttcacaacatcttgttcccagctgccccagagaagtatagaaaccaagtcaacaaaacttactcccagcctcccgcaccaaactgtattgctgcatataaaaccctggaggcatcactggcccctggcttagaaaattggatgaaggtgagacatttcaatgaaacatactttatggtaggagagaagtgtggataatgtttggtatttcacatgataaatttgagatgcctgtggaatgtacatgcaggggtgtccagggagctttttggtaggagctcagagaaagagctaagatgaacgcactcatttgggaggaattaaagactaggccagtggttcccagccctgagtgcatcatctatggggcctttcagaatcccaatgtccaggcccacccccagaccaattatatcacaactatacagcagcatattttaagggatggaggaatagttcccagaaatcgtgctggttctctgtgagagaagaggtaactttaagtggtgccagttcatgcaggggcttgagaaaagaagtggagtgagtacaggctaaaagctgcaagtcctggaagaggaaggaatgcaatggactgatggccaaccagtgctctgaaccccatctgggataagaattgtggatctgtgtctagtctgcatatttgtgcactcattttgccccagtgtacttaccatccaacttgaggaaggagggtatggtggtatggtctgagacaacggaagggcaagaagggtttctgcagctgactttggaatccaggctggataaggaaggcacaaaagtcaagagggactgatgatccagaagaaaatcaagtaaggaggaaggattggaggctgtgctcaaagactggaatatttgaggttaagatttccaagtggtacaattatagtggatgcatgacagagagtggctgaatatgctttgaggcgaaagctgttccaattgaggtggaaagcataagtgtggagaagtatttgtttagtcttcttgtactcctttgttctagaagtctgccttggttattcccaacttccttaacataaaggctgtccaatggtgactgcaagtgttttaacacagctgtcttctatagaacgggttattattatatctgttattttaaaacacccacccttgcatcaataaatatacatgtcaaccaaattctttatattaattgacaattatttatgaaaattgcaatgccttaagtgaaaaatttgtggagccagcatcccttagaaacacctttcttgctagaaccatgtgttcttgctttgtgactgtttgcatgttttattgctaagtctgtagataacattctttcttgaagattattaattatgtatacaagtacccctgtgtaaaagtattcacttggaagagacccaggaatctaaggcaggggccagcaaactgttcctgtaaaaagccgagagtaaatattttcagctttgcagactagacaatctctgccacaactactcaactctgcttttgtaaccttaaagcaaacatacaatacatgaatgagttgtggctgtgttccaataaaactttatttacaaaaataggcagtgggctggatttggtctgagagctgtagtttgttgacccctgatctaagataataaaggactctagtggattatttttgtgggaaggtttccaagttcatattttaattgatttgacttttcagttttggcttcaataaaaccatttaaatcatagtttgttatggtgctatagaaatgaagtaacttgtaaatgatgacacatggaaggttctaactacagatgggtttgtggaaaactaataggtcacgatattctgatgtagacagtcatcaggcttgtcatcttaacttactcccttgaagactcaagtacctcctccctcatcttggagaaagtgcgtgtctgacgctacagtgtcatttccttcaaccatgtaatccataggcacaagtgaaatggtgtaattcaatgttgactagaccaatgacggtattctaaactatttccttatggaaattcagtgtcttctgggaaaactaacattagattgcaaatctgttcctagcatttagagactcctcattaataagcactttttttaatagtaaaatatggcctggccaaaaaaaatctctgacaagatgtgagactcaatgtcgttcttatgatttagaagataggctgaagtgagatatacttccctacaaataaaatagatattcctcaaaatgtcaatcgaagttatgtggtttcattgtctctgtaaagtatttacatatttgcaactaaggcctattaaatatttattattaaggttgccaccctctgaggtggtttgatgtttcagtcagggcccagaggtttttttaattttttttcatcagtcattctttggaattaaatgtgtgcacgttggtaggacagaaaaggaacggaatgtcagctttctgccaacaactcttctggctacaagagaatttctcatttttttttcttttcagtgtgagtcacatggagaatttatctgaggagggcatcaaaagaaggagtgaaaagcaattaaggagaaaaaacacagttccttacatccatgttggtccatattggaaaatgaatactgagtatcatggctggttatcaatttcttttctttctaaagcccaattactgaatttttcacttggaacatgcccagataagatggaacttattcaggctccattcttaaaaaaagataccagaagtcatgatctgcctttctcactctggacatggaaattctcatcacagtggtcagttgaggtgatttcaaggaataatacctgaagggatcctttaattcaggttgtagaacaaaagcccaaacaaatcattaacaataattaacctctcagatgtaataaattacttttcaataagttagtttattgagaaatgtaatttgaacatatataataacaacagtctgacactaacttctgtaccctctgcttgaagcaactggggaactctgactgtggtgtgatgggaagttaactttactcaacctgtgagactgggtctttcttctgaaccaaccacagggcataaggttcatgctgatgtgctttggaatgtgcatggcccatcctatctatttctctagcttctgctggctttaattcagagtttctcaacctcagcactgttgatatttgggccacatgtgacaggccatcctgtgcactgtaggatgtttaacagcatccttggcatctacccactagatgccagtagtgcccaacccctgaccctcgtcacgacaaccaaaatgtccccacacattgcccaatgtcctctgggaggcagaatcaccctggttgaaaccactgccctaataagatgttgcaaagttccagatttgatatcattgaactgatattctaaaaagcattggctacatctgcatgctgctgccctaggcttctcttgacatatttgatctcaactttgcattgagtcttggagggaaggggcaatgtgtgtaggatgtccacacatctaggtttgcctaggataatccagtttttgtctgtcatctggatgtaattattaagtagcaccaccttgaaaagtgacacagtaagagtgaaaattatctggcccccatgtggtcttggaaaatggggaagagttttaagagttcttacaatgtcagaaaacttttaccttgcagaggtttttgatgccttcctgtcctattttaagagcctgggaattcaactatttcatgcccatatggaccacatattcaagtcttcagccttaactcttaacagcttcagtttttgtccaagtaggcaaagtgagctcagacaacaaggaaaagaacagtgcttttaaaagaatgttcttctcaataaaaataaattctaaagttctaagtagggagttactgctgagtttataatggctttcatatttgcttttacaatcacagtattgctgggctcaggcttcctgcttggaaaagtgctttgcaatgcttcagacagaagagaatgattttagaacaggctgggctatgaaacaagagagttgaagaagcccgaagtggtttgaaagcagtcattcctttggtgttaaagataggggaaaaaagattgttcccccttattaaatcctgtcacatgtagacaagagtgcttgttaaagcctcgagtggacatttgcattgtgtggttctctggtgtgtacctttgctaaaataagtatgcaaaagtctccaggtagtaatatgcccttgaccctgtaatcagaatcggtctctcacctggaaatgtgaagacaagatgtttggctagtaatgaaggtaagataatcatgtgggaccacaccattcaaaaggttgtctcatgctcacaagatgaatgctatatttccagccatcatgcccatgtatcagacagaaagaataaggaagaggggagctcaaaagggcatccttgctgagacagcttcccaaaattactgaagccctcaacctaacacttgctctccaatatcgatagttttttcagccaggtatttttaccacctccttcagtattatcttaccaatgaatgacaggagaatggatattgggtagacaattagcaagctctggtatatagcccaacttttgctaatgtttaaaagtcaaaaccacacaaatcttctaaaccagtggtcaacattcgctgcctgtggactaaattcagcccgctgactgttttggtaaataaagttttattgggacacaaccacaccccttcatttacatatggtctgtggctgcttttgtgctgtcaaacagaatagttgtgacacagactgtatatatgacctccgaagtctaaaatgtggtctctctggccctttatagggaaatgttgccaacctctgttctaaacagataactcaatgaaaaaaatgggcagaagacatgaacagacactttacaaagaggatatccaaagaccaataagcacatgaacaggtgttccaactcattagtcaccaggaaatatttttttttttttggttttcttttttgttttgttttgtttgagacggagtctcgctctgtcacccaggctggagtgcggtggcacaatctcagctcactgcaagttctgcctcccaggttcatgccattctcctgcctcagcctcccgagtagctgagactgcaggtgcctgccaccatgaccggctaattttttgtatttttagtagagatgaggtttcaccatgttagccaggatggtctcgatctcctgacctcgtgatccacccacttcggcctcccaaagtactgggattacaggcgtgagccaccgcacctggtaggaaatgttaatttaaaccacagtgggatggcactgctttcccatcagaatggctataatcaagaaataaagagagagctgacaatatcaagcattgcattaatatgggacaactggaactcttgtacattgctggtggcactgtgggttggtataaagactttgagaagctgttgggcagtgtctactaaagtagaacatatgtccccctctgtgatggagccattccactctcaggtatacgcccaacagaaatgcctacgtatattcaccaaaagggatggaccagaatgttcacgttggcactatttattaataatccaaagttggtaacaaccaaaatgtctatcaacaatagaaaagggaaaactgtgttttattcatatgatggaatacttttagcgatgaagaggagtctcgctacctgctacaacatataatattgacaagagaaaccagacaaaaaagactgattctgtggccttaaagttcagaaacaggcaaacagatcaatggtgtttgaagtcagaatatggttccttttaggggtagagatcaggagaggactcttcatgatttgggtggtcgttatacagggggttcactttggcaaaatgcagagttgtacacttatgagttcagaatttttctgcttatatattgtatttcaataaagagtttcaaaaacagaaaaaagaatgcacatctctttaatgatagaaatgtatcagcattgctctcagccagttttctattgaaaatgatgcctatgacatgtccctcatgaaacaaccacataattagccctggccctttggattctagtcttattcacaaatggaataaattttctgttttcagatttttgcatttgactacgtctaccctgacagtgtgactgactaggtggtctcagctccacacaccccatggcaaaaataaaaaggttgtgtctaaactgcagtggattaacccactgagcagactgcgtgctcctgggctttcttgccaaaggagagagcaaaggatgcaaagaagctgaatgtggaatttatggaccctaagaaggcaatttggaaggattttttcccccgtttctgtttagtcttaacttcgtgaaattgtaaagaagtgctggagactgggggagctgtttgtatgcaaagtgttgtctgcctcagttgtgctcctgaattttgactggctgcccagtcttatgtgggaagctgaataaaatgtgtatacttctaaaaaaaatcaattttagattttacaaaaggagtcaaatattattactcccaaaggaagaattgaggcagttttttttttttttaagaagagggtcagaagaaacagccaggtcttttttaaaaatcacccatattttttggctgacatattcagttaaatttgtcccctctcattgatgccggtggggagttataaaggaaagaaaaatattaaatgctaaaaatgaatagaagggatgtaataatccaagaattagggcaattgatgacaattttttaaagacactgctgtaaatgaaatttaaataactgtaaagctagatattcaatccaatagttatatacataagatgtactagttattgtttcataattatccagaatctttcatttaaaaatatcattttatgtttcttagactgtatatgtgtatatgttacgtatatgtgtgtatatatatttcaaatacatatgtgtagaaattcatgagatttttttttaagttaccatcctccaaaggaaaaaaaaaaaacctggcaagtgatgagaaggaattggagctgtgtacaagaatcttagaagatttaggtgatctcaatgcagcctcccaggtctcgtgtagcacctaaaaggatcattttttaaaaagaaatccaaatattagtttaggagaaaacacagaaaatctcatgactctcgattttgtgaaaattaaaatctgacagtagaaagcaaagtggcatggcccctgtgcttgggttaccgctgcttcccaaggggctccttagggaaataacttccctgttccttctcttttttacttggcagtcccaggaggacagttgagttgggggactaggggcattggaacaagtgtgtccttgccaggctcctgtggttggctgctagttgggcttctcactttgtgaaccaaaacgtttggagagtcttgtcttaggaaaagcaaattattctgccccgtgatgtcccttcagtgtggaaacatcaaggagatagatctcactgataacagagttgatcaggggagagtatgcaaagacaagacccaattatcaaagcacagcctttttaaagggttttgagtagattgcacttgttttggtgagaaaccaaattagagagttctgcctcctaaactctacatagactaatgtgttcttgggaagcacccctgctctgggagtcgcatttacctcttggtcatactgaattccttcgtaggagggcctttgatatatttattctgtaaccaaaaatggcagccctgagattggagagcatccctttgatttcctgtggactgtccttttctggagatatggtttgttctttcctaagggtcggaattatgattctgaaaagttttgcttttgaaatactacatcacagtgtcctaatgagaatggtgagccatctgcagcattcagcacttgggcatggcaatcaaatctgggcccgatgaatgattatgttatataaatcaccaggttcctccaggcagcagtcattgccattgtaattgattcctgatgagactgtttcttgatttgctggtgctgtaaccactgatgctgattgttctcatctcctgaaattgtatttagtaacagcattcaacaaatattactcaagtggttattgtatatgggaccaggctctggggttaaaaaatgagtatggcagccctgtctttgaggagacaagtgtttcaggaggaaacagacaagatgagcatcctaacagaggtacgaacaggaagctagcaaagctcctattggagggtggtgaggtgaatcggggaatgtccctccagaaaatccagagaggctaatgggagttacacaggcaaaggagaaatggaagggaggtgacagaggaagtagagcattataggtggagggaaatttctccttgaaaacaaaggaatcacattcaatgtgtgacctagaatttcagtgggcatctcctctggcaagaaattgagtagaaggatggctgcattttggaatgttcaaagtgtggagaggatgctatgtgtactgtagtaagtgcaaaacaatgggttggatttttaaaaattttatgtacacacatatttatctatatagtatgacgtgacatagaagttacagcctgttgaaaagtttatgccataaaaataacaattcgagttcacttcctgtgagtggcctagggtttttaagacaaggaagaataataggatgtcaagggccaaatatagacatggatgttttagaatcctttgcttttctgatctcagagcatgtggcatttggtgtaattgaatccaggacagatgggtgcaagccccattcaactttggagggaaaccaattaacaagcatgtgtccaaatgtaggattaaacttgcaaggcaagcgagtggcttccaataacacttaggaaacactaattagtgagagggaaatactttgtcaaatggtttgagaatagtaaatacaaatgcaacaagggaacattgtttttagttacaatttatattgttctagaagaaatggggctgcaggtgctttctacagacaaaatgaatcccaaatacatttacctaaggcttctagaaataatacaaatgtgtctttaaaagctcagatacataaagcagtagcatccaatttggaagtcctcttgatctaagcagtctggtttctctttggtaagttgcctgtttccagactataaatgaaacaaaataatcactatgttaatagagatgaatatatggaagataatttttttttcttttgggcttataaaactccaggagggaaaagatgaaagccaaaagtagaaaaagattcaaaggaaacaaattgcaattttagttttctaaatcaggggtgggtgaacattttctgcaaaaggccagatattttaggtttagtgaacatgcagttggtctctggcaactgctcacctctgctggtgtagtgagaaagcagtcatagacaagtaagtaaacgaatgggtgtgactatgttccaagaagactttatttatggatgttgaaatttgtatttcatgtaattttcatttcataaaatgttattcctttaattttttccaaccacttaaaaatgtaaaaacaattttactcaccctgtgctagatctgagacaattatctccccacaggtttgttctgttagaaagtccttggttgaaaagcaacatgctttccttttaaagttttcataaatttattaaataatgatgttttcccccactggtgttttcctaggtttttctagaatgctctgtgctctcgtaacactttctaacatctgttgtcatcatgcatttattaagcactcaccatgaactgaaatgctgaggacagacgtcagaggaaaagaaaatattagcaatagaaagtggtacagaagctcctctatttatggaatttcaactcgtgcactttcagagatacaaacaaaaccatactctggagcaaagccctctggctctctcttcaccaccaaaatatgcgtcaagaggttctgggacctcttttattttctgccctttttaaaaagaatttctcatttttcagtctatggaatatttgctgtctttctgctaggtgttgaggaattttgccaggaaccccatcttatgtgataacctcagaggacttgaaagaagaaagtgctagtaagaagtagtagaagtaaaggcaagatagaaacaatttctttttaattgaaataggtcagaaaaactgttgtaagccctttggcaggaagaatgattttgaggacaaagatcccatcatacaacctgagagaagctctgtacttgtgtaataatagcaaacattgatacagagcttctatgtgcctggctgtgttttaagtgattacacgatcacatgagtgtgcatgtacactaatttaatcaccaccaaaaaagtgttaatcaactaatgagctcacgaaatgattgatgaaacagtgaaatttgaacgtggctccggaattagcatcgtaggcctatttgtgttaatttaagagaaggaaacaaatctggtaagtgtacccggtcatggatggttccatgggtttgcagcttttggcatctgcccaaccttaaagtaagaggcagaacagcaatgctattttggagtaatattacggatgctaaagctgttgaggaattccctgtggtgcttgtgggcagattacccatttcagaagattttcggtgtatgaaatgaaacagatcgaatgtaggcaaagatgtcagtcaaagcatttatcagtaaggaggagtacgaaaagaccgactcatacctcacccaggtggaaatctggaggttgcaagcttctaccctgttcaagacctctggacgtaggaacaaggtcatacatagcctttagagcttaacatgtattcaaccaaaaagcacagtggactctgtctgtgctctgcccggaatatctcagatcttttaccagttctgtgtgcctgtcccattcaccagcttctgtgtagttttgcttctaatgaccaacatctgtgagcactctgtggggttctggagcagttgccctatattcacaaagagcaggaagtgcctgggagtttacatcaccctgggggcggggcgtcccacagcccatgactgactgatgtgtgtgaaaatattaaagtccaaattctttggcgaaggcgggacaaagtttagatgtaattaataccccagagcttccctcaggaccagactgagactgggactttgctagaaatcacacccttacttggctttattcccttccctaccctgttatgctcaccccttaccagtttctcctgggaacaggttcttaataaatcaattgcacatcagtctttatcttagtatctgcttctgaggaactctacctaaagcaacaagcacatatattattaagacagagaaatatcgtaaggctttaccttaagtcagcaatgaaatattgaatgaaagaatggactgaatgaattgatagaagccagctttgcactactcatgttgcagttagggaaacagaaaaaggataaaatattgaaacagtgactgttacattttagagtttgaagggcgtatagtgagactgcccacatagtgcagcctctctggctgatggtaatctaggttcagcttacatatggccagggaagaagatactaccacctcctgggactgttgccttccatctagatttgttataaagtcagtccttccttcctctttccctttctccctccctccctttcttccttccttatttccttccttctactttatggaggtaaaattcacatgccatacaagtcattcatttaaagtgaacaattccttggtctttaacatattcaaagttgggtaaccactattaacataaatttcagaacattttcatcaccctgtaaagaaacactgtaccctttagctatccccccctcaactcctcaacccccaagctctgcagtcctaggcaacccgacatctactctgtggatttgcttattcttgacattttgtataaatgaaataatataatatgtggtcttttgtgactgacttctttcaattagcttacaattttcgaggttcatctacgttttatcagtatttcattccttttaatggccaagtaatctttcattgtatggatagatcatattttgtttattcattcatcagttgatggaaatttggtttgtttgtaccttttggccattatgaataattctaccataaacatatgtatacaagtttttgtggacatatgttttcatttctcttggctatatacctaggagtagaattgctaagtcagatacagaaagttctttcttatattcagacaaaatctgagtctccttaacttccacacttggtacttatccagctttctgaagaaatatggacaagactttcttatgtatgacatcccctcaaattattcatcatctttatgtcctccttcaactttcaaagactgaatatcttctgttctttcaatcattccactgcaaaaatgggacttacagaaatgcaaactgatagctttgaggttgtcatattatctgttataatgtacaaaacagctttcttttgttccaaatctcagactttcccatcaacaacagggaacaagtggctaagtttattttgctaagataagagaaaacaaattattttctgggtaagaaggcttttcgatagactctgcatgggttttccctttggaaaatcaagaggactaatgatttgtgtagtttatgtatacatttgtcatttcttgacatgttaatgtgagaaaaaattttgtgcttctgaaaaataaaattggatggaaatcaattatcttaagagctttaaaagaaatcacgtgtagcattctttttattcttagtcatgaagacaatggggagaaaacttgacaaaaccacaggaaaatgtagcaagttacttagcaggctctgggttgtgctgaactgggccaaatgttatggtcatttcttcttctgtagctatgaatggatctaatccttgcttgttagtcatacacttaggactattttccaccttcttttaacattaaatccagagctcaggatggcttctgactttgtctcatgctatctgcatgacgttggacaaatcacccggcctttatgagtttcagtttctgcatcatactaccactacatcagtggctttcaaactgtgttgcacgggataacaaccaaagaatctcactaaaaatgtcaatggtgtggtgctgcaaggaattgtgcaagtaggctctggggaggtcctcaaaatctatttttaaaaacccacccaagtgatgctgatgcccatggtcctgaagaccataccttcaaaaacactgactagccatttccttctggtccctcttcctcttgttctgtattccactgaaagggagaagaaatcttattatctttccaggtaatatcttttcatctgtgctgtgtgcaaggacatgaaggaagacaactaaagttgaaataatgaaaaaagtcccagtctgatgcttagattctgatttattagaattattttgaccataacaattttaaccataaagtagggtttcttaaccttggtactattgacatttgggaccagatcattctttgccttgtgtgtgggaggctgtcctgtgcattgtaggaagttgagcagcatatctggcctctacctagtagataccagtagcatctccccctccctccaagttacagcaaccagatatgcctccagatattgtcaaatgcaccctaaggggcaaatctgcccctggctgagaaccaccttcataaggcatggtccccaaagaaaataatcaagaaattaggcttggagcagttttcttcggttggttcttactgcacagcaaggcaaagaaggccctgctaaactgttggttcttgacctttatgtaccaagcattcctgggggatctggaactccctggctcatcctctctatttgctggattaatgggatacagacagtttaagtgacttggcaggagaaggacattctgttttattctcctcattttattacactcctgacaacgaattcttaacatttgccttatatgttctgctccctatcattatcacaagatagattagttggcggggggaggggagggaaaccaatatatgcaaaattgctttgaaacctgcaggcaccagagtaatgccaggtgtcatcattcatcctactcctgagcctctgaagccaggggtttcttgaggttataaaagtggtttttttaggggggtgactagtcaagcactccaaagaactccagagtggtcagttttgatcacacagatggccaatttttacccagtctgttagccttttaacaacacacagtgttgcgtggagacccacttgtgtatgggtcttcaacgatgggtggagacccagggctcagctctactcttctgctctggagaactttctctttgttttcttgggtggtgcaagacctacttcactgaaagaaaatgtgttgttggtgtgagaggtactgctaagtggaaattattaaaggatgaattccttatgtctgtgaaagatttctccgccttggcactctagacatttgggaccagaactttctttgttgtgaaggccgtcctgtgcagtgcaggatgtttagcagcatctctggtctccacccactggatgcaagtgacacccttcccctgcagttgtggcagccaaagatagcttcagatattgccaagtttctcctcagtggcaaaatttcccctgttgagaatcactggcctaggaggtgtggatgggacaccagcaatctaatgaatgggcctgatttgtcaaaaagaatctccaccttgaaacatactggaatgacctgcaaagagattggggtcaactaccatttacatctcaactccaccatttattaggtatgcaaaacaggttaattaacctcataaataaaattaagatagtcatactttccttcccagttgttctgaggatccagatgtttgcaaagcatctagttgagcctgtgatgtaggtgcttaatgaatagtggaattgttaccatttcaaacaataattctagcacctgcggtgttggcgttgtcatgggaattctgcaggctttagacaactgaaacactgtgcaactgtgcagaagaaaggagattatgatcagaggaatgaaggcaatagactaacattagattatggatataaatgaaaaatcatttcttaattcccaaatggttatttggaaagtcgtagctggagaaattgcggcctctcctttttgcctaatgacccttgaatagaacatatatattagaaatgtctctttttaggcactttttaaggataccctccctggctctgtggcatggagtagaaattcttcagtgaaaatatcaaaacggcaaaaaacaagataaaccaataataccaaatagaacctactgtaatggtcatttatttcctcacccttcctcacttgttttctttccctgaattctcggattatcatattctcgactccaattgatgcataactttatgatattctttgtactagggtttgaggccaaagacaatggtactatgctgtgccaggatgttctcctctctcttctccatctctcctatgtgactgcagctccagctgcaggaattcctccttcactggtcttcagcccagctgtcttcaggctgggggttgtctccttaaacttacctggaaaaaggaatgagaaccttcattcttccttagatttcttctatctccatatccctggaagggttaagagggtgggaagaaattatggctatagagtaaaatgataattcctgaaatggcatatatgtttacagttatcaggctgagattttacccccactttgctgaaattctgcctaatgagatgtcctccctcaaaagcacattcagtgtatccattgctcctgtctgtgcgtgtgggtgaagtcggccttatcactgccaatgccagggccttagcagggctggtaggtccttcacttacaggagacacatgatttcagccaaggagggccttaagctgctactccagctctcctttctgatcctggagtttgatttccttaatttcatctttgtagccccatgaaaaagacttaaaaaagagacaactctaaactgtgttcagtcttcatataaactgtgttcagtctgtttatacaatagtgtaaataaagattctaattaatacagtttggaaaactgttaggcattgtctagtaaagttgaagatatgcatgcctatgacccagcaattatattcctgggtttggaccctataaaaatgcatgcacatatgcacaaggagatatgtataatgatgttcaagcagtgtggttttcagtggtccaagattgaaaaggacataaatgtccatcaacagttacaaagataaatagtaataaacacatataatggagtactagacagcaattggaatgaacaaacaacagctacatacagcaaacatggatgaacctcagaaacggaatgttgagcaaaagaagtcagctataataaaaacatacttatgaatctgtttacataaagttaggaaacaggcaacactaagctctaatatttatggatgcctgacttcctaaaaggcagtggatttcaaccaggggtgattatgcctttccccactccctgggggacatctgcaatatctagagtcatctttggttgccacaattggcgtagggggaataatactggcatgtagtgggtagaggctggggatgatgcaaaacattctgcaatgtccagcctctaccataaagaatgattggttcccaaatgtcaagagtgctggggttgagaaaccctgctgtaaaagggaagtgaagaagtgaagtcatgacagtgtctaccactgggatggaggagggaaatacagccaagggacatgggggtctagggtactagcaatattttaatttttgacctcagtgaaggttagacaggtgaatgttttgtaacaattcattaagctgcacattatatgctattgatttttccatttcaaaatgttaaaaatactccaggggctagattaacaggacaataggatggcatagtgtgggcactgggtttgggggaggggattccccatcttagagggtctcatagtaactctgttaacaatggtggggctgggccttcaagaagggcctgtcctgccatctgaagtgatttttagtactcagatgggccctcagctcttcctacactctgaagttgaatttgcttccacagatttgggtaaagtttttctgaaaaaagtaatcacccttgcattggcattaactgtggaaaattttaactcagcctataggcaggcagaataaatgcaaacaagtattttaatttaaatgctctggcagaaagggcagcattcagttctggaaatgctgtaatgtttagggacaggaagacatggaaattccacagttagcagggcacgttttctcttaaaggtgatgctagtagagtaactcatacagattatttttaagtcctctctggggtgaatgataaacatcagataaatttattattttttaaaaaagaaaaacaaacaaaaaagaacattagcctagcaggctcttaaccaacaaattggatgaacttcagcctcctctgaagtgaggttttatgtgcttcttgctgcctttttatctctctccattaccccaaaggatcaaatgtgcattttaaaaccacatgccatgtcaatatacagtttagttgacctagaacaatacctgtgcatagtatgcacttaaaaatatttataaagtgtggaatgatagacaatggacactcagaagggcagtggggtggatgatggtgaattacttaatgggcacaatgtacattcttctggtgatggataccctaaaagccctgacttcatcaccacacaatctatccatgtaatgaaattacactgttaccccatacatttatacaaattaaaatttaaaatttaaaataatatttgttgaataatgaccaagtgaacaaataacatgggaaggatacttggaagtagagatatgcaaataagaaattttgattagagtggtgttttaaatataccctgaaatatatttaaatgaaataatgaataatgtgtgaaattcaaattgtttaagattgaacagacttcttagagttctgcatgatcttctagatcctttctggagctttgagccttacacaattggactaagaattgaaggaggtggatgattcattccaaggtgatttaagagtcttgcagcatgaactgatcatttctttaggtgctttgcccaatctcacaaactcttcaaacacagagaaaaaacaatcctattgcacttgaacattttactccaacttagctatgacactttagcaataaataatgctagaaggcagaagtcattcctaaaatgtaagtacacagtgtggggctgatggagtatttttggcttacaagaatgtcatttagtgacttactacatttttgaaagaaagaatacaaaccaaatccaggatgacccagttttaagaggtgacttactcaggggtaatgatcaaaaggctatggttaaggttttaagacccagggatccaccttgtgttgtttaaatatattcataattaaatagtatttgtagggaaagggatttttagcttcaggggcttaaaggcaagcgtgatggaagaaaaagtcctaaggctggagtgttcacctttatgaatagaccacagtgaagtgaaagtccctaaactggggcttgtctaggccattgaattacatctgtacacacgtgcccccatcaggctgccctggctgcaattctctgaaagatgccagatggtgaagctcaagctggttctctgtcttattctgaggatctttgatgactttgctctaaaggttgcttttagcagcagaacagagtgagagtaaagagggaactttagtgtgtcatttttcgagctctgcctggacatgtcacagagcaaggaaggcctccaaggtcaatgggcatgctcatttctcctacaaagcagaagaaaggagacttgggtagatcaggctgtgggagaatgaaagacttgggcaaatagttcaattgactttctcataagacaggcaacactgtttggaagttcctgggtttggcaagggattgattttaaatttatttttatttttattttttatttttgcagtataaaatacatgtagtgaagggtgtaaattacactagtctgaactgtactgcacagtgaatgtttacatatgggtgtactctagtagctgccatacagatcaagatatagatcatttccagcaccctagaaggttcccttgtaccaccttcctagtcaataccaccttcccactttggtaaccactgttatgacacctattaccatggattccatttgcctattgcacttaaacatttgaatttcagttgcagaataaataagtgaaatcttacagtatgtacacttgtgtctgatttctttctcccaacataatgtttgtgagattaatccatttgttctgtgcatcagtagcattttcctttttattgctgaatagtattccatcatgtgcacagactacagttggtttgtcatgcatcagttggtgtacatttggatcgcttttatttggggcaattatgcctcaacacagtatgagcattctggtatatgatgagattattgtactctgtatatctaggggtggaatttgctggattggaaggtaggcctatgattgactttagcagatataaccatccagttttccaggtggataaactgtcatgggactatctaatggtagattcctcaggccacttgcacccctggcttcacattcccactgctaattataattatgctgtgattgttttaaaatattacatgccagtggatggttcattcaactaaattgtaagggctgaaattccggggccacatccaactttcctcccctctcctcccctctcctcttacacagagcaagtggagagtcattcagccggttcagtacagtgggaccctgacaaactggcacaagctacccccaagcacatcttccactttgtagccacccctctggggcttgcattgattgattcatgagtctggagtctctactctggccccaggcctggccttcctctgggctcaacttgtgggaggctggacgtaaattacagaaggacaaggctgtggagggaactcgctgatcttctccaaggtgttttaaagtgcaggtttccatgaggggatttcagagcagaggccagttttaagggttattgtgaacctacagaatgtgccctgcaagcccccctggaactcgggtcaccctaagtgaccagcatcctgggcagccttgtccccgcagcagttctcctgggtagcatgacttggttcctctcagtcctgccctccccaagggtccccacaatttgagactctcacagaagaaggctttctagaaagggaaactctgccctcccaggagaaggctctgaatctccttccactgtcaggcccacacctccttcaaagttagtgaaagtctctctttcttggaaacccaagttcgccttctcgctggcattaaaggctttggcagtccccgcctcagcagccggggtcccacgggtccggggagggtggggtggcaggaggcaggcgtgccggccagcctgacacctgtcgtgggcgcgttcggcctccgcagcccccaacagctgtcagcggcggcggccgccggagggacccgccaggagcggaaggaattaaacgcccgcccatcgcatcagactcggccgctccctcctcctcctcctcctcctcctcctcctcctcctcctcctcctcctcttccccctcccccttcgcgccgctgccttctccaggtccccaccggctccgcagcggcagcgggacgctgtgccaggggcgctttgcacagcactcggcacgcacggagcagggctcgcgcccaggggctgccccaggatggcagtgaagtgcggggaactcagagagacaccgtgaccccaggctgagcccaaggcgcgccactcctcccggaggcgacatggggcacccggtgtaccgcggcgagaagccccagctgcactacgcggtgagtgtcctgacgcgtgcagaggacacagggggcgccactgggccgctccgggtggggactgcgaggggcgatggtagtcggggctccccacaggtccacggctgagggggtggcgggtggccgggtacgtcaccccgaagtgccacctgctcactaactcagtggcgcttcccgaaatcttttagaaggtacaggggagccccaaccctgaattcagtgtttctttgccccaacgctgtggtcactgcatctgggacggggctggactccgccaccacctcgctgacaaaggctgacaaatggggttcctggggttaggcctaggtcgctcattcagccttcagtcagatatgttgaaaggacgagaataagactggacaggaggcagggccgcttcatgatctcagtgtgcggcgagtggatttgctgaagaaatgctgccgggagcgttggggtgcagccgtttcactccttagaaagggagtgcatttccctcctactttgtggcgggacagaatgttgcacattatcattaatgttgcacgctaatacaagagaataccaggggctcttctgtcgtaccttccccctcccttatggtggcttctgttctccctgttgatacaaagatttactggggacctactgtgtgccagggactgcgctaggtgctgcaggtactgcaggaaacacaacagagagaaagctcatgggatttgccttctttgaagaaggagtcaagattttaaggttaacgaccgaccaaatccagatactagatgagtatattctttgagagagagaaaagaaaggaaagaaggaaaaaaggaaagttgtttctgaggaatgactactacttctgaagatttcaaatgccccctccaggaagggggcagggagaaggtttaccttattccagtcttcagacattgattttccacgtgtgagatgtgtcgttttgagatgagacactgcagttgttctgtcatctgctaatttactgagttttccttgaattgatttgcactgttgagactggacgttctgactgccaactttaaaaattggagagaagcaggcagagagttgacaagaatcattaatatttataatcaggcaaagacagttaactgtctggaattcgtgtcttccaaaatccagtccccaacataaaaaaaaaaaaaattgtttttttgaagaaaggagtagaggtggacaggggtggtggactcaggcatcccggagctgctccagttggttcctggtgtcacctcggggctcctggattaattgcagggccattgggcaaattgcacacctcgtacacttcgctttcctccactggaaaaatgaagacctgaattaggaaattgttaagataccttcccaggcaaacgttccaggaacctgtaacagctctttctctggtttttctatagttacttgtcttgaaacaccaaatgagatacttgtaagttactaatgctcgttcatctgtcttggagacaccggtggctcagtgatttgccttttaaagtagtttaaagggtaaccacttttcaacagaggttgctttacactgaaggaagtagagtctgtgctcattgtgcccattcaacatctccaccccaccacctttttgaactgtgtgctggtaccctttgattcatgatctgaggtctttgccatttgcaagagtgcgggtgggggaggaaaggtgagaacgggctccttaattttaaaaaaatctattcattcaatgaatggttattgcctcaattatgtaaatatattacaaaaatattttaaaattgtcatttaattaggctgtctgattcttctaaaatcataaactgaagagtcaagccgatgctaatgtcccctcttggggctctgaagactgctgatgaaatagccctttattctagtacagattatcatgtatgtatattctggtttaagactataaaaaggaagattccagagggaatttgttgggattccaggttggaataagtcacccgggctctctgaagtttcctatgcatactttaggatgagaaagcagcagctctgaatcagtcacgtgtccagagaatgttctttattaagtgcgacccattgtttttcatattagtataacccttggtggtataatatctattctaacgctgcacttttgtttacttccctcatttgggttttgataattccagagcttgttttgccgtttagcacaaatattccacttactttgctcaacagggttttgtcccactgtgcattttcctgtgatcttgggttttttttgggtctgtcttccttgacatgaatgaccctccatgtgtccttaatacctcctgcctcctctgaaatataattcggggataagtatgtaatgctcttccttcagtgctttttcgtttgtccaaggtgagactgcatataagaggtcagtggctcacatttgattcattcaataaacatttgttgaatgcctgttgtgttccaggtatttggtcaattttccaaagagacagttagatagtgaaaatgttaggagttgctatggacatctcactcatctttttaaatggtcataatggtcacagagagcaaaatgcaattaactagacaagaacatcctccatttacataaacagacattttcaaagtataatacaactgtcttcttgctttatcatcacacacagaaaataatgtgtgttagcagctaatgttctcctcaaaaaatttcctcctacagttttcccacgttcagattatggtgactccgtccttccagctgggtgttgtccttgatgccttttggtgactgaatcagatttacattttgaaatgatcccagtatggagtgaggatgaggaggagctagagtgcatcctggtatttgggcctgggagagattcgagaagatgactgatgctagggtggcagctgggtaggaggttgagagcagttggcatattggagagatgcttagaacatagaacctgtcagacttagtttggatgggataaagaggtgatagagtatgaaggatgaggatgacatgaatgaatcaatgattttctggcagcatttctagagaagctcttgaagtttatataataagcaaatagtcataatgatatttccctccttgttactgtcttatacagattgcaaaatatttgaacacagtctaggtcaatttcagtctgaaatccaattgctgccttatgcaggttttctgtttcctgattgaagaaatctaagctcagaacagtagaattcaaggcagcacatgtgtcgctgctgacagaactgagagctttatccaggtgccctgatcctgcagtgctcttctgagtcatttagacaatgaggatagtcgaacctaatcatccctctgcgatccactttgccacagtaataaaccaacaaccaaatgttggaccttcagtgacttaatgtgactatctgtattgtcaaattgcatggccaaatagcttttaaatttgactagtgtagacaaaaactaaaaatttaagtatccattaagttcaatgcaatatctttatgtctttctgaaagacactaaaaaaaatctggattaaaagcttggccttgtgacttactggggaccttaggaggctcaagctcttctctcctggtgccccaacctgtctttaccctcaagtggggcagagaaaagcaaatcagtgtccattatacagtcaccatcaggaatccctggactgacatcattcatttctctctcgctggcaggttgaaaacttgctgggagtagtactatgtgtgtcttgtccctgctgtcacctggacacctagcagagtgctggaagcacagtaggtgctcagtagaaatgtgttgaatgacttcatgaatctagtagttgagacctagtttttgaggtcctaagctgctcattctccttccttgtactggtctagtctgagctcctctgctgctgatgtcacttcctgtttggtgtggtcactgcaccatctgtgcttttgaccacagccttgtaatcagatgctgactctgcccttgctccagttaaccccttcctaaggaactcaccagaagtgccaagctgcttaccctgacagagaacctgttttcacatagaatggaaactatgaaagtttccacgtttgttctctatgaacattcaattttcaaagactttgaagtcattaagtttgcttaataattgagtggtattgaatacaggatactctctggtaattctgaagatgcccagaactgggcgccgttgcaggcctatgctgatatgaatcagttatcatccatcggtgctaacagtgtagacatcttaggaaactcagcagaacttatactgacctgtggcatggcccagaacttacttttataaaaccatttttatattactctggttgtcatttgtctcctcataaaagcaaaattttttcaacttacaaatatgtgagagattattgaatcctcttaattgacacctctactaattgtagataccttttctactcccacccccaacctggcatgcttacttttctgctgcatgcagaaattttcctggatgaggcctctttggtgtggaagccccatcatcttaggaagctacatctcccctccttcaaaccactcattaagtaccactactaattgataaaaaatcagattcctgttggatgttgcatagcagacatctctgccaatcatttgaaaacaattaccaccctttgcctagtcctttctggtgatgaacttttattatttacttttcctgttcccacattgtgataaccctggaccacacacacatgactctcaacttggttgtgaaattattgtccagtcatacaaagtcttcattgggttcttgattcctcacttccctgtcacctgtttcattctcagactttcccatctcagtgagtggttggctgtccctatggccagtgcaatctttttaaaaggtaatgaaatagtgacatttcagtgcttaagctctttggttggtttccattccacttagaataatagcttcatccatgaccttgaccttccaagtgctccttacatggtcttctctgcctcataccacaccccactccacaagcttatcattgcctggccacatctgtgccctttctgttcctcaaatgcgaccagttcttttctgccccaagcctttgtacttgctgtcccttctgcctggaatgtcctctgtgtgataggctttttttttttacatccttcaaattgcaggaaaaatgtcgcctttcctgactgctttctctgaagtgtttctgagcccactcagttaccctggatcatatcacactagccacttccctcattgttcacatcaccacttggtattatattatatattcattgtttgtctgtctcctctgactagtgtgtaagtttattcagggcaaggacccaatgatcctttcccactgtctttccactgccttagagcaggtcctggcacagggtaggcatacaataaatatttatgagaacatgaatctggctgcctgtgtatttttccctaggttacgctaggactttccaaacttaaccctttattagttgatgattgaggtcagagggagagacgagactaaaaattagctttccagtttcactgaattcttactaaacgagaatctctaaggaccagacttggaatcaatcctttgaaaaagctttgggggtggttccaatatcagctgggtttggcaaacactgattaatttacacggtgaaccacttactactcaagcagcccctacaaaatgtaggattcagcagcaaagtagattcagaaagtgcaatacaatacttcacctcagctgactctgaggtaatctagtacaagttttcagagcagtcctttgttttaccacccagtgttcatttcagccaaactctctaatgatacaaaaggtataggaatacttcctctatataatgtcatctggcaatatgtccctcggtatccatattctaggtaaaatcgaccagtggttctgaaccagaggaccctgggcaatgtctggaggcacttttggttatcataactggcaggggttgccacaggcatctattaagtagagacctgacatgttgctgaacatcctacaaagcacaacacaacccaacaaggagttgtccagcctcaaatgtcaatagtgctgagacagagaaaccctgacttaattgtatctcagtagatatcaaaatcttaaatgtttttgagaacaattttgtatggcactttctaaaatacattattcgtagtttcttgggttttcagagatagaggtgagaaaatgtgagtgagcttccctggctgtgagtcacagttatgaacagtgtgtttcatactgtgtggggattactctggagagggtgttggtggtccttccagaagcctcagcatcttgggctttttgtttcttcactcctcaatgccaaagcccttcctaatcttgggttaaaaaaatgtttactgtcttctctctcatgtcagacattagctaacttcttcctttatgaccgtctaacagccttgcctaatttgccacctctcttctgatttagccagaatacccgtttaacaaatgtgttaatcgtgggcctaaaattagaagttataatctccaaatgaggatgtgtggagtgctcagcagccttggtgtgtggatgtgggatctgcatctgtatgaaagtgagaaactagagtgcctgcttctgtccctactccttgaggataatgacacagaccggcctgctctggggaaaagggaagagttgctgaaagaaaagccaaaggaaagagggagggaaacagtggctcccagcgtttctctctcaatcacatcagggttcaaaatctcctgagcagcccagggtggcaggcgggtttgtggcctacctgttctcccattgaattgcagagcccgttcttaactcctggccatgtcactgcatgtccattagcatggtctgttttagattgtgagttacgagatgatggggagggtggggatagatttaacggtcttgggtgcttgccacattttggactgagaccactgtttacaaacacaattaattaatttaatatcttttaatgtactttctgttctcaggttttctcattctaaccttattttcaaaagaccaatttttctgatttattttattcttaaatataccctgaatacttaaaaacgtaaaggtagatccagtgatgcaacaaggactcccaccagtcattatgtggtactgctttcactatctttgtggtgactacttggatgtgaatatgggatacttttcaatacaagaaacatatacaaaatataagccaaattttttcattcaaatacagttactgttactgaagactcttccacttccaatttccttgaaagatgccatgactctttcaaatgaaaacctgtcaggcttgttctcctcttctcttcggatacttgtcattttcttagaacttttctaacataaaaaaaaatcttatagtaaaatttgagtgtttgggatgtcagctaaattagatttctgaaataacaattttagaagaatttggagttgtggctttagagaaaagttgccatggcaacagcaacagaagtagtttagatgaataaacttttaacatatttttgaatgacccctttctgcagttgactgaaatatctggtaaagaaatgtataagccagtccaagtgcaatacagaggctaaaagcatctcagcactttgtggagcacgtgggctccatatttgccaagcatctctgtgccaggtgggtgcctctccacatgggcacaaatccctggacattgctctaggttcctagcttggtgatgccatgttaattagacccacagatgaataatagattagcaagggtatggaacattgagtttgctagaatgatttgaaaatggtaacataacacatagtattatttctgtgggtatctatgcacatgactttcaacagttccattcatgttaagatgccatttcgatggtctgagcaaaatgcaaaacacggtcttaacttttatctcaaaagttaaggcatcctcccacattagctactgattcacagtcaagggctttgtgtcgatcaggatccaaacaggaaacagataaatcactcaaaaggcttaatttgaggaatgaactacgccaatgtgttgacaggtttaaaggaaccaacggtgagtggtgaagcacccagcaattagcaacactgagaagctgttaccagggagggaccagcgttaccagagcccactgacttgcagccttggctggaagggaccctggcaatgtgtccagagaagactccagcaagggcaaaatacagagaagcagggatagactggaacagtaaatactctgacttcttggtctccctgttctccatctccttctgggcccaagcccagccaatccagtgagaccagcacagagaagggcagaacattttatttcctatttttgttgagggctggcgggagggggggtcggtgttgacaaacataaaatatcattacaagcattttcagtcttgtttggggtttgcttacatttatgaaagaccttaaattcctaagtatatagaagtctcccaaattgcttcaaatgtctctttcttccacactgtagattattttgactaccacatttaaagtactcaggtgctatgccagctccatccatacgtggtgtgcttgcttttaaggatttttatatcacaaacctattaaagcatttagtagagagtgatatattctacgtatattttgtcattaatctaatattggaaagttcattactttaaagtgccctggtctaaatttattagtatttattaatataattcaaaatatgtaaatgtattaatatagactacaattagattttttttccctctaagcccattaggatagtctaatgtaatttccttgccaaacaaagaaaaaggaagatttggtttggctttttttctggttgatgggtaaagggttttaactcttaaaattgcacatcaacacaaatggtctaacctgtgcttgactgaaaggcaattttcatttatctctgctggtcaaggaatggttgcagctaagtattgcagttaaaccgccctgtaccccagtaaattttagcagagagaaaactctcatttcaacctggactgcagaaagtacctcttattcttaagttagttcctccttgagtcttctgtgcacccactttcataaatattcatcctgcttctttggagaccatattcacaacagaaccagaaaatccaaaaggacgcagaccagaaccagggactatattgtgtgtgactcaatgcttggccatttatagcatgtgcctgatgcttagtatgtacttgagtgtcaatgaaattaatcagtgatttaaagctctcagaaatatttagtctgacttagagtaataataatagccaatatttattgaatgctctctatgagtcctgcttattctacatatattatctcacttaatccttaaaataaccctgtgagataggtcctattatcctcatttaaaagatgaggaaaccaaagctctgaccttatgtctgtttcagggccacacagctagtacgtagtggggctgggactcaaatccttgtctcttaatttgattgccaagtctgcatgcttgaatcactgtgcagtgggtgattgttgacatgccattggcttaaggtgatacctttgaggtaatactttttaaagcctttcattttgtaataattgaagacttataagaacttgcaaaaatagtactgagaggtcccatgtaccccttatctagcttctctcaatggtagcatcttatttacacaatatcaaaaccatgaagctgacattgggacaatcctattaactagactacagattctcattttaccaggtttttacatgcattcttttatgtatgtatatatgcgtgcagttctgtgcaattttattacctgtacagactggcatatccactaccgcattcaaaatacacagctggtccatcaccgcaaaagcactccccccatgctacccctttgtattcacatccaccctactcctgccctcatcctgaatctgggctaccactgaactgtctccataagatgacacattttaaattcttcctcctgttcttgctgcacggtggaaacattcctgtctccattgattatttacacccaaagcatccataaacataacagaagaaagtatggtgaattgatagggagatcagagaggattttggtgtgtccttgttgtcagcaatgcatatatatgtatgtgtatatatatatatatatatatatatatatatatatatatatatatatgtacacacccatataaagaacatcctgtttgttatttttagttgagggtttgagggttgtggtaattttataattccaacacctgtgttttcactagcaaactgcttttgattgaaacacggcagagtttatctcctgcgtaaatgcggcacactccctctttgcatggctgttctaacggcacatccatttctggaccgacaaccgcgtgactgaacttgcagcagcctggaaaaggtacatgagagctggcactctgcccttgtcagggttttccaaaagtatttacgaacaaggataaacacgagtcctgcatggatttgaggtagccatgaccgagctgggctctgggcagcacaacagttacgtaaaccttggcattcatggcacacatgcatttttattcatccatttcaaagggagtggccgttcgtagacctctcttggggaaaggtttgaaccttatcatgatgaactggttcaaaaaatccttaatagctgtttttattcaggattgctgaagagtgaaaccttatcatcgggacacagttagaaagacttcctgcatttatttggtgctcactattttaaaaaaggtgtccaaactgctgatgctgtctgattctgcaaacataggcaaacttactagatacttcacatatttcagttttaccatatgattatgacttgatatttattagaaaggaagaacattttttaaatgtagtcatactgagcccaactcttgcttttaatgcaatttaattgcattaaaattagacaggtaatgtcaccattaccacgcagatactttgtatcacccattgcaaacatctgtaaaggatcaaaggctcatgtagtgagtctaagaggaaacttggtttgagaatgaggccttccatgatatttctgtgctgccgcaggtgggggagggcacatttttatttaaggcgtcattagaaaggaatgaaatatagaactcctagcatgcatacatatatgcacatagacacacaaaatcgtactttaccttatagctgtgttgtctaaaatgtagaagtgtgtttgtatcagttagctatcaccacactaatgctgtgtgacaagctactctgacattcagtggcataaaaaaaccatcacggatcctagtggatctgtgggtcggttagggttggcttagctagacagagctcagctgtttgaccagaggccaaagtgtcaaggctcttctgtcaattctgtcccatgtgtatctatcctggggcccaggctggcagcatctacccaaagaagttcagcaatgacaaaggcacaagatggcaagtgggatcaactgaagactcttgagacgtaggcaggaatttgacacactattgtctccacccacctgctactggccacagcaagtcacatgtaaaagcctaacttcagtgtgtggggaaatgcactccttccatgatggggctgtggtaaggatgtgaagcaacgagggatgaagagatgggggaattgattcactttacctcagtgtttaatcagtttatcctgagaatgccaatacttttaagaaggtacaaatctatcctgattttctttttctgtttcgtcagtgagttctttctgtcatggatgtcaatatctatgtcatcatgacccaattaaatgacaaaagcagggttttgaggttctctcactgatatcagttcccataaatccacagtgattggagaaagactgagtagacattaagggaatatagaaatagactgaatgatattaacatttaaacagaattgcgacactcgtccctgtttccttgtgtgtagcagctctggttcctcaaactatcaaaaagaaaccattcagaatcacctccctggatactttttaaaatttatttttaattgacaattaaaaattaaatatatttatgatgtacaatatgttttgaaatatgtatgcattgtggaatggctaaattgagataatcaacatatgcattacttcacatacttattttttgtggtgagaacacttaaaatctattgtcttagcagttttgaagtatataatacattgttattaactatagtcaccatgttgaacaaggaatatgaacttactcctcctgcctaactaaaattttgtatccttgaccaacatctccctggagattttttatctgcttctttttactagtatcacttttaaaagatttctgaatttagctactgtttcaaaacctagaagaaattaaggatgaggtgatttatgaatgaaagaaaaatatattaatcctttaggccaaacacaccagaggcaacgtttggcaattaaattattaatttgatcaattttgacatgtaaatggataagctacattaaaagcaatgcacttaaagtacacacacagaatcttgtctcattgaagtttgaacaccttcaccatatcttcctctattatatcaacttgattgaacagttgccaaggcctgtttttttttccagtttgctctgtacgtgatcatatctagtagactgtctgccatattacggtagctcagttcttaaatcaggggtcaacaaactatgacccacaggccaaatccagacaactgcctgcttttgtgtctcctatgagctaagaatcagttttacatttttagatggttgaaaaaaataccaaaagaagaatatcttatgccatgtgaacattttatgaaatacagattttagtgttcataaataaagttttattagaacacagccatgtgcatttattgacatattgtctttggctgctttcacactatgatagcagagttcagtggttggttgcaatgaactgcatggcttgcaaagcctaaaatgtttactctttggccatttacagaaaaagtttgcctatctctagtctaatgctatgtctcaaattaccacagacactgtagataggtctacgttacatcagtatgaaggcaaaagaaagggacacatattgttggtatggaggggagtggtgggtatatttcagataagggcaaaatgtcagtgaacattcattgattcaccagtatatgtgcagaactgggtatgtgtatagcgctaagggaaacatttttttaaaaggttagtctccaatttttactctaaggcttcctcttgaataagaagatgcatctgcaagtatagtgtctgaaaactatttgccttgtccaatctctacatcactggaaaatgctttaaaaattttaagttaaaaatagtatatgtttcatggtttattttgcaattattctaggcagaataattttcataaacattgccattcttaccagtgcgaaagggagacttaaactcagaaaagtgtcatttactcatgggtttaaaatgctagttcttcttgtggatgtatctgagatttttatgttactgtatccagaactccctcagaggcaagaacataaagggcctccaggagctgactctaaaaacaccagtctcctgttctttaaactccgtgtggcttgctgagcgctcagccacaagagctgggggtgagccatctctgggtcctgccaatgcagccagtgttgtgccaaaggaagtagccctgtcttacactttgtgatgtttcttttggctgactcttccacattcttgtgaccctttgaatgaagacgtcttaacagctttagctctacaccatggcctcccgctatcatttcctgcaggtcttgtcttagagctcagcagcttcctgagtaaatgtcaccttggtgtcttctaagagggtctcactgaggttcaaaaaaccatggcttccaccagattgaaagcataatgtccacgagtctttgtctcactggactgtgcaggaggatgaacctggaattctttttggttttgaagcaacgagtaggtcggggcacagaacagagaaccaggaaaatgtctctgagggtggaaatcaaatgaccccagaggaggaaattccagttgaaaatagaaaccgggtcagcacccttgtgagagccacagcatcctagacttggaaagtggcaacctgtggcctgtgaaggctgctatcagaagtccatggactggcctgaaaagagtgttgtgttttatggcaatccaaattgaaacaggatttatctagcttcacagatgtggtctgctggagagttatgtggaaatgactcaatgtcatatatttgtcacattgaccaagggttatttctttagtaggaaaagacaattcgggaacaatattttcttgagaactatgatatatgcatacatgatggtggtagcttccaaattaccatggtacgaattctctccattgatggttaaggggaaaagggttattttgttgcagctgtacaatatcccttcattaattcaatgaaaagatctcaattaatgattattccttaaaatgacagatctataattaacttggaaatgcccacaatataatcatgttgctatgaaaagtgatggtttttaaactagtctaacataattccggattatctttaaagagaatttaatgtctagaaaagtttctgtagctctaaaaagctgcagaataggatgtcattttgggaagtttcccttgcttaattcagcttatgatccaaatttgaaggagaccagtagtccaggagttttgtctgcaaataaaatgaacaatatgtgttctaaagtgttttggatttttgtttttggtgggaggctggttagtcatggagcagggtagaattagtagcttttggctttaatcaggaaaatatcacatggtgttaaagtgctgtctattaattggttattataaactttaaaatgtatattatggtggagaaacttctcatttgggggactgtttttcatagcatttgtggcaacttttatttattacttaaaaattttaaacatcacaaacactgaaattctggggtagagataggattttcttaaaggagagatatatttttgatatatctttttctatctgtgtgtgaaagtgtaatgccttccagaaatccataggaacagaaaatagattagtggtttcctggggctgtggttgggaaaggagagtgactgtcagtgagccccagggatgttattgaagtgacaaaaatgttctcaaattggattgtggtgatggttatccaacgcagtaagtttacaggtgaagtttatagaatgtaaattacatctcaatgaagttgttttagagtatgagttaataagagaatcaaaaagtacttatttacaaatgaaggattaaaatcaatattatacaatcaaacttgaaatacgttagtaatggtatatatatattttttcctttctaggccacctcttagaaagttcaaaatctaataaatgaggggaaacacctttttattttttgctagttgttcaggattcagtgatctgaccaagcacccatttgtagttaagacataaacatcccactgaactagacaccagacttctaagaaactcgactttctaaaatcaaaagcaaaaacatatctgagcagccaccaggactgtctatataatttgataaaaatgttgcaaaactgaattaatagttatggttacacaatttggtacatttactaaaatatcattgaattgtacacataaaatgcataaattttatgctgtatcaattataccaaaataaagttatcttcctataaatatatgttcatttgtttatatatttatgtttattatatatgcatatataaatctaacgtaaacatataaataaatgtttatatatttcatatatatttgtatattttatatatatatatatatatatatatatatatatatatataaataatgtctgccagtgacacaggcccaatatctatattccacataatgaagtcatagcaacagggccataatcttatcttattcatcttattttgggatattttggccttaaccatgtgacactgaaatttgcttgggactgttgaaagcattccccttgtttaaagaggttctactaaaaacaacttttcacccatttttttgtttgtttgtttctctctttttattttttctagcacagtggtaacaccctattcccactttaacttcttttccttccttcttttttgaaaattttctaacttgtatttataattctcttgctcatcaaggtcatccagacactatggttctgttcatgtggaattttagtctcatagcaatcagtaagactgtcttgcgagagccggaaatgtgttcattaacttgagaggccttcctgctaagtggtcaaacatggaaacacaaagttatgtagggacattttgctctgtaaactcaaggtatagcatcatttgtttaaaccctctctattgagatgtaattcacatgtgatacaattcacccatttaaagtgtacagttcagtgggttttagtacattcacggagttgtacaaccatcaccactagctaattttagaatatttttgtttccccaaaagaaactccatgccactggcagtcactctctttttatctcctccaccaatgctactctgagcccctgacaaccattaatttgctttttgtctctagatttgcctgttcttgagattttccataaatggaatcatacaatacgtggtcctttgtgactgtctcctttcactgagtgtgttgtcgaggttcacccatgttgcagcatgtattagtacttcattcctttttatcaccatataatatttcatcatatggaaacatgatactttgcttattcattcatcaagtgatggacatttgtggtgttttcagtttttctgcttttatgaataatgctgctatggacttctgtgtatatgttttgtatggatgtatgctttcacttctcgtgggtatataactaggagtagaattgcttggtcattataggaactctatgtttaactatttgaggagccgccagagtgttctccaaagtgattgcatcattttacattcccacaatggtgtttgagggttccagtttctccacatccttaccagtacttgttgttgttattattattagtagtaatgtttagagacagcatcttgctatgttgcccagactggtcttgaactcctgggtttgaggaatcctccaacctcaatcttttgagcatctgggagtatgggcatgtgccaccacatccagctttgtctatttgatagtagccatcctagccagtgtgaagtgttttattttagttataacttttatttgtataacaaacaagaggcacattagatggtgatcatttgcttcacaacagtattttttgtagtcctccttttaaaatcacaaaaccacatatgaatttaaaaccagatccttttctttaaaaatagtccactgcagtctgcccatattccagcagtatccattatcaaagtaaagtgtacacaaaaggctccctccacctctccttgcttgagaatctgtgtcccctgagtatggatgtcctgctccaccttcacagtgtcaccttggaggaagtggcagggggtcatccacttcaaccattttccagccctggcacttggcagcaagacttggagaggccagaggacatgtggccacaggcccctgcttgtgctcctgagtgaacacttgacatagatatccagtgaatcatggggtgcaagccagagacaaccccccaccccatttcttgcaggctgtggatctacgtgtcggtggccctagttattatatctgttatgctttaaaagtgaagactaggccaagacctacaggctgatgattattaggtggattaacatacggaaaacactatagaaaagaaggaatagtttgtgcaaagatgctgaggagcaaagtggcatagcaagttcaagcaaatgagtgaagaaagtagcagactgagtgaaggagtaaggggaacagtagcagaacagagctttggagagatgggtgcggtggtcaagaaaaatggcagggacttacaggccacagagtaaggatattggagtaaggggaagttatagaaacagttaagcagtgtgagggttggaggatgcgtgtgtgtgtgtgcgtgtgtgtgtgtgtgtgtatgtgtgtgtgtgtgtgatgatcaatttcctcaattagaaaaaagagatgtgatgaaattgtgttacagccttttggacactcagaataggaggtcttttattgccaggatacccatagcattgccaccctcagatatcttgtaaactctggtaggaagaactcatggatgactactttgtcgtcctactgcctttaaatctgcttctgtctgttcccggcacccactgaacggcaatttctacaactctcaatttgggcagcagcgtccatactgggaaaactcttccatcatgcttcctcatagacccctattgactgggtaactgctgcatcggtcacctcctctccctgggcctattatagctatggctaagggtgcttccgttgtacctggatagagttttatgcttataagctgcttgtggctattaaacagagcaagaggaaactgtgtacatggaaggaactttgttgcccttctctgttacagacaagcaaaccaccaatgagagcaacaactttttaagaaatcctggcagacttgtggcaagaataaccaatattgtagttcacccgtgaggcttatacaacgtttgccacactgtatgcattgagaatctggttgcgatttttgttataaactcttccattccgcttccccctccctgcctccttacacacgtttacttcagtgaactctgcttgacagactaaccaggctgaggtctcaatctgtgacctaggagccagtgataacacctttgactaatggacagaagacttatagttctatttttgttgttttgattttttttaagttatagtgttgaagtcatacgttgtctttagttattaatcttactgcttccttcagcattttgttgaatagcatttcatcatgctttggttaagtgatttatagttagctcacaaatcccaggcttaagattaaaaagctactcataaattccttagaacattcattgtgccagcagaaagaaaaaaatactggactataggatatcattcctgtatctgattcctacactattcctttgaatatcatcccacacctcctccccgttcaactccaaatggccaatgaacacatggaacatacatacagttagccaataagaacatgaaaacatgctcaaaatctttagcagtcagggatatggaaatcaaaaccacaaggaaataccactttacacccaccaggatagtaatgatgaaaaaaatacaaagaataagtgttggtgaggatgtagggaaattagaaccctcataaactactggtgggaatgtaaaatgctgcagccactttgaaaaacagcctgtcagttcctcaaaaagttaagcatagagttaccatatgactcagcaattccactcctagttatctacccaagagaaatgaaatgtgtgtacacaaaaaacttatacatgaatgcacatgcattattcataacaacaaaaaagtggaaaaaacccaagaatccatcctaactgattaacagataaacaaaatatggtcaaccatacaagagaatattattcaataggaaaaagaatgaagtactgacacacgctcccacatggatgaaccttgaaaacatggtgctaagtctctcttgagctggacacaagagatcacatattctcttgtgattccacttacatgaaatatccagaataggcaaatccatggagatggaatatagattggtggttccctagggctgggggtgggataaaatgcagagagactaataatgggtatggggtttctttttgaggtgataaaaatattctaaaattggttgtggtgatggttgcacaactctgtgaatatactgaaaaccatttaatcaaacacctgaaatgtgtgagttgtaaagtatgtgaattatatctcaataatgtagttataaaaaatgaaccaagaaagccaagcaatgctagacatgcatggtctattccactgtaaggtaatagtctgtctaggcacatttacttattaaaaaaaaaaaaactccccatttatctatttagatgtttctttgttatatatgtgcttaacaatcttctcagtttacttgcagtttgtaggtgacagtttattttatgtcatgggaaactgaaacagaatatgtcaggactgtttacgtgaacacggtctggcctttcgctggacactgggatacagtatatttcaataccccctacgcacacatcccacacacattaatcagggccaacatgctgggagtaaccacgatggccaaccacaggatactaggatgctttttatatggacatttgtgggtgaatgtaccataatctgtttaactggctgatagtcatggtggcagtggcatatgtgtgtgtgtttacattgtgtgtgagtgtgtgtgtggggtgtgtgtgtgtatagtttacagcaagctcaggcggaatgctgtaagccaaacagtaccatgaatctctaaaaaggaaaaaagatcattatctttaaaagtgcattcttacatgctgtcaagtatttgaggattgcttttcctagctgaggctcagtatagtcttctttagtctgttgccaggggatcagcaatgggcaaaatctccgcccccatcccagtacccactctgtgtcatacattttccttgatgacttatgcgagtactttataatctttacaattctcggctgggcatggtagctcatgcctgtaatcccagcactttgggagagaaaggaggatcatttaagcccaggagttagagaccagcctgggcaatatggcaagaccctgtctctaaaaataaaataaaatattagctgggcatggtggcacacttacagtcccagctactcaggaagctgaggcgggaggatcacttgagcgagggaggctgtggctgcagtgatgatcatgccactgcactccagcctgagcaacagagtgagatcctatctaaaaaaaaattccttacaactctctaataggtttctttatatcattttatagatgaggaaactggggcttgtagaggctaagtaacttttccaaagtcacaaaaataagtggtgaagttgggttgtaaactcaagtccactgattacaaagaccatatttagggtcccttaagttaagctgtcttacatcttcccgaggagaaataacatgcttttttgctactgacttaatcataattattaatgaaactgaagtagaaattgattatttgactagaaattgattacacaacaattcaatgtttagactaagaaccaaggatttccaattaatatgccagagcttgccattaaaattttttaaattgtcatttttttcttatggatatgtaataatcatacagtaaacccttgatttgtaggataccaacctgcaggaatgactagtaatttttttaaaaagaaagaaaaaagaaattctccttaaaagtagaattgggatccagatgtgtttttacccagcagtgtcttccgtcatggatttgtcttatagaaggaaaaagacattccaccccagtggtgataggtgcatgaaaagctcattttgagaactaaggatggagaaagcaaagaggagcagagtggtagagatcacagtggcaacagtactggggtcacctgggacctcaaggtgggcacccatggccatgtggtggtagaagtgagaatcaacagagggacagcagtttgcccttcctgttgacagtggaaaagagagcagcaatgaagaagtagagtcaggaactgctctaacgtttgctggaggggcagccagcagccccttatattaggcctaccaggacgctgggtgccatattgaaaagatataacagtcataatggattgtcagtgtggatgcctgcagacatttgcttcatgtggtaatatcatgacagattcaatcagctctttatttaatctgtattttcacctataattatgcttataagacaaactgttcaatggttttaaaagacatgaaaatgtctccattagagaaatagaagctcttacaataagatagttagaatgttaaccctgagctatccaggatgtgtgcttatctagaattactcgttcctacatgatccaggctcgctgaggatttagcatactgggccttaagagctatgatctgcttttttatttttaatatttttggagatattcttccttcctgaggttacccaaagcagtatcctttggccacattttctttgagctctagattagaaaaacatttataaccacccacaaacacaaaactttttaagatgaggttttggagggtaaaaaacttatgaactgaaaagaaaatttggttcctgttggcagacagtgatactttctttgagttctaattatatggaataatttgtaaatgaattaaacaaatgcaaaacaaagggattatttttatgttttaatgtaaatgttgcattaaaaagactgaggattgacttgaatagattggaagactacttcattattaatgattctcgtgcttgcctttggaatctcttgcttggctggattatgtagaatcggattttaaggctttgatgcaaggatgacctcgatcctgggctgcctgctactctcataggttcttaagccaaaagttgagatgatttgcaatggtagggggacaagacagattagcaatgggagatgcaaagagtggagaggctcatcagagagatgaggaagacggctttgcctctgacccaggtgtgaatcagttaagtggtggaaattaaagaggagatgccaaaaagcaagaagtatcagtaaggcatagactggtgaacttggatatctgtaacatatttgcattcataaatgcaacgttttctctcttgccttgtgcagacctggcctttctgcatctgtgtctttttgaaacattacaggatattcaacattagcacctaattatgagcccatttcaatgttagagcctgttttatctctgctttaacgtggtttaagtatgtctgcaaaggaagaaagtttagttacattgttaaccatcctttttcatgtctcaaagagtagaagatttgtttatctaacagattttgccaagaaggcagtgaatgaaatttcagttttgaagtatatttgaagttaacattttgagatagggagccaagctcagtcaagcaacactttcctatggaagcgccttcctttgagctcagcataaatcatgccttaaagtaactttcagcctgattagtgttgtccaatagaaatgaaatccaagccacatatgcaattttaaattttataatagccacatttagataagtttaaaaataaaaagaaacagtaatatattttatttaacctaatatatctgaaatattattttaatatgcaaacaatagaaaagttcctaacgagatatacacatttgtcatgccaagtctttgcactattatttatttcatacttacagcacattttaattctgactagccacatttccagtactcattggtcacttggggctagtggctgtcgtatttgacaccagggctttagagaactgaatgagcaaccaaaagatgactgatttgactcagtttcctactggggaagttttcacatcaactatctctaactctcccccatacctacacccagccctgagcaccccaagattgctgaacttttctcacactgaaatagtcaggatgtcttatcttcacaggtggggaggatacagagctgtgttttcacatttcgtagtaaaattcagctgctgttctctgcccgtattctactcagctttgaatttcaaccccttggctttcccatactgagcagccaacgcaaactattgttttcaatgacacctgttcctttcgaagaagatgaaggcagtaagcagatttgtgcttagtacaaggtgttcaagtgaaattacctatttattttggtgatcaccctcccaaattgctagggtgtatcttcatctggagttacataaataggatttgcccacctcctaaatagagtgtgtgataatggaggtaacctaggcatcctcctacgctctgccacaactgatgctcaattattccccagaacacctaatgctttatgtaacagagctctgagagaataggggagtggcaggcaaaaatgaaatagatatttcaaacatcactcctatgtgaaacatatagatttggcatttaggtggaaggctcttttttccttccacttacagagtttgttaaattgcaagcatgccttggtgttgccagagcaatgtcttgtagctgatactcacagagagctagtgacttgtagacttctctatacaagcatagttgtggataaagccattctagaagggaggtgacccctgtacaataaagcctgggttgttgcaatgtgagatcaagagagcagaacaatcttctattttgttaattaatctagtatataaagtcttgcttaaattaggcataggctcaaagtctgactcacagtcttttatgttttgaaaatgttcaaagaaggtggaaccaaaatgggtgaaaaaaacttgacacatatttgaattgttctcatttgttcatatttgtaattctttaaaacgagacagacaaacgtacagcatacttttgtggccaagaacttgggaatcagatcctaaatctcaatgcaatgttgtactttgggtttgtgtttggaatcaggcatggtttcaaatcccaactcttgtatctactaattggatgacttccagcaagttatttgtgagccttagtattatatcataattgagtcagcagacctatctttcagagatggagtcagaattaagcagaatgatgtacataaagttattggacagtgatgggacaaagtctgactaaataataacaccactgaattttaaaatttaacatgttatcagatctccttcaattatttatatgtatatatgtatgcaatgaaaacataatgcactagcctttttactgaattattcttattctaaaacaggaaatatatacaatcatatggttttatttaagctaacaaacatttgctgagttttggtaatgtcaaataacttactgttggatactgaagggtatatttttgttcaggtcgtaagtatcctaatatcctgtacatatgaatggccgttaggtcacagcttccctcctgtagctcttaacatgtaatgcctctagccctgtggctctcaactgggggcaattttgccctcccccacccctactcccccaccaagggacatttggcaatgtctggagacatttttgtgtatttgcttgccacatcttggggagggtgctattggcgtataagcaagtagaggtcagagatgctactaaatatcctacagggcacagaacagcccctacagcaaagaattatccagacccaaatgtctacagtgcctaggttaagaaacatggtcttgatattatgtatttttctagagtttattatgtctttcatcatttgtgactttggccatgctatgaggactgtctagataaaaattgtccagtcatgagctggttggacataaagctgtgactacttgaactcaaggtgatacttacctaatagcatcgtcggagggaatttgttcattgggcgggaggctggattagctgcttttggatgctcttccaatcccaggaatcccgtgcttttcctcttttgtcacacaaagctatatttcagcaagaatctctcccaaactttgtgttcaccatgaccagcttcttctcagatcctgccatcaaggccaagcagagtatttttggaatgtggatgaatgtgacaagaatgttattcttaaatagcaattctgctatgcaacaccatgatacagtctcctgaatggatctgattccaagtggaggcttgaactctaatatttaatagtaaactatagaaaccttatcaagataaacagcactaggagtttttaattctatttacatgactagaagttgacattcatgtccttcttgaaactcagacccccaaatattgggaaagtcaaatacaatacggcacagtcacagcatgagtatcatacagtgatagttcatgctaggttaatgtcaaacattaagagtataatgctgaaatatttctggatgaaagataggatatctaggatttctttcaatgtaattgagtgggacagaaatctaaaagttggtgttttaaagagaaattggtaagccacagctgtgaaaatggaggcttaggtggtttgcatattggctgccttgaactgtaaattccacctgaagcagaggtaaacgacagtgcttttagccagggggggacggggtgcgggggggcacgttcattgacaatattattgcaaggtatgttggttcttttttttttcatgactggaacaatgaccagcttcacttcgtcaccttctttctcttctatgaaatgccttccctccttaaacctaaatccaatgcatccctgaagacctagctcaattatcccctccccctggaagcctctaaggtcttccaaattttattaatacttctccactgaactcctgcagtgatgcatcttttgcatgttttaagaaattgaggtctagttcacataccataaaattcccctttttaaaagtgtacaatttagtagtttttagtatattcacagaattgtgcatttatcaccacatgttctagaacatcctgatcacctcataaagaattgctgcattcattagcagccaaccacccctccctttccctttaacacctctggcaactactaattactttctgtccccatagatttgccttttatggatatttcataaaaatagaatcatataatatatggccttttgtaactgtctcctttcacttagcataatgttttcaaggctcatctatgttgtacatgtatcaggatttcattttgtggctgaataatctttcgttgtatgggtacgccacattttgtttattcattcatcagctgatggacatttgggttatttccactttttagctattatgaataatgctgtgaacatttatgtgcaagtttttgtgtgtacatgtgtttttgtttctcttgaaatgaaatatagctaggagtggaattgctgggtcacatagtagctctatgtttaaacttttgaagagctgccagacagttttccaaagtggctgctccattttacattcccaccagtgatgtaacagtgatgattaaaagcaatggcaaaaactgcaattacttttgcaccaatcttaatacagggattcagatttctccatatcctctttgacattttaccctgcacaagtctgttgatgtcactatttgtcctcaggattgattatcccacatcccaaattagtctcacctcccaaattagactgtaagctacttaggacaatgatccatttatttggtctttatttaagccagtggtttttttttttttttttttttttgattgcttattgtgtggcaggaactggtaagtgctaaggctttaattaagaagctctattttgtgggggaggcacataaaatcacactggcctgttttggggtgatgggtgcagtaataacagcctattcaaggtatagcctttgcttcatatagtttccctcccacaatgtcatacttacaaacaccactcaagtctactatttaatacattctattagagaggaacagatctctgtgtgtgtcctctttttagtccaaatgtagaagctctgatttttctgttgggcttttgtgtttaaatgtgcttaaagaaatcaatgccagcaatatttctagcagtaactttggatgtaccatgtaagttattttgaaacagtgaatcatcacgaatgttaatctgttgacttgtatgtataaaagcttcttgagactctaggctaaggagagacaaagcatcaaaaatgtaattcctctggattcagaaataaattatccacatgccattttcacctgcagttaatctggttttatgtttgtctttctgcaactctcattcagtgttttggagaaattaggacatttagaattcctaaatgacatcaaggataaaaggaatcaaactgcaaactgtagaaaagaatgcattgttatactatatataaaggtataattatataattatgactataataattaaaacatattgtgcttaacaatagtatcaaattgttttcatctgagttcttaattacctaatataaatatgtctatgccagccatgccaaagcaggtacctaaaggaatttcttatatctaggaaaaaacgtattgatcacctcatgcatttaagggacaagaatggcactttcattccagcttataaatcatgtcaattttaacaatgacttaaaaattcttttgtgatttgtttaaactctgaaaagaggcttgtttgtgttaaggaaaaatcaaactgagaatgagttatgtgctcatattatatatagatgagtaaaactcttactccctctgcaaacattagaaaacaataagatactcccacggtttctttttttttttttttttttttatagcacttacgcagtccttactatttaacaggcactggtttagaatttttacaaatacttctttaatcttcataacaaccctaggaaacatatacaattattatccccattttacagataaggaacctgagagtttcagtaacttgtgtaaggtcaccaggtagtgtaagcccatgagatttggcaccttttccaaagtggagtaggcctgccccagagtaaagagtgcctgttctagtctttatctcaaagaaagcagtgatttaattagttactatcaatgtggggaatctgttggtctgacatcattctaggtttcagaggcaacttggctgcaggttttgtttttgttttcgtttttgttttcatttttgttttgagacagagtcttgctctgttgcccaggctggagtgcagtggtgtgaccttggctcactgcagcttcgacctccctgggctcagttgatcctcccacctcagcctcctgagtgcctagaactacatgtgtgtgccactacacctggctaattttttgtgtttgtattttttgtagagatggggtctcaccatgttgcctgggttggtctcatcctgggcgcaagtgatccgcccactttggcctcccaaagttctaggaaaacaggcgtgagtcaccatgttcagcttgcaggatattttcatacagcttaggagagcaatgaaattaaatgtgagagataaaatatacattgtcacctacctgtttgatggtatatataatggattatctataccatacattatacattatagataatatatattatattacatcttcatattatgtatagtcatgctgtctttgatatacatacacatatatatgcatatgttatacacacacataaatgcttagccccttgcaggctaccctttcccatgtgcttccatgtcttgggtaataattcttctcagactttcaggaagtacagtgctactaatattcttggaggttattattctttcttcttggtgaagaggatgttgaaagatcaataatttccatctatctccagatagtaaggatgccttgtaggagagagatctgaagaccctgacatgtccacagctttgcagcctgattctgacctttctgctttgggggcaacttccatcaaaaggagtttcttgtcgcagttcttacaggcaggggcatctcacaacagttgctagtaatgataccatctactcccaagaatgggaaacctatactcatctacttggcctcccaaagatggatcccatttagggtgtgtgtgcacatgtgtgtgtttgtgtgtgtatatgttttaaccaaaataattagtgttaccaaatctctaggcctccatgcctagaggatctctcattaagtaggatattctatgcgctcatactagaaagttataaaggcaaaaaagacactagattaaaactgataatgtccatataggttctgagatttttttaaaaaaaagtctgagcttatgttaaacagaggtaatgaggataatcagttgtataggcttccctaatgtaagtcagcgtctctcatcttggcattcattccagaactgtttttaaacaggcttgcatgtgcacagtatgttaccttgccttctaagtactgtcagaattggactggtacctagcaaaaatatcaaaattatgagtcctagaacagtgcttggatgtaataagcactccgtaaatacttttggaaaaaatatgttgatcaactacggttttattagataatttaaaaaagataactttaacccctgccctctctggaggagagagttgctacagtaagagggagcagtcatccccagacctctctttgatgcttctgggtgtaagaagggcaattgaaaagggatttaggaaacaccaggcatgctgggtgagtaatatggctgccacctaagagaccatcagggaagtgtcttctgtggtatcatgccctgagccagaatgccgttgactgcttgactctgaagaaattttaaagtgttcctgagggtgagagaggtcttttgaatcagggattctcaaggtagcctatggtgatttgaaatgtttacattttaatatcacatatactctcctttctattggaagcaactaaaactgatagtgaagacttatgcttttgctgtaaagagtaagagttgcctatctgtggtatgatagtactcctagagggtgattcataggttaaaccattggaacagaaaagagaaaatatttttacttggccatgctctcttttttaaaaacaaatattactatttttttaaaagccatatcactggcatagttttcagttgtttttacagtcggttgctctttaggcttacaatctttaaccttgaaattattcagagataattatttttggaaggaaagtgacaagggaaatagttatgtagtcaatttttgattatccaagatgattttgccattagaattagtatcttattttagcaaatagcaacagtcaccttctctctttgctaacccttggaacaaaatgttttataagggaacagaactgaattttatttctcctcctgtgccccgggcctgtcttatattttcactgccggtagtacctaatgttttccccatttcagcagtatgctggagccagcttgcgttggctggagaaccagttgtgtgcatctcttcctaactgcatgtcctgtgtcctcaccttggtaccctggaatccgccacaatgagtatttatattatggaaattaacaaatggcgcaaatcagagctttcctccagagaaccagttgttaaatgttttatcagcacactgctgccccattgagtccttcctttttgttttttgatgaatattttctaaaatgtattagatgttgctgtctttgcaaacagggtgtaatagaaaaatttactatttcctggtcccattattatacttcatattgctgggttagcttcttagtgtttcttcacttttcccttcagaagagggcttcttccttctgaaatcttccactcagttcttatgtgttgattttgattgcccttagtccatcaaatgagataaccaagtccataaatgtgcatgtagaataaaatgagagttagaggacttctgttacagaataaacctcttgaataaaatgcatggccttagtccagaatttttgtgacaactagtttgattgccaacaccagctttatgagtatcctacctgtgtggtcgcacagggcccatgctcagaaggacaacatgactaatgttctgctgtcatcattttaaaattattaatctgagcaagaggtcctgcattttcattttgatcagggctccataaattatgtagccaatcctgatagttgttcagatgccttttttgcttctgattttagaaagctgaatttcttagaagtctggtgtgtagatcagtgggctgtttctatattaaccacagatggatgcttggtcagatcactataaatactaaataagtagtaacaaaaaaatgatgtttattttcattcattatattgtgatttttctaaatgggtgtcctaggaaggaaaatgatacattataatgttactcacttattttgaatgtataagattaattttaatccttcacttgcaagtaatttctggttctcttattgagatatatttttaaaataactttattgaagtaattttacatcataaaatttactcagtttaagtgtgcaattcagtggtttcttaataaatttacagagttgtgcaacattcccacaatctgtttagaatatttccatcatcccaatgaaattgttcatccccatttgcagtcattccctgttcccacccccagccccaggtacccactaatctactttctattggaacagctttgccttctatggacatttcatatgaatggaaccatacaacatgacatgtggtcttttgtgattgacttctttcactcagtattatgtctttgaggctcattcatgttgcagcaggtcaatgcacaactttacgctaagatttataggatatgtgaggttggtgtaggacaaataatgcttatctacttatctgtgagtgcacatttatttttgctgaaattttcattgagaatggaaaggtagccccattgcattctacaggaagtccatttttggcttataacgcttatcattttggcaccttctggatcaactactcaccctaccttctgagaaactttaagctatttatgagggtgtaagtgaacttaatatttgagttcaattactaccaagcacactttctggaattactactaaattgcaaacatattgtagcagttctaaagacgcttttttgagttaatgttcatcaatatttaaaaaatatttttctcagtattaaaacaagttaaaaataccattgataagaattcaggctctgggctgagacagctctcagtggaaatcctagctctgcctctcaaagccatgtcctaaaataagctattaaatctctccaatacttgatttcctagattatgaaataatactacacactacctcagagaatcattgacagaattaaataagtcaggtaatgcattgaacacagtgcttagtacaacaaatgttactaaatgtaaacatttctacaatgatgagtgatgattctgttatgtacagatatgtactaccatttgctagtgtatcacaacagaatagaacacatcatataatatgatgcaagttatattaataacataatgtctatgcatatattttgttatatccatagaaaattttaacaaattaatagcacagtgtgtggcctttactacactcaacaaatgttagttatattattattatcattattacttacaatggctttcttcagggggaggaactataggagatttcttcttttcacagtatatttctgctgtttttggtttttgcttttgtttgttttctttaaaaaagtattacttttttaaataggaaaaattaaagactaaaaaacttaaattgctcttgaatagatttgtaatcattatcatatactctcttaaatcacttattattcaccttttataatctttggaataaataataattaaaacttccattttctttaaataagaaaataatactgctttataaatactcagtaatacaaactaactgactatttcctgaatttgatagtgtctttttcaggatatccttcttgtaattcagtaaatagaaagggcccccattaaaaatcacatggagaaagtagggtgtagggttgggacaaacacaccaacgtgacttgccttgtatctcttatttcccattttagatactggtgggttaaatttacttaatatcaagttcaaatgtatgtacagtcttaggacttggttgttgattcttaagagtgtgttgaaaaaataaagaagtcagctaggagaagttgaaagaacttagactttgaattcagatgcctgcctttgattcttccttctgtgattttgtgctctttggcatctcaaaaactcagttttcctaccttgagaatggggaaaatccccaccctatgagtttttcataggcatcaaatgagacaatcaatttgagattaagctataaatgtaaagcctcctccaaaatgctagccagtgtgattttttaataaggtcattatttttcttccttttaggatttctctctcccaagaccaatagtactaaccaatattcaggcttcattcatgtttcagcagggcatgggaatggttgtgggtttctttgagctcactggccatttattgttattgattaattaactcgtgataaacagctggtgaaaaacccaggataaggaaatgagagtgatggggtggggttgggaatggtacataggaggaggctggaatgatgaacaggaaacagccatgcagaactctgctgaaagagccttccagaaaaggaaacgcaaaagctaaggctggggcaagttacctgtattaatataagataacatcaaatgggctgtccttccagaggagtaactgagcttcctttggtctacaatggaatttcttcccattagaaaatttgacccttttttcttgcaaaagataagccaaagatatgtgaattgcatgacagtgatttaggatggaacaattccttatttgaggaatgcttctttttctattttacttctgtgcccacatagcacccagcttacaactaggagcttagtcatagacagttctcaatgctggctgcacattagaatcaaacaggaagcttttgacacctcactattccaagtgtgttccttagaacaccactgttgacattgcaaaatgcagaatctcaggcacaccccagacccactcaattagaatctgcattttacgaagatccctaggcaatctacatgaaagttaaagtttgagatgtgctgtacaatactgtgccaaagatcaagcttcactcctagagcttctgatttatttggtctgggaagaagcctgccttggcatcattttaaaaaagaaaaagaaagcttgtaatctccaactgatgagaacgtacagcaaaacttgaagaccactgacttgattgttctcactcacaggccctcaatcactgatgactatcaagcacgtggaaatgggattcatcaattatttaaattgcttgtttgagagtaccagttatgttttaaagttttctggcttttttttttcttttcttttctttttttaatcatactttaagttctagggtacatgtgcacaacgtgcaggtttgttacatatgtatacatgtgccatgtttctgtgctgaccccattaactagttatttacattaggtatatatcctaatgctatccctccctcctctgcccaccccacaacaggccccggtgtgtgatgttccccttcctgtgtccatgtgttctcattgttcaattcccacctatgagtgagaacatgtggtgtttggttttttgtccttgcaatagtttgctcacaatgatggtttccggcttcatccatgtccctacaaaggacatgaactcatcgtttttcatggctgcatagtatttcatggtgtatatgtgccacattttcttaatccagtctatcattgttggacatttgggttggttccaagtctttgctattgtgaatagtgccacaataaacatacgtgtgcatgtgtcttcatagcagcatgatttagaatcctttgggtatatacccagtaatgcgatgtctgggtcaaatggtatttctagttctagatccctgaggaatcaccacactgtcttccacaatggttgaactagtttacagtcccaccaacagtgtaaaagtgttcctatttctccacagcctctccagcacctgttgtttcctgacatttgaatgatcgccattgtaactggtgtgagatggtatctcactgtggttttgatttgcatttctctgatggccagtgatgatgagcattttgtcatgtgtgtattggctgcataaatgtcttcttttgagaagtgcctgttcatatcctttgcccactttttgatggggttgtttgtttttttcttgtaaatttgtttgagttcattgtagattctggatattagccctttgtcagatgagtagattgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctacctggaggcatcatgctacctgacttcaaactatactacaaggctacagtaaccaaaacagcatggtactggtaccaaaacagagatatagaccaatggaacagaacagagccctcagaaataataccacacatctacaaccatctgatctttgacaaacctgacaaaaacaagaaatggggaaagtattccctatttaataaatggtgctgggaaaattggctagccatatgtagaaagctgaaactggtttccttccttataccttatacaaaaattaattcaagatggattaaagacttaaatgttagacctaaaaccataaaaaccctagaagaaaagctaggcaataccattcaggacataggcatgttttgtggcttttaatgaatactcttaataatttgtaaatctttctctagaatagacttctagttcccattagaactagactagtggttaacattactgttatcacagatcagagactgggatgcatgataagttttccttgtcttccttcagctctaaccacaccgactttctcatgtttgggggtgatattatttctcactgtatttgcattgcaattctgaaaaatatcttcctatcccacctctgttttgttttccatgaagtgagcaaatttaccaagtgatttggaagaaatttatataattgtatagcttgaaaagcctttttttcccctacaaatgtattatttaggacatgtaaaatttagcaaacacagatattttaagcataatttactaaatattgatgataacgcatgctcagaagtcttcatttagaggactctcaatttgtctgagtgtaaactcaattccaacaatcaaaataatttgatatctggtttttgctttagcaacttcacttggttggccaatgttttaattctccagtccttgatctctcattgtggtaaacccacaggataattttattagtgctttgattttctgtaagaggcttttttgtttttctttaattcagcatataattggtgcatgtttaaacttatttgtgtttcggttgaaaggcagttattagtagagagtatcaatagagagttattatagagagtattagttattatttgcagaaatgttaaccttactatctagagcaggatctttctgcctcagcacattgatattttggactggataattctttactttaagggatttgtcatgcgttgtagagtgtttagcagtgtccctggtcgatccccggtagattccaataacaagctgccaatcatgacaataaaaaatgtctgaaatattgccaaatgtcccctaagggtgcaaaactgcccccagttgagaatcactgatcagtagagatgaaaacagaaaaagaatctgtaggcattttgtgacctaaataagacattcttatctccgtgttgctagcttttattttgtggctgagtgaattgttttcagtgtgaagaccaatggtacactggatttctatttaaagatggtttcaaatatgtaaaataattgatagtttacaagccacccaaacatatttccccacttccttttctgagtttagttgagaaaattttatatgtagaaagctgaaactggatcctttccttacaccttatacaaaaatcaattcaagatgggttaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaagagaaaataccatcagagtgaacaggcaacctacaaaacgggagaaaatttttgcaatctactcatctgacaaagggctaatatccagaatctacaatgaacacaaacaaatttacaagaaaaaaacaaacaaccccatcaacaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttagaacggtgatcattaaaaagtcaggaaacaacaggtgctggagaggctgtggagaaataggaacacttttacactgttggtgggactgtaaactagttcaaccattgtggaagtcagtgtgttgattcctcagggatctagaacttgaaataccatttgacccagccattgcattactgggtatatacccaaaggattataaatcatgctgttataaagacacatgcacacgtatgtttattgcagcactattcacaatagcaaagacttggaaccaacccaaatgtccaacaatgatagactggattaagaaaatgtggcacatatacaccatgaaatactatgcagccataaaaaacaatgagttcatgtcctttgtagggacatggatgaagctggaaaccatcattctgagcaaactatcgcaaggacaaaaaaccaaacaccgcatgttctcactcataggtgggaattgaacaataagaacacatggacacaggaaggggaacatcacacaccggggcctgttgtggggtgggggaagcggggagggatagcattaggagatatacctaatgttaaatgactagttaatgggggcagcacaccaacatggcacatgtatacatatgtaacaaacttgcacgttgcgcacatgtactctaaaacttaaaggataataaaaaaatttcttcctttcttccttctgaattttaaagctccttaagtcaagtgaaaaatctagtcatttacctgcgaagttcaaataaggaaatgactttggctacaattattggagtgcttcaggtgcaagtggctgtttgggcctgataatttagagatatgggacctcacatttactctctctgcatgcaaagcagtgggtctcagccctagctgcaaattgagatcacctgggagctttagaaacttcatacccaatccccaagccccagagattccagctcagtggtcgagggtggtgcataggtattttgtagagctccccaggtaattctagagtgcagtcagggttgacacccactgatgtaggtagatagggctttgctgcctttctccttcattgatcactttcccacatttccctgtagcctgctttcttcctgtctgcaacatcctggtcaaactcttctgcctatcccttgttattatttttaaccaaatgattttttccaagtgtttttcctttgttcagacttggacttggcgtggaaactgctggatcagtctacttaatccatgaccttctttcagctgctgccttcctttcaactgctgcctttatttcaactgttaacctcagtccaccttaaaaaatatatatggtttttaagcgggtatttcttcctttgccagcaaatcattatacgcagttcctgtctatgtttaccaccatcacttgcctctatttctttttccttactgctatttatagtttaattttctttcttttctttgtgctcttttttattcatgtttccatccttagatgacatgctcacgttttgtgaattaggtgtgtttcaagatgctgggaaagtaagttttctgtgctttataacttcagacccgtgtatttggtttgtgtcttatttaaaaatgtatgttcttatggccctgtttgccccacctaagcgtttaaatgtgacacctcatgtctgttgggctcccaggttcctattatggccggtggatctgggccaggcaaaccatcctaggcctcaggcatctcgtcacgtctagattcacctctccccttcccacaagacaggctcacctgccttccagccctgtagctgctggcctctccctgaactccgtggtctctagcaacctttggacttctaagtaatattgcaaagatctttatccttggcttgcttgagagcatttctgctaagccctaccagcaactttcatcttgtttcctcagttagttcttctaaaataaatcataaattgccccattgctaaaacttacgtcacattctttcaattctagtatctgagtcattgcaaaaaggcatctcaggttcgttccagagatttggcaggggagcttcccacaactcagcaaagtgtttggcccctttgggccttttcactgagacttgaggctagatttgctgtgcctgctctgtcctttcccttctaatttctcaggaattgtctttgctgtcttcttgtgttctctgagatcacacttccacagctgttccagaaacatcacaccacttgtatttttttaaagccttagcttttgcttgtgggttcacttgtacaagaatattaacgttgactctcactttgtgtaatactagtatatcaagctagtcttttaaaaacaccttttttaagcctttaagcccaatttatatatctcatttttttatcatttttgcattaatgtttaaaaacaaaacaaaacacaacacctttcttttgatcccttaaataccagctagtgagactttcaaatctagcacttaattttttactgagcatctaaatattccttacaaaatttaaacttctagatttaactcatcagatttcctcaaacacttaaacagagattgcaaacttaaatcattaagtcccaagtattttagttaaaatcataagttcgatatgtcagattctccaaaacaattcaaacacctcaaagaacaaataaaacttgcatatcctaacatgttgattccagaagttatttttacactcaactcaattgtattaataccaaagtttgattaatttcttcatttgccccatgtattttatcaatattactactagtacctgattagtattaatactggtagcagcattatcattagtattcataatagtgttaatgctagagctatcatcattattagtaccagcaccagcactattagcatagaattagccttggtcttagaattatattagtattagtatacttctcagagttgcaaggttactgacccaaataaggaaaacagaaatgatagatacagttattggttgagaatgtgacttcaaatttataaattgggggttttcagtcagagattttggaccaagacaccaagaactagggtttgccattctgattcctcaatcccactgggcctttattgtgctatagtcatttatacagtagtaagaatttctaagcttcaaccttttcttgtagtctggtgaatcatggtcatttatacttaattttcttacagtgttttcttatgtaatttttattgaaaatttctgtgacaactttttattgcctgattggagagggtgaccaatcatccttgtttttccaggactggagggtttgctgggacatgggaacttttcagcgctaaaaccaggaaagtgtccaggatgactggttatcctagattctaggccagtggttctccacccccactagaatggtctggggaacttttcaaacataccaggccccaagccccacctccagagattctgatttaatttgtctggggatagtgcccagtcattgatattttttaaattttctcaagtgattttcctgtgtagccaaggttgagaaccatcattctgcattctctacccaatttgaaacaccctatgcaacattgtattgtctactttgacctcctggaacttagcaaaacttgaatttgacaagcatgtgtttgggttcatcaatgtgaagtatttccagtaaatattcctgggggaagtcatgcacatctttcttgagcagattatgttatttgttgtttttgagtatatgtgttctcatgacttttcacagagttttttgttgttgattaaactgtcatgctttcattagtgacaactgcattaagctggtccatttgtccagttagcaccacccttgaaagtattcaagcttcttggtaacaacaaagtgttccagactcatcctggtttttcctgccacaagacatggaatcaactacttttcaaggatccctgtgtctttcactttttagttgaaagttttagagaccaaaatcttggctacccgggggcacatcgtgttgttttacaagagcattcatagtaggtagatcttggatccatgatcttatctgaaattgaaattcttaattctctcacatggtttttgtgcatccccattgtccatcctgtagatacttttttatccttattctttttttctataaatcaatatggtgttctttgtgtttttttcaagcattaaaattctgtcactcttttatttactttcctttcaaatttcaactgagaatcaggaaaactgtgtgtatagacttcatttattttctagtttattctgagaggcaaggggaagcaccctgttgtcttttccaggcacaaactctatttccttttatagtttgataatttcttcgttctccagtactcatattttctgaagagtcatcactccttagcttatttcttcataagttatagccaactgagttttatacatgaagtggaaagtggattttcctctgaaatgagaggaagtaggtattttgttgccttttaaaaagaggtagaaatgtacgagcaggtcaccctctcagtcctcatatgggctgataatttgtacctgagactatagatttaggatatggggcagaaattgagtcagaacagtacagccaccaatggcagagaccacaggccaaggctcaaaaataaaacccacataaatgttattttagtgagttttgccctcatcctgggttgttttgtagggaaagtgatgggagagagaagggggcatatcttaagaaggcagtcccttttgcagtgttttctgacttaatcttagacctaactcttaattttagaattcactctgagaagatattaggcaaactcttactatcaaaggatttccctcatttgggatcctgagtttcgtcaagtcacttcagatcagcaataaaatccccttgagagtttccagatttttctccacaatgaaccatgaagcatgctgtttatttgtggaactcccactcctggttcttcagaactccttcatttgccgatctaaagatagcaaaaaaggctcttaaaaatacacgccttattgattttggaatgttctggtaaatgccaatctgattgatgtcatttatgtagggaaggctttggcttaagccccaaagtgattttagccaagaggaagtaacgtatctaataaataatgtggagtttgtgtattcatccaccaaataataattatcatcactaaaaatgtgactagagatgccacatccacttctccattgaggtaaatttctaacagacaaagccaagtgaaatttgatgtccgtataagctgctttgacctcgttgtttctgactttcattacagatgaattttcatttgtaattttgttgttgttttttggtttccttggtactttgatttgtttgggcaaaaactcagtgaatctgtagtgatttaggagacagtttaatcaacacaagtgcccatgtttcagactcagacatgcaggtgatatttattctgggtaattttgggggatctacaccttttgtttattctaagatgacgaagctgcattattattttatatgtaacatgcactcattgtaaaaaagttgcaacgatagacaaaattataaagagtggattgtaataagaaaaaattctgagtacatggcaggatccatatactatgtgtattcttgccttattttattgggacaacaatgaaaataggccaatagtttatcacatgaagagccagccttcacaaatacagctctgtggaattgtatctgagcataaaaacactctttatttaattattattaatataacaattaccaataacctttatatctatctatttacttatttatcttttcctgtggtggggggttcaaaggtttctgggagtgatcaggatgcccaaacttcctctaactttaaaattttaataagtaaatgaagaaagctccatgttttcctcctagagtttaattagctactaatataagttgcttagcccaggatctatcctatggtggtaggtgttcattatgtttagctaaaatttccatcaccattatcatctttgtcatcattactgccatcactaccacaaccaacaacattacaatcaccaccactgtcatcatcaccattgtcatcatcctttaatactaggcttgaggaagctaaagggagccaaatgtacatttatgtcttatgtaacattaatgttacttgtcttattcctaatgcctcatcttaaatgtaaagaaagtaagaagacccagagatagttaactttgtcgtctcttgactcccaggatcaaaaatagttgttgctgcagtgtttggaataaaaaagcttaaaagaccttgtatacaaaagtggttcgtactgccttctctcgtgaattcatgccagcagatatttttattctggtaggaagtaactaaaagctttgttcaaccctggtctgccagcctctgtaacgcacgtctgacaaatatgtgtgactctgtgagaaagtttggttctccccctggtggcaaaaggaaaaactaacactagtgctccttatgggagtgtattgatagggtacgagatatgtaaatacagctttacccttttcaccagtgttgcctgagatttttatctcagcccccttggttacttttgttctttggacaacaactggtttatatcttctatggtcgttgggatgaaagggatttgacaaactgacaaagcattttgcttcagaaaccacttgaaaaacacatctatgtttcaaataaagattatttcaggatcataaaaatatgctcggtgtattagccatggaactagattttaagcttcatgatcatagagatagatattgggtttattttattgttattgcctctgaactgagaaaagactctagaattctaaatataacgcacacacttgaactaagtagacggaaacttacccttctaggtaggtaactctgcttaccttccaaacagagtttggatgatattgcctcatagaaagattttttgatacaatactcaggaaccgctatggactgctgctttggggccaggccccatgccacttgattaaatacatcctcacttaacctgtccctacaacaactctgtgagggaggcatactcataccgaagctttagccatgtggacactgctcccctgaaccacatgcgtagtcaaatggttagggcagatttcagctcatgtctcttttattcagaacccatcctttaagccagtagttctcaatgggggtgatttgactcccagaggacacttggcaatgtctggaaacatttttggttgtcatacctggagaggtgctactagtcggtagaggccaaggatgctcctcaacatcctgtaatgcacagtgcagcccccacaacagagaattacttggtccagatgtcagtagtgccaaagctgagaaactgtactcctaaccagtgctactcaaaatgtattccacggaacagcagcatctgcaacacgtgggagcttgttagaaatgcagaatcacgagccctgtcccagacccagtgaaccagaaactccatggttggagctcaggaacgtgtgtttctacaagcccccaagttcttcttgcacactcaagggagagaagctctgctctaaaacaacagatcattctgtgtctattgagctagacacaatcgtatggtttcctcaccactttcagtgttccgttgtcgcatagaagtatctcctcaagcatctaaaaggggaaagtctggcgtacactaggaacaaatgtgactcatggggaaatcagtgcaattacaaatccaggaaccacacccagctgaaaatctaggaaggttctttttctcttattttctctacttaagaagggaagtctcggagacttagtctaggttcaaaagatgtcaacatatacacaggcttggtttggggtttgattatctaaaattaaaccttaaattgaattaggtaaaacccattttggagagccacagaattctaaattagaaattacattgagtttcgtatttactggcccaaataagtaatcttctctatttgtgcatttttctaatcacaaattgtcttctgagagccagtgaaataattatttttatatgggtctctcttcaataattgctcatcacttggtattttatgtgatttttgtggggcatacattataggcaaggatgtattgtaaaggataaaaatgtcagataaaacatctgtgtttaggtagtttgtacgtcactgtcctccatcccacctcatagattcctactgcttggctataactaagagtagaatttaaggctgacacaggaaaccaggcaatcaagttcattaagtaccttaatcaactctggccagaggatgatctcagagctcccctatctcaagaagaaatttcatgagaaagctttggggttacttccagattaaagattatgttctggacagttcaagccctaaacaacagacacatgaataagtggagccatttctatcatactttttcagggactgaagatataaatattgctatttgttattaaaggattttgtttgttaaacctgatgatacttatttttatgtgagttcatagtattccagctcttcaaaacctaatttgtttgtagatccctcattgtcatctttgaaaggttccagtagtttctggaatactttcttttcctatgccaaatacaacagtgaccaagaaatccatctgaaggatttggatagtgtggtagcatgtattgatggacccagtgttccactcatccctgtatacatgctctttaggtaacatgacagtgccctctaactctgactctggagtcagccttttgactggctttggccaatagggacatggagaagtgatagcatacctgttgtaatcctagacctcaagagacctttcttgttcacacttgtccacttgtgcttctgccatggccatgagaaggacatgtctgagccggattgctggagaggaatgagagacatgtggcgtagagctgcatagctaagcaactccacccaagcccagcctagagcacagccccctgcagatgcatgagctagtccattcaggatcaaccactctccagcttccgagtaggttattacacagcaatagctgactgatacacatgagtagagaagaaaagaattttccaagtaaagataatagtattgataaaaccgtgaagagaagggtctatcaacatgttggatcacgagaaagttggcttgagtgaagtagaacacgcttattgagaaataatcaaaaataaaactggatagagagtgctgactcaaattatagaggagtttaaaagccagccaaaagaatcatagtattgtgtgaaagtgccatagaaataatctggtgccaggtcttcaactaagacaaagtgattagtggccaaacaataatggtacccaagtcttaagtgtttgtaagtgatgcaataggaagagataatggaatgatggaacagggattttaggaaggtaaatacaaccatgagttagaaggaatggtttggctgtccctagacatattacctgtgagacttttgtagtattatggaactggagtcatgaagctctgaagcagaggatggtcttcgggaatggaaaggatagttatggaagaatttttgagaaagaaaaaatattccagttatctattgatgaaacccatgtttctctcctgatcacacttgatatttaatgagagagttcttattaaaagtaaccatgtccatgaaggatcttattgggatgaagaaagtgttctaaaactggtttatggtgatggtagcaccacttggtaaattttctaaatgtcattgaattgcatgcttgaaattgttgaattttatgatatgtgaaatatatatcaataaagctgttaaacaaagaaacaatgaaaatccccaccagttatgttccatagtccctggagggggctgttttcatttgaatacccaaactcatcctgtcaagtacaggtagcatcctcctcttctttctcagatgacactatacgcagcgaaccattggggtgcccacatgtgccacacagcctagagccaccactgtgtccatgccagtggtactccatgtagatgcagggaagagcccttcttccccatcctggcccagactgtcagtgagtaacaatgacgtgctgcttgtatccatcatgaaaacagtccctttcatcttggccagaaaccctcttttcctagatctgagatctatgtcctgtgtttgggcccacagatcagttccttggctccacttctcaactgtcccttccagttgccatccttcttactttttctgtcctggacctatctctctcactgtcgtaaaccctcagcctcatttgaatgttggcaacgaatgaatggtagcaaattctactactaaaatcccgctcacgaggggactaatcaaaggtgacattgaaataagtcttctggattttaagcacaatatggggcaaatgaggaaattgatataatctttttaaaaaatttaatagcattattgagctctgattcacataccatacaattaactgatttaaagtgtacaactcaacggcttttagtacattcctctagttgtgcatccattaccacaataaattttaaaatattttcatcactccaaaggaaactccatacccattagcagtcacaccctattttccccatcacccaccagcccttgcaaacactaatctgctttctgcctctatagatttgcctattctaggcatttcataggaatgaaatcatacaagatgtggtcctttgtgactggcttctttcatttagcatcacgtttctgtgttcttgattcaattaaattaacacaaaactttgggatccattttgtgccaagcactatgctgggcactggttggaaaaagagcttacctttctgggaaagcagaacaacaaggaaacaatgaatcccattccatttaacagagggattgatcatttggagtgtgcaagttgaagcatgaggtatgggactcacactggaagaattttgctctgcaggccatcaaagcaccagagtattgaaccaggcaaattactttaattgtgctcttgagtttattagatgtgaatgtcttgctggcaatcatggttttactatggaagcaaactgaggtcttggagagctcattctgtccttaattgtaacatttagtaccaagaccttggacatggtacctctctgggccccccttgtctcatcaggaggggtagaattgatggtctttgcttatattccacaggtcttagaatgatcagacctgacaatatatgggaaagggctttgtatgctgtaaaatgacaaccaagcatgattttaacaattgtgctgcacaaaataagcattttgctgtaataatttgtgatctcataagcattagtcttctattgatgcaataataaatgaccacaaacttagtgtcttaaaatactacaaaagtattatattctagttctgtagactagaattctgacacagatctcactaggctaaaatcaaggtgtcagcagggttcctttgggaggctccaggggcagatccctgccttttgagctcctattaatagaagctgccctcattcattggcttttgtgcccttcttccatcttgaaagtcaacagtgttgcatctccctgtgcctttgtgcttttcttccatttccctttgacagactccaactggaagagtctcacttttaaaggttcatgggattagattggttttacctggataatccaggataatttctccttctcaaggtctatacacttaatcatatctgcagtgttcctattaccatgtcagtcaaaatattcacaggttccagggatgggtgtgtggacatctttgggaggccatctttctgccaatagatgagtttctgttatttctctccttatcgcatctcactgtgtttgtatgtgcacatgatcatcttgttattttctctcttctgtatttacagtcttttttcattttctcttttcatgctgtatcactgtttatccttttttactatttctttcccttgctacacatttcttttttcccttattgttactatcctttactgcttcttagtattttctttgtatttcttattcatttggctatttatggatattttgaacttcctttatcttcctggctttttctaatttaattttcttatcaccttcctttgagccctcttggtctctatttttacacaacattgagtcaatctctttttctgtccttcttagcttcctcttctaacccttgctctcatgcagaattcttatcttcatttacacacattgtttaacttttgtagctccttcagccctgactgtgcagtttatatcttgacaaatgggaggcgggaaagcagacatagcagggagaagccattggtactgagaatcacaatccacatctacataaaaatgccccatgttctgcagccaaacttgaaccttttggagctcctgctaaaatctcttaaggaaatctcaaagacaacagttacatgattactgattacacatgcgtaaatatagaggtatgtttaataagaaagatcagaatagaatttggagtgatctaaattacctaggatagatgaagttctttttggtgtaaattttcttacaattacagcaacaacaacaacaagcccttcaaatataaatgtttcatgtcattgctttttcaacttatatttattttgtatgattctaataaagtaagcatttgatcagttgcagaactttcatgtatggacattgcagagaatgatgttgctgataatgaaatggcataatgtgtgtaaaactcaggttcttagtctttttaagccccagaacaaatctgttcagaataagatctaagttatacatttgctctccagaggaatgtatatgaagaaaattttgtatctgctttctggaggtttcattcataaattcattctataagtatttactaagcatatataaagtgaacaaaaacagagatactgttctaggcattaggaatacatcagtgaataaaatacaatactttcttttaaagagattatgctgtagaatagggagactgacaagccaataagtatataatatgccaggtggtaatacagaagataaggggatagaatgatggaggggagtcagtaggatggtagggaagctttctcaaaaggtgacaatcagaaatatgacataaaggagacctgatatttaaaggatgagtcaaccattgttaacggcttgctatcacttaggttcctgtgtgggaagtcaatttagatagtcagacaaagaaagccctttttgtctgttaatgtgaagaacaggttttagtttaacttcttacgcatagcagtgagtaactagaaattagcacattccagggacaacatactctttcagatttatttgattttccaatatggctaagcaaacatatgattattcattgaaatagtagctccagaggtggtattagattgcctacttctgaggaattaagagaagaaatggttgcagataaattttaaaaagctaacactttaaatgttatagcacctagatatacagcattgtccaatagaaaattttgtgatgctggaaatatgtaatatctgccctgtcccagtgaatagtcttcctcagaggttttctttatagcttccacatctctgttgtttgagatgtcccaaggaccacaaagatggaatctccaccctagagcccacctgagagggagtgactactcaaagcctctttacgagcaaaactgtggctcctaagtacctggccaagtcaaccacagtcctccaggatcttgttttgaattttaaagctgctctctcttgggcccactccatattactaccacggagagggtagctaggccatagtgcttctgtgaaggaggaagagccccttcaaactccagtcctttacctcaacaggcttagctatagggatgtctcctcaggcttgtgtttgtatcttcagataatttccatgggatattggtcttgattattttattttatgttatatagtcaaaaggctgataattgcttggtctcaataataagacattgcctcctcactgaaatattaatcagaatggtaggtggctgctatctctgtagagtaccaatcaacttaatctcatttggataaattttgaaaatgaaggaaagaaatgtggctacaaacaccatgttttattttttagcacctggaatcccactccaaaggagataaatttatttcactaaccttagcaaacaaatcaaatttacccactaactccacctatgcccaccctgcctaggagttcacacttgttcaatcattccattccattgcagcccaggtgaaaaaggctggttgaatttgagatgtgacctttgcttaaatttcatccccaaagtgtgcccctcagaatgtcacattcttttggtaaatagccctttcaaagtgaagacacaattatttcatgttatttatatgcttgaaatgcagaccttctgtttttcaaatccacaaaagcaatgatttaattttcagtagttaggaagtacttgggtcaaattttagccaccttgcttcaggataaatattactatcatttgcttttttctctctctcttttttttttaaacaatgtcttttttatgaacttgagagggctggtgatgattttgttttgttttgatttattttccccaaagtagagaaaacaagatctcctgttttacattttactttttattttacttaccaagcaggaatttgtcggtctgttgtctcacctactaacatctgtgtatcctggcattgaagattgggaatcacaagctctttaaaaggctgacacagatgggcagagatttagcatcctaattttaaaagtatatatatatatgtgtgtgtgtgtgtgtgtgtgtgtgtttgtgtgtgtgtgtgaaaaaaatagaaaatattcatatttaaaaatttagaattattagaatctttagtttcatggttagggatttgtatgaataatttttatttcaatatttacatatggcaagcattctataaacattccaaattttttgtacctgataagaaagaaaagaataaagcaatattaattgtggttggcttttgaatttccaaagtctttccttaacctttcagcatcagtagaattgtaaatcattgtcccaattaagttaacaataatttcgtttcttttcttttctttttttttttttttttttttttttgagatggagtctcgctctgtcacccaggctgcagtacagtggcgcgatcttggctcactgcaagctccgcctcctaggttcaggccattctcctgcctcagcttcccgagtagctgggactacaggcgcgtgccaccatgcctggctaattttctatatttttagtagaggcagggtttcaccgtgttagccaggatggtctccatctcctgacctcgtaatccaccctcctcggcctcccaaagtgctgggattacaggcgtgagccaccgtgccagtcaacaataatttcttaaccattctgtacaattcacatagcatgaggaatatgagatcaatatcccaaagtgaacatgatttttaaaaaatccattctttattaatattcacttggtatatatttaatcactgactcattagtcaagaagtatctgtagtgagaaaaatgtttagctttaaatactggtttcatgtgggaaaaagttaatatataaacatatagtcagtatatactttatttactaagaaaacacaattttgctgaattttccatctgattataatgacacatctagatattttaataataaagctacagcaaatacttgagggtctttgaaaggagaaagcaggttctatatttcaaaagtagcttggatataaactgcaaaattatttctgcagatgggcttgtttccccttttgttttatcaactttagatatttatgtcttaaaattaactaaagcaggacacagaaataaccctcttctccatttaaatatatattttttcatttgggttctagattctcaaatgattacacatatacattgttaaaagcttatgagatacattaaatctagattaaaatgataatatacttttacagagacatttcctgtagtacttacagcagagtcgtggatcaactcatctattcctaattattatgtagatattaggatatgagcatgagctcaagtactagtatttattttatgatatactggcagaaatcagagctgttgaatatgtttacttgttatctttttcattaagtttccaatatataaaactaggcattatctttctcataaataatatttgattaatttgttagtgattaaccatataccaaagggatatttgcatagaaatttttattccaaatctctccattgtagcttttaattacctctattaaggattatagtaatttaaaattattaaagatatctatgaattcttcaaactaaatcactgaaatgtcaatgcaagcttaatggttttgttgttgttgtttttggtaaagtagcatggtcttttagttaagaccagatagtaaatattttaggcttttctgaccataagatctcagtcacaactctgccatttgagtacaaaaacagtcatagacaatacacaaatgaatgtgcatggctggttccaataaaactttatttacaataacaggtgatgggctggatttggtccatggattatagtttgctgacccttgcttagaggataaatagctgtgtgcttgtagaaccaatctggtgagggaaacacttaagggaccatgttaattttaatgttgcacatatcctggttgctgttctctaggaaatagccatccctccagtcagataatgaaaatatgctggtgatttctcttctttctgcatggaaatcttcttaagggattttgagaattatccatcaagtgagacctatcagtgctcagtgcaaccctggtggaaaatataaattagttattcctactatttctataagtaggccctccagtcattgtgatagttgggccaatctttgttaagaacatgttgttgttgttgttgttgttgttgttgtttgtaagcatactttgaaaatgacctgccatgtaagtgtcaagaatagttaactcaagatggaatcatgattgacctgtagagtgtgatgggcctcaggaagcatgccctggtagttctgtgagttctcactagggagagacattttattatgttcttcatgccataggtactatggtctaagcaagtgtacaatgaataagtcaatgaattaatcaatggaaaattatagtctatagtgagctttgaattgtaggaggtaaacctatagcacattgtcacttcaaactcaacatccagttttacaatgactaagtagagattttctagtaagaaaattatccaagtttctgatatcacttttattctttcactggtgactctacccagagagaaagaacatgggtcctacattaggactgacatcagaggaaagagaaatgtttatagccagaagggaccttgaagatgaggaagagaataacaattttgatgactgcaacaatgatgttgacgctataggtttaaatagtaagttgttatttacaaaatgctgtttcagtcctatcactttccatgagttaaaacgaaggtttagattatgtgacttttgaaaggctaaaataaagtaagtgaaactggaatacttggaattctgctacctgatacccaattaggaaaaagagaaggcaaagtttaaaacaaggtctaggttgatgagttggtctattaaacttttctatttttctaatattcattctctttcttctggtaattctgggttttagaagagtatatacaattgaattgcttctgactgctgctattgacgcatgctaactaaaggaggcagcctcagcccagggaatttaatccagtcaagtgataattaagcatctatgaattggcattaattgccaacttttggcccttcctgtagatctgtccaaaccttgattgtaattcctgcatgtactgacaacttgatagtttagcatatcccagtgtccatttttaaggcactatccaaaatatatctctgctcattaccctttgatatttatctaaacaagtaacttctgatgttaagctttgagtaaaacgggggaaatggcagggaagaactgggcagagaaaacgggggaggaattcaaactacacttgataactgtgatgatgacaatttcagctaccaccagttttgaacatttacaatgagggaagatagtactgttttatatttattatttcatttaatcttcacatcattcctctgagataattgttattctttgtatctcatatataagaaaactgagttttagagggatcaatacattgtgtaaggtcacaaaggtatgagtgatgagggcaaggtttgacctcagctctgtggcttctaaagagtatcctgttgagcactaagcaatgttatgtcataatagctgggctctaagtcatggctaactaggaaaacttggagacccttgttactcaaagtgctgtcctcagcccaacagtatcaggagccccattccagacctgctgaataggatctacattttcacagaagcccccagtgatacattaaagcacactaaaatttgaaaagcatggccctaggcttttcctagacaacccctgcccagtagtctgaaagtccgtagagatactttatcatcaggaaggggagtaggcaaaaaaacaaacaaacaaacaaacaaacaaaaaacctaccacaatgtcctgtaaaaagaaagctttctccagcttctgaaatgcacatgtagaattttacagaggggctcaagggacccgggagaatagtgattagagggtcattcaaactgggatacttttgaaagggaaaagatcactaggaataattaccctggcacattaggcatgaactggaactgcactaagcaaactgggacatatgggcacctaagtcttacttggtgagaatctaccaaaatatcaggattttttagactgtaaaacatgaaaccagagagacaggaaatttaaagtctacaaatttaaaagggtgacaattagttattgattaaattattttattccacaaatatttatcaagctctttccttctttgtcaggtactttataagctacagagatatgagatggacaagacacaatagaacttaacaggactaggtaataccctttaagcttgacaacagcaatattaggaaacataaaattagagttaacttcatggaagtcataaattgcaagcatcctggttctatttctatcctgtatcttaagaagtgatatagtctaatattttaattcatggaagatgaatccaaatgtgataattaaggcaggttgggaagttagaattggaggaggaataagaatgctattttagatgatagccaaaaccatgccctccctaatatgtcacggggatcttctgacagatatggaaccctgggccaaatgggccataatgaaaattagaacacatgtaagctttggagtttatcatcttttgtgtgttttagaaaagagtatttatcctagggctttgttcaccctgagctgtatcttgtaaatgaaaagtacaatgtgtgcatcttccatgccgaaaaataaacagcaaccttacccttttgtaaacagtaatgcaatatgctcaagcaagatttacagatgcatccgtttagataaacaacaagaatccttattaacaattagtcctcatgcaagacccacggcaatctgtgctacataggaaaactattttacgatcaccatgctttctccagtgcctaggacagagtctaatgcacagtatagatcagtcaaaacttgtgggtttagtaaatgagtcagacggcatttcagggatgctgaaagaggagaacagtgtagtccttcctgctttaattctttttgcagagtgcagaattggttgaaggcagttcacgtagatagttccaggtcagtgcaggaaaccaggaaggagagggcaagaattgaccttgttgctttgccaactgactcttctattctggttttgtttccttcatctggagaagcagatgtgcctgcctgatagggcggaagcctggaagtcccacaatctggaggtaacatcctggtctctcaaacttcctgggtgattcattagccagccacaagcacaagatctgtcacttccagaaacttagccccatcaatgttcttatgatatgagcttaagatccagaacaaataacaataattgggaaattttaaatgaccatattatttatatataatactttgtgaggttaaaacaagctcacttaaaactttaaatatcctttgttatagctagttccacatgaaagtactgggtcaatttgtccttgtagtcaaagattcatcacaaatgaaattcaagtatgggcagcacaggccccatttcctcccatctcagaggcaaaggcatctgtcatcctgtccaaatcccatgcagttctgcttcatcagggtcactccagatagcatcatgttaactcttccccagcttcaacttctacactctcagtcatcttgtcatgtcaaaacccttccttgagcaaacctcttctgaaagccatctcttttttgcaactaaatctctcataagaatagtttacactcaaagctagttcacatgctcatctatctactcctgaactctctgctatctggcttctaccccatcattcctttgagtcttctgtcttcagggttataggcaactttgctgcgaattcaggagagtgagtccttattgcatgttacctctggaacctctgaatccagctgttttttcctgacaacgtcttttcttcccttttccataactctattatttctcctcctacctctgggagtaatatgtcttgctctcctttgaaggcatgttattcctcacctgctccttaaacatacttccatcttaggcctcttctcctctcactgtagacacatttctttcacccttttatcaattctgtggcttaggctactactttgttttatgttcttccatgttgcaaggaacagagacacacttggttatttcaggtaggagatatccattgtaaagttacacaggaaagaacttaaaaggggaaaaacatcttagcccttgtgaaaactgaacaccaccccatgcaagactcaaaggaaactcatccctgtgcaaagtatgactctagtaacattcgacatttaccaggctgtagacttgatgctaactagctttctctctttctccccacctccctcacttacccacgtcgctctagtctactctcaaatacctttcgttgacttttcttctctttccctcatggcttctgctccttcatgacatctgatgtctcttggtttctgctatctctctatctacccataatttcttgatagatacaatttattctataacttaaaacattgcaataatttttatatttgctttccttctgctttcaatgccttctggaactaggtggaatctgaatgtatgtatgtataaacgaatgaatgaaatattgaatcagatctactaactttgtctttgtatcctcactggctgcccatgatgtcatagttgccagttaatgagtactatataactgccattatgccacttacacatttcttcaaccttcacacattcttaagaagagatggttttatggactgaatgtttgcgtcccaccaaaattcctatgttgaagcctagccctacagccagtgtgatgctatttgcaggtagggcctttggggagtgattaggtttagctgaattcatgagagtggggctcccatgatgggattagtgcccttataagaagaggaagagaccagaccttgctctttccctgccatgtgagaacacagtgagaaggtggctgtctgcaagccaggaggagatccctcatcagaactgaactctgctggcaccatgatctcagatgtccagcctccagaactgtgaaaagcaaatgatattttgttttggcagccaaggctgactaaaaccagtggtattcctctcccattttttaatgtataaaaaactatggctctcacagatgaaattgctttccttagatcacaatgcaagtggtaaggccaggaattggaaccccaatacctgaattattttatggttttctgcattcattttataaaacaataagccaaaagataaatgaacaattattttttaatgaacgtgaatatgacgtatttaatgaattttatctttttgttctgcttttctattttggtctacatgacaataacacatcactataggcatatacgttacttaatattgctaaggcattaatcaagatatattttgataatagtgattaaaataagaattgattgatcttctatgtctctagaatttttagcttgtgaaaatacaaaccaagagggagaaatgactgtctttaaatttgtaaggcctactggataggtcgaatgaatttgaagacatttgtctgcaagtaacagaagactccccctccattggaaataaacagtaatgaaatttccatctaagatgacaagaagtccagcatggcctacgatctgggtaccatacagaatgtcaggatgttgggtccttctctctgcaggctctgtcctgctctgtgtattgttggctttgctctcaggctggtaccaagatggctgcatcagtttcagacatcacattgagatgtgacactgatcagagggagaagtacagtttatctctttttgtttctctttcatagcaggagactttcccggaagcttcatatttcataggcgggaattgggccacatgctgtgacaatgactactagttgtctccccttctccttgcatttcccccaccttcctttcactacctcctgtatagctaactgtcatcatgtgactaagtcccctgcagtaagggcttcctgttggctgaagttgtccagggctcctagcagcagtgccggacctgagacagcacagcaaaatggcagaaaagtaagctagttgagagcctcatccctgatgcatctatctactcctgaacagggtgccccctgttgcctaacacctgtcttcttttctccagtatataaaatataattccccagggaattatatttgcatcttatttaagaccactgttatttttatttcttgctcttttttgtagttatgcaaccaaacttaatctgatatgcatttcccttcttaaaacattcctggcaaatggaatagtgtaaccacaagggaccaaacataatgaggatctatctttggagccgggatgggtcatctacccttggtcacgtggcggaaggttgaatagccaaataacattagacctctctttggaagaaggagggaaggggaaatcactgttgggtaggcaactaactgaggctgctaataaagttaattaagttttccaaggtcacatggctaattattggtggaaaagtaatttctttttttttttttttaacatttttagtttcaaaggtacatgtgcaggtttgttatataggtaaattgcatgttgtggggctgtggtgtagagattatttcatcaaccatgtagtaaacatagtactcaataggtagtttttcgatcctcactctcctcccaccctccaccctcaagtaggccctggtgtctgttgttcccttctttgtatccatgtgtactaaatgtttaactcccacttacaagtgagaacatgcagtatatggttttctgttcctatgttcctccacttatgataatggcctctagttccatccgtgttgctgcaaagaatgtgatcttgttcctttttatggctgcatagtattccatggaatatatgtaccacattttctttatccagtctactgttgatgtgcatttaggttgattccatgtctttggaatattatggatagtgctgtgataaacatacatgtgcatgtgtctttatgatagaacaatttatattcctttgagtatatacccaataatgggattgttgggctgaatggtagttctgttttaaatgctttgagaaattgccaatctgctttttacagtggctgaattaatttacattcagaaaagtaatttcgacttaggttgtctaaaagcaagttcagtggacttctgtctataagataagcttagtcaatgatttgtcattgatattataacagaaattcatacacagctgggagatgacacctagctgttaaacatttattgcttcatcaattccctcttactaagatacaaatgtgagcagttacctctacattgctgagaatcatatgcatacaggtcaatgttatactcatatggaaagaagcagaccgcgcagaccacctcaaagttatatatttggccatgggcaataaggtgagaaaaatctgctttgctaatgttgttggcctgagctaaatattgaaatagcatccagttactcagcatgtgaaccaggcagtggggagtcacgcaaactgggactgttttgtgtggtggaacagaggtgatccaaatgtgtgtttgtgtgctttttagagtttgaggccaatttaaaaaatagtctgcactgcaccatgcacgtgggtttctttgtcaacaccatctgggtgctgactctagaagtttcacttcccttagcatactgtggctccattaggagatggggcacagcactttgatttcaaaggtggttggcctcattagctatttgtggaacttagtaaccagcagaaatgatgctgttggaaaaatcctctaccttaactttaattcatatggttttattttttttcttctgcttttgaggggctttcaaatgaagtatcagaaggaaacagtgctttttatatgcgcatgtgtgtagtttttttcttagtcaactgaaaagatagaaaaaacattctgtgtttgtggacagtattcatataaaattcaaaggcaaattttatctatgtgaccgataaacaaattactaatgcctgttaatcccagtgaattttacaaaatgatttgactggtgccgaaggaggcaggagaaagacagcaaatctgaactctataaaatccctcaaggagtaccttcttagaagacaagggaggaaatactttttttcaaatgggaagcaaatcacaatatagaattacagtgtttattattattattattattattatactttaagttttagggtacatatgcacaatgtgcaggttagttacatatgtatacatgtgccatgctggtgtgctgcacccattaactcgtcatttagcattaggtatatctcctaatgctaaccctccccccttccgccaccccacaacagtccccagagtgtgatgttccccttcctgtgtccatgtgttttcgttgttcagttcccatctatgagtgagaacttgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatccttgttggacatttgggttggttccaagactttgctattgtgaatagtgctgcaataaacatacgtgtgcatgtgtctttataacagcatgatttatagtcctttgggtatatacccagtaatgggatggctgggtcaaatggtgtttctagttctagatccctgaggaatcgccacactgacttccacaagggttgaactagtttgcagtcccaccaacagtgtaaaagtgttcctatttctccacatcctctccagcacctgttgtttcctgactttttaatgattgccattgtaactggtgtgagatggtatctcattgtggttttgatttgcatttctctgatggccagtgatgatgagcattttgtcgtgtgtcttttggctgcataaatgtcttcttttgagaagtgtctgttcatatccttcgcccactttttgatggggttggtcgtttttttcttgtaaatttgtttgtgttcattgtagattctggatattagccctttgtgagatgagtaggttgcaaaaattttctcctattttgtaggttgcctattcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatgcagtttcagctttctacatatggctagccagttttcccagcaccatttattaaatagggactcctttccccattgcttgtttttctcaggtttgtcaaagatcagatagttgtagatatgcggcgttatttctgagggctctgttctattccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacggtattgattcttcctacccatgagcatggaatgttcttccatttctttgtatcctcttttatttcattgagcagtggtttgtagttctccttgaagaggtcctccacgtcccttgtaagttggattcctaagtattttattctctttgaagcagttgtgaatgggagttcactcatgatttggctctctctctgttattggtgtataagaatgcttgtgatttttgtacattcattttgtatcctgagactttgctgaggttgcttatcagcttaaggagattttgggctgagacaatggggttttctagatatacaatcgtgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgagatacgtcccatcaatacctaatttattgagagtttttggcatgaggggttgttgaattttgtcaaaggccttttctgcatctattgagataatcatgtggtttttgtctttggttctgtttatatgctggattacatttattgatttgcatatattgaaccagccttgcatcccaggaatgaagcccacttgatcatggtggataagctttttgatgtgctgctagattcggtttgccagtattttattgaggatttttgcatcaatgttcatcagggatattggtctaaaattctctttgttggttgtgtctctgcccggctttggtatcaggatgatgctggcctcataaaatgagttagggaggattccctctttttgtattgattggaatagtttcagaaggaatggtactggttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgttgaggaatttatcgatttcttctagattttccagtttatttgcgtagatgtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcgaaaaaccagctcctggattcattaattttttgaagggttttttgtgtctctatttccttcagttctgctctgattttagttatttcttgccttctgctagcttttgaatgtgtttgctctggcttaataatgcttgtgcaaagatgattaggaattttgaatacattggaatatggtgataggaggtttggtactgatacacatttttagcaagccttttattataggctaaataagatttagaagttgtattgataatacatatgagcaagactgtttggttacctttaatcttcctttaagtgccacttacagaattaatttgtttattaaacataatgtcctcttattatctaacaaagtttcttatcctgaaaatctgaataattgtgtgttcctgaatataaaaatgtttacatggaaaaacttgtttgtttttggtgtcactaattcagattgatccgtttgtctcatataagatgggtttggcactaccagattttacagtgagcagaaaatgtttctgtacagattcataccatcagctctcagaggacttgacattcacacaaggaagaaattatttgtaatacctagtacctgaggtgtttgctttataaggagatgccataacagataatattataacaaagagttattaatgaatggggaatttacccatttttttacatacagaattcttctaaatcaagctgaatttatttttaaggagataagtgcttaggatttaactttctttaggactttgcattaaaatgtttctagacatgggtggaggacctttatgaagataaaatggaataaaatataccaaaccaatttttctattataaaaaggcaggaagtcactaaatcataaaagaatttacagaagaattgagaccactcatagctacctgaggaaaacaattaagatatagttaaggccgggcacggtggctcacgcctgtaatcccagcactttgggtggccaaggtggacggatcacctgaagttgggagttcgagactgtcctgaccaacatggagaaaccccacctctactaaaaaatacaaaaaattagctgggtgtggtggcgtatgcctgtaatcccagctactcgggaggctgaggcaggagaatcacttgaacccaggaggcagaggtagcggtgagctgagatcacgccatcgcattccagcctaggcaacaagagtaaaactctgtcaaaaaaaaaaaaagaaagaaagaaagaaagaaagaaagaaagaaagaaagaaagaaagaaagaaagatacagttaaaacgtagaactaccatatgacgcagaaactccactcttggttatctacctaagagaaatgaacatatatgtctacatggaaacatgtacatgaatgttcagagcagtgttatttataatagctaagaattgaaaacaatccaaatgttcatcaacaaataaacaaatgtgatatatcaatacagaagaatatatttagccacaaaagggatgattcctgcgacaacacatgcaaacctcgaaaatgttatgctaagtaaagaatccagacccaaaaggctacatattgtatgactggatatatatgaaatgtccagaacaggcaaatccacagaggcagaaagtagattcatggttgctaggggttgagggagagggatgtgaggagtaactgttaatgggtatggatttctttttaaggtgatgaaaatgctccaaagttgattgtggtaatggttgcatgactctgaatatactaaaacttactggattgtacactttaaagtggtaaattttatagtatgtgaattatatctcaattttaaagaaagatataattaagactcaagttcgagaaaaagcagacctgactagtagttctagcttttctatccacacaacagatatttattaagtaaatcgctatatccctagtgtactgctgttcatgacttgtaggatacccaagataatttctgggttttaaaagacttattagcatgggggtgatgtcatctctcacaaaggcagaatctttgcagctggccagagagaccccatatccaaaaagtaatgcagctttgggggaagaaaggagaaaaaagtactacatctgtttgaatacaatggatagagttaggagtctgattaactgacccaaacacataaaatttggagaacaataaagccatgagccaaatcataagagtgtaggatgtaagtttccctaaccccatccctcatctaacttaaaaagagaaaacattttccatcaactgagtgggaaaaaagccaggaatctccatgaatcaggaccccctggatttcttccatcctcattgctttggaagtgattaagtccaatgatgagccagtgtctataaagaattatgctttgtgtatgagcctgtcattttgaaattatattataaaaggtaaataaaggaaaatgacttcccaattcaatgcagtttggggtcggtccataagcacaataccattgtaattaaaatctaaaatgaaatactcagagacaacaggatcaaaagccgtggcatttcaaattgacctgaactatcacttactggcaggtaatatggctgtgatgaaattcctcagcaagaaaaggtttcaatggattaaggagaggtacaggctcgggtagtattatgtgtgtagccaacatagcaacaaggaggtaaagaggatatttgaaaatgcactccctccattaattatgctctacaataatattctaaccttgctttaacactgtagcatcattttcctcatttctgggtccaggcaatatggatattttgtgttaaatatgaaataaattctcaattttctttagtataatttaatacataaatggatgtaattcttctagaaagttttgttagatattaaggtacatatatcaaaacataatgtatgctatatattttatattatatcaaaatatgttaaatcactatagtgttgaagcacagtctaacaatattctttaatgtcccatcagacattaaaaagtatattttaaaaagacaaattttaaaaattaacagtgatcaagagatttaagaaaaaaacccacattgacatactactgtgatatttttctcaaaaaaacagcaaaaatgtttatatcaccttgatgtcaaagtacttcaacttaggttgaggtcatatatcctagtgaaagtagtcaaggaaatagtcatcttgccaaacaagtttctttttgtttttgttttgtttgtgtgtttgttattttgctttaagttctgggatacatgtgcagaatgtgcaggtttgttacataggtacacatgtgccatggtggtttgctgcatctaccaacctgtcatctaggttttaagccccacgtgcattaggtatttgtcctaatgctctccctccccttgtcccccacccccaacaggccccggtgtgtgatgttcccctccctgtgtccatgtgttctctttgttcaactcccacttatgagtgagaacatgtggtgtgtcaaactagtttctactgttgactaatcattcctcattctttagcctgaactccctggagcaaaagtagaaagttaataaagctgctgcctagtgcctaaggtgtcatgaggactgtgaaaaagaataaaacatcattccagcatggggagggaatggattagaccatagggcacttgggcagctatctttgactcagttgtcattagaataggactagcattgagtaaaattccaaagtttggtttgagcctttattaattaattagtatgaattcatttatcatgggaactatgctacctgctacactcttcagctacccaaagccagccgtaaactgctctttccccatttccagccatccccttctcctctaacgaagccctccctcttcctcatatcactcattgacactttacacaggagaactgaattacagttgtggcaccctaacggtcatatgtttggccactcacccaaaacaggattcctttttaccacattcagaatggataatcagatggttatctgcatgaacctttaagtattaagaatccccttacccttaagtcacttatccttgggtgaatgttttctttagatatagtctccttgaaggaggcccaggcctacttcctgaaattctcattctgtcatttgaaatctgctctcttgaaagataggccagatctactacttcaccattcaaatattttaggtcagcatttctattactgcacagcctttgcaacttcagtctcaacatcagtttctttcatggatttcaaaggtttgtcaaatgaccaagctttcaccatcttcccctctctagcctcactaccctcttcagaacttgctggatgcctcaatgtctttcaaaggcgtatcctccagaccagagtttagtgctccatgtgtgctctggctggggtggaatccattgcgtggtcacttttctcttttcttgagttggattccaaagtttttttcatgcagctcaagtttccattgcctggtgtaatgcttttgtcagacttggagttcatttgagcttatcggacaattgttggctcattagaaatcctacctcttccttttcacagaattaaactcaagttgcctctctctgtctaattaattgttacaatttaaatgcaaatttctaatttcttgaatttttaaagtatcatcctaaccttttaatctaattaaattattatatataaattacaattgtattttaaaaccccaattctctcttctattatattatgcattcttcctagcttagttgtctagtaaaaatttgataatcactgcccatgcttttatgtaagtttctgatgaagatgttaaacaagatgggaccaggtacctgtggtggtagatttgcctactttgttaattagtacctgatatgcatagttcttcagtccatctgtatgtacagctgtatttgctacattttactgtctgatccacaaagtttccggaaaaatttgtccagcatgctgctgaaatcagtaatttatctaaatcttttggagtcagattccatggtaatggaagaaaagtggatatatggtttgtggggaaaatatgtggagactgatgaactctcaggggatccttctacatagagaactatgtattattgtgtttacctttcagtttattctatcatggatggtactcctgtcctaactaaaattttataatcagtagtcctcatttcacaataaatgatgacaatgatggtggtgatgatagtggtggtggtgatcatggttataatgattatgatgatgctgatgaacatatatatatatatatatatatatatatagagagagagagagagagagagagagagagagaaagagagagagagagagagagagagagagctctttccatgtgccaggtactacataagtgctttatactttttatctcatgtaatcattgcaacaaacttgtaggctaggtgttgctcactgaccctaactagtttagacattcacaactggtaggttctctttggcagataatggaaacactggagaagtgacaagtggtaaaagttaactgctgtactaccatgtcactaccaggttgtatgaaagagcaaattcttctacataaccatttaatagccagcaggcaccaaaaatccagcctgttttggtagcttggagataatcaatttatctgtctttttgggctttctaagcatttctttgcatgaaaagtttgcctgatgtagtcacaaacgattgttagctcattaaaaatcctaggcagtgacttttctagaatatggcttcacccactctatgagtacaccctttccaatgatgaggtcaaggaaaatgatcagaaagtacagagaggaggcagaacaattagggaagagagaactaaaatagaagtgacgggtcagacaaaaattcatttgggctacttgccacatctctaatttcaaactccttatcctaaatcgggtttgtttaactctcaagaaataggtgtggcccttgggacaagttggctcagattgacatactaccatgcatacacacacacacacacacacacacacacacacacacacacacacacactataagcaatactgttgcctgagacaggttgtttctgattaaataaggacaccctagcaaatagctcaatactaaagacttctaagcactggccaagttcagtaaatgtcctgaaaggaagaagtttagttctcagggtgacttgaaattagaactttttttgctgtttttgttttaaaatgctttgcctgggagagagcactatgtggaattaatatccccttctgtctccacagcaccacactagtcagcctaacttagagagggaaattctttgttgccttttttccaaatacctgttaaagaacttttgctggggcttacctctgtgtgttgatcaaactgaaaattttccaaggatctgaggcttctctggagggtaggttggcattaagatttcttcaatagtgcaaaggatgttgtttttcacaaccaacacagatgtgcatgcttacaatttaccttcagtctggaaacatgttagtgaggcatgaatttctaattggctacccacagatggatacggtactaagtatgcttgaactgaatcatataatttgaaggcatttctaaaggtcagttgacatatattgtataaaaaagaaagattatatatatgtgcatatgcatatatatgtagtatatatacctatacatagtatgtatacatcaatccaggtgaacagagtgtatatgcataatatatagtctacatatgtgtgtatccatatattatattccaactaaaatatcattctcaggcatttaagaaacctgctcttacctcatttcagattccccatgggtactggaatattttatccttggggatgattaagtaagagagatacaacaccaaagctgacttatcattagtgactcagtactggagaattgagaattattcagatgtgccgaaatctctcttctgaccccctacatggaggacaagtcactacactgaagttggcccttgtctgtccccttgtcctttggttaagaactttgatcaactgacttaaggcctcagatatgggagatcctctactttttcatgccctaatttggtcctcagtggtttctgtgctgtctttaagtagataagggaggccctacttcttactggtaaataaactgaagatataccaaaggtacctgcttcagcatgaccattgccttatttggaccagttaacagtgtgtacttaaggctcccaggcagtgaatatctttcatctcctagcagattacaatctgctactataataactccccatctctgttgcattgttagctgtctttgtgtgtgtgttgtgtgggtaaactatttgatcttgtatttcatcaacttttaccaaactacctctttgctattgatgagaacagtaacctttctacacgtaagttccacttattcaagaggactattaagtgatcatgtctctcagttgattagaacatggtgttactgaggtataatttatttttgtagtcgttttattaatgacaacagtaaaatatacacattacttgccatggaacagatcacatgctgagtgttggacttgccttatgtttctctgtgtaagagttgactccaatgatcactcaagtatttccagaagggaaaggtgagaagtgattggtcaatgcctaaggctctcacaacttgtggtctacaaccctgtttgacagtgagctgtttgggcctcggtaggaattttcccacagaaaggatgttctcactggcaggctcccaggaccgcccagaaatccatttaaccataacagagctgacagcactgtcaggactggagttggcttccaagtgggaagtcagcctagtattaatagcacagttccagctgcactgtgggtccagcagacttctgacggtccggcctgggaaccaaggcactctttgtaacatttatgggaaatggagtcctcgttgagaatggtgggaagacagtactgaggcggtacaaggcccatggcttctcacttcccctttctactctaatcacttccaacgccactatccagcaggacgagatggaggggaatcctagaggaatccttctctagccttcaagtctggggagagcctgccctgttcctggcctggctcacttgggtcgactgttctcatgtacaggatatttgtaagttgggtgtttctaggtcacgtgtatttagttatatgatatgaatgtttattttaatatagtagctcttgatccaggcacaaatatattagaatgtaaagttcatttttatttttaaaagatttttcttcattttgactaatttcagttctgattatgatctcctgcttctttaccagtttaaaggcatcatttttatgtaaataaaatgggtgtgcatgattgtagtaaaacattccgttttgtggttacaggaggaaatgagagaagtgggtggtgcactgtgtatgcatgcgtgtgtgtgtgtgtgtgtgtgtgtgtgtgtgtgtgtgtgtaatttgaatatgacctaaaggatgggggtgtttgttaccccaagacatacttcaaggaattaaaaattgtgttgtactaaagggaagtctttttcactaataacttagaagtattgcagaccatttaggtttttttgttggtcagaagtattatagttaacagatttttttcccccgggagctctttgaatacataatttctttaaaaagatttttaaagactgaccagcaacctgaaaattattttctgctaatcccaagtaaatgtctctgtaatgtaagtgctgctttaaagttatcttatggggtacatatgacccaaagggaaaataacttgtttattaagttgattttctttcttttttcatgattcacaaattgtcaaattcattctgtttgggacagtagaaatgtggaaacatgtaagtgagtaacaattttaaagtgtaaatcaactaaaatgtatatgaaaccctgctgggttcttaggcagtctcttgatatttctaagctacacttctctcttctaggattctgttttgggacatagtcataaacacaaaaggaagatttcagcaccaaattatattcatctttaaaatattggggcccttcagccccttccaaacactggaaaactctctggagtttggtttgccaagacatgggaaactttttttccgaatatttttaagggaaaattatattttagggttatgaatgtagaattataacacagataatttaataagcctctatagctaagtctaggttctctttaaaagatcttgttttttcacccagccccatagttacatatttgagggagtgaaactgagcatacaggatttttggagtggcaggtccatttgaaatcattctcgtccaatgttttcattttctagaaaagggaactggagcccagaggggttaagtgacttgagcaggctactgttggtgatggcaatagtaggagtggccatcatttactgaagatcttctttttctgggtttccttacgttttattttaccctcacaaccaccttgtaaggcagggggccatattccagttttataagtgagaaatctgaagtttgggaagtcctctagctgctcaaagtcaacaggtactaagaggcagagcaagaatccactgattctggatgcctggtggcttctgcctcagggtgttttccattgtaccagacatttcccaggcctaagtagaaatacaagaagcattccttctttatacatgtttacttctaatatatcaagagcatctgtatctaagcaatcaccctggttactcaatcttttggatagtagtctggggtattgggtctccttaccttagtttttctgacaaaaaataatcttcctcctactggatttcataatattccaaaatttgtcttcagtggatgcctcaacatatactttgaaatgtctattttatttagatctgaagaagagtattctttttttttgctctcattcagtgattcattcatttatttattcagtaagtatgttttgaatgcctactatgtgcagatgctattctaggctttggagatacagttctggacagaacagacacaaacccctgccctgatggtactttatttctagagggccaaaggatggccaatacatacacggtaaaaaataaggtaagtgagatggtgataaatacactagaaacaaaaaacaaagaaatttgtttaatgagtggaaggagacaccaggaagatggggtaggacttactcaaaaataactgagaggggaaattggggagtgcttcttatcacattgtcaattcagcaaaaaatgccagtgtctattttgttcagcaaattcctttccaaaaatataagttttcaatcccccaccaatagtaaaatgcttatcctaactctgtctctatccttatgatatcttcccatccaccctttatggaacccattgttatcactattataccaaaaaaaaaaaaaaacaggaataacaggagttatccacatatctaagggtaatacaatttgagagtaagagaagcttagtgcctggcctatttttcccaaacatctaatttatggaggagaatcttgaatctcagaaatattgaaatgttgggaggctggggcaggagagttgcttgagcccaggagtttgagaccagcctgggcaacatagtgagaccctgtctcttaaaaaaaactttttttaattagtaggtgtggtgcccacctggagtcctagcagtttgggaggctgaggcgggagaatcgcttaagcctaggaggtcgaggcttcagtgagccaagatcacattgctgcattccagcctgggtaacagagggagtccccgtctcaaaacaaaacaaaacagaaaaataaatgttcaaatgactaaatgacgacctcagatcaaatggcaaggtgcttattattttatttccagtaaatgatgtgctgagttcccatggtgagctaagtgattgagctggatccaggggcctcagcactgacttcagaggagatggtctgtggcctggaggcacagagaaagaactgatacagacaaagacttctgatcccaacccagtgctccttcccctatcccatgatggggactctttgctgttttccagggtctcacaacggtgagaatggggttcccttttacatttgtacttcccactctgtacttcacgtatgtcataggttaaatgagactacttgagctgacctacgaaccaaaaccactgtatctttatttctatgggaaaatgcatgtggactttgaaatatccagctatcttaacagactttcagaattgaggagtgtctgagttggaaaatataagcaaagatcatttagtgttcagtgaggcaaactctagctgcccagcctctaagatactgactatctcctagagaaaacacaatcctctgcagtcctgaaggaagcatcagatgagatacaaataagtagtaacagtttcttccaaattgtatggggaaagttttcttctcttcactatgaagaaaacctgatgatcataaatagtgaccattttttccacaaagtggcaatttgtgagtgtgtataccagccattctgtagtttgtcatagttcctagggctatggggacctatcacaggattgtagctcatttaatctggattcactactttgtgggctggacttatgtttctattaatggtagtagccagtatagtgtcccaaatgcatgttgaatggcgtggagtggaaggacatgttctcttagctattctgtatgctagcaagtgtcattttcctgtctgccttccataatgggaatgccatggacatttcagttcgtgttctacattcctatcatcacctgattgattggaatgatattgctatataataaggatttcgaacatacataagcattctgaggaaacatgaggttagattgaactgcagtggatgctctaccacagttcaagggcaagattattacagttgccttgacaaccatagctctgcactctctgttttattacatactcttttcctatttgggaatccttttgagaagaaacaaaagaaagaatgtcagtaaggtctcattttcaatttatgaggcttctggaaataatagagtcttatatagctacaaaaacgtctccatttcttaaaatttccccaaacattggaaagtccaggcatatgaaatgaactaaaaataagcttttacttatgtcaaaacacaaatatcatctttactccctatagaagtaattattttgtaaggactgaaagaaaagattacttttctatttttctctagcgtacagctgtgacttctatttttctataaaagggaaatatttttgcctataaattttcattagtatttttacctgtattacagttattcaactgcaaataggtatataagtaaaatagtcttactctaggaaatggctaggttgagagactatcaaacagtgatattttaacaatgtgttacattattaattatcaacacatcctcttttaggtttcctttgtagagcacactagtttgtttgtttgtttgtttgtttgtttgtttgtttttcaagagaaaaggtgacaatatttgggtctttataattgttttttctgtattaaagcaaaaatgtagtataaatgtatactactgtgtgactataaaagtcattgagaaatattattttttattttgtccacttgttattaaatctttcttttcttttctttctctctttctttctttctttctttctttctttctttcttttctttcttcttgagacagggtctcactgtgtcacccaagctacagtgcagtggcatgatctcagcttactgaaacctccacctcctgggttcaagtgatcctcccacctcagcctccccagtagctggcactataggcacccaccagcatgcctggctaatttttgtagagacagagttttgccatgttacccaggctggtctcaaactcctgggctccagccatcctcccctctccgcctcccaaagtgctgggattacagtggctctatggaacaaattcatatgttaataccctaggatgggagttagggaacttttctgtaatgggacagatggtaagtatttcaggcttttgaggctatacagattttgtcacaactactcaactctgatgttgtagctgaaagaagccatagataatatgcaaacgaatggactgggctgtgttaaattaatactgtattcacagaaacagacagtggactggatttgtcccaggggctgtagtttgccaactcctactctgggagaaaaattgttttgcttacttatctgtccacagtctacaggggagtgtagtgcttcaggcaaattgcttcttttataatatatgcctaaactgagcatggtggtgcacgcctgtaatcccagctacttgagagactgaggtgggaggatcacttgtgccccaggagtttgtgtccagcctgggcagcatagagaaaccctcatctcttaaaaaaaaaaaatgtgcctaaaagtccatcttttcactctgacttttgtgtaaaatgtccccattgctaccatattggttctattagagagaaaggcaggggttacacacttttgcaactcattagggagagtagaagcagatattgataataatttccttgttttaaaagctgttagagcacatgaaaaaaaaattcaactactaagatttccttacaccctagctgaactgctcagttagaactgctcttgaatatcaaaggctaacgtgccctgcctgcgtaaggtggcaatataaactgaggtagacactgtgggatgcagccccttggcccccagctggcctccccatccccatggggtctacatagtcacctggcaccaagaaaaacgtgcttttttctttatttttctttgaagtattcactggtgctttgttcaaactgattttagcatcctctttgagtttgaatcagatacttcaaagaaaaatatagaaaaacgaaaacaagtatctatgtatttgttactcagatttagtaactgttaacatttgttcttatttgctttggatatttttatcttttttaaaataaagaatccctttcattgacacaattgtaacccaagaattttccccattctttctaaagaggctattgtcagaggaatctgaattattttccacttattaaaattggttattgagaggcaaaagaatagaaagaatattgattttatagtatatattcagagcatcactggtgcatagtatgaacgatttgatccaatttgtatggttttctgcccatcgaagactgaataatatcatgaatctactcccaagagagacatagagaatgcatcacatctctttcctattgggaatgggatatgaatctaaaagacagtaaatataaaccatcctaattcataatagagagctggatatatttttcaatttcaatggcaactttgaaaagtacattatttttctctgctgcctttaacatactaattgccttgtggtataaatgctttcataaatgctctctcatctgatcttgtgtgatagttacaatagatggtattacagctctctcccaggtaagggtatggatgcactgggatgtctgtacagtgtttggcagtcttggctggacctttgtatcacctaccgagctttgaaaagatactgattctgagcctatccacagaggttcaatccaaccagtctgagcaacagtattcttttcttttcttttctttcttttcttttttttttttttttttttttttttgtgatggagtttcactcttgttgcccagactggagtgcagtggtacagtctcggctcactgcaacctccgcctcctgggttcaagtgattctcctgcctcagcctcctgagtagctgggattacaggcacctgccaccaccatgcccagctaatttttgtatttttttagtagagatggggtttcaccatgttagccaggctggtcttgaactcctgacctgaggtgatctacccacctcggcctcccaaagtgttgtgattacaggcgtgagccactgcgcctggccgggcatcagtattaattgattctactgtactgctgaggttgagaacccccaatggaccgaccagtggttctcaagtagggactatttgcccccgcaaggggacatctgacaatgggacattttttattatcacaactgagaaggggcatcccctggcatctagtgggtagagaccagggatgctgccaaatatcctatagcacccctacaacatagaattatctggccccaaaggtcaataatgcttatattgagtaaccctgatttaagctggactaaagtccctctgactctaagccatattgtttccccagtctcaagttgctagattattcaaattagtcatcctcttattattgctgctaataaaatatattttaattaggttgttcttcaaaacaacatttacaatgactttttagtttatcaggaaccaagtgatcttgtgtcataaccatactgggataggcaaaaatccttatattaaacattttcaattacttttatcagaatacaaaacaagcaagcaaacacacaaaaaacaacacaccatcaaaaagaagaaaagagctatttctcaacataaattgctctgtatgtattatcccagatgagcaatgtgtattatataaagcagtggatttcaaacttgagagtgcattgaagtcacctagagggcttgttaaaatactgattgccggcctcatctccagagtgcctagtcagtaggtccggggtggggttcaaacagttgcattttgaataagtttccagctaagattgacatttctctcctagggactatactttgacaatcattaatgtaaagaatttctctatattagcatttcaaatgaatattaaccctggggaccatctattaaggcctcaagttaatattcctaaaagttaaaaatcattttatcatagtatacaaataacttaaaatatgattcatcaagaaatatagagggcttcctaattctatagttacaatcaggacagccctatagaatcaaaccttttgctcccacttctaagagcagcaagagctagcaacagcaagctttgcttaagaacaagcctagtagttttatgaatgcacagctctctacctgatcggaaatgaagggatgccagttcactgagacatttttaaacgcatctggtcaatgagaaagttgatattttctgtttcctgatgtgtatccttcaaattatacataagtgcttaagtgaaaatgacttgatccaaattcccttagctttggatacattaacatatgctcatggaagggtggatgggatatctaaaattttattgaagtgtattgcctctctataaaataacaaaaccttaactccttaagtaattaaaatatttggcagaagtggctaaataatgttagattcaagtatggaatctgaagcccatttcaggtatttcaagaacaagtcaattattcatccagtctatcagccaaagacacttgacagagagcagtgacatggtgttttgtaaaaggcatttccatagtactagtgctctcattttgttgtcatccagtagaaagaagtgtacacatttgtgaagaaatgcatgaggtaataaaactatttaaaaatccacattttctcaatttagatggacttttcttaaactagtataaagttaggtgttaccatatattttgtaggcataaaaatctaaacctcaaagtggcagaattcaagagtacccatcccttattttctacaggagttcatctgaatcccttgatagtaaagattttctttctttctagaacctgacataattcctagtacataccaagtgataatgacactttcattgaatttacttaaatagctatatgagaggtccatgtatttctatatttcatgaatttcaaattatatatttcagtcccatttaaagttaggatctttataaagaaaatcctgaagaggatccagactatagcgtccaatgtgcaaatttttaattgtgagctagagattgagaataaaggaaagttattggaaaattttccaagaactaagcctttctgttgtgctggtattgatgatatatgtgtcagtcagcaataagactaccaaaggtgaactaaataatccggtgccataaaatgtcttataaaacttaagctgctaagaaaatctaaggattaaaaaatgtacctattcgcatacttctgctgttgtgtgtttaagagcaaactgagaggttgctatggcattacttatgcgtgcatggcaacagagcgaacttagtgattcagcttgataaaagaggaaattagctcaccatttcccctttccccaaatcagagtcagatatccaaatatttcattttgaaatggtatatccatcaacacgttctaatggatgaaagtcagtgggggtgggggtgggggaaatgtcataaggtgaaattcgtatgtcatgtgcttactttagggaatgcaacttgtgtctaaacagtctattcatatctctgcatccttctttccccctgataggatggggtttctcagtggcatctgttgggtgaatatacgatgatgagtaacactttggcaaaagacagcaatttatcagcccgtataactttgttctaatggaagtggatcatcccagaatttgagaaagaaacattgttcagctgtgaaactccaattccctgtgtgtaacagccctccagggaaggagtagattttgtcagcataatatgtgaagtttagtcattatcaactgcacaaagcagaggtcaggcgtgggcgtacatgtgggaggcactattatgaaatcaacccacagccactgccctgctggggtgatccaatacaaacagagccaaatgtcatgaataaatgctgacattttatcacatgattagtttaaatattattttactactgtgctttttcttgtattatttatctttcacatctttattttgtttccggtttcctttctttaaactgataaatgaaaaatagggaagtatgttttgagtcagtactttgaccatgaacacaggaagttaactgaaccctccaccaccagaacaacaacaacaaaaaaactctaaacctgtgaatcttggaatcttagatttgttctgggttgacatgggttttggaatcataattttattaatttattttttaatttacatagagtaaaattgaccttctggagggtatggttctatcagttttgacaaatacataaagttgtgtagccaacatcacaattgtgatacagaagaattctatatataccaccccccacccccacccccaccaccaaatctcttccttctgccttttcgtagtcaacccctcttttcaccctcaggctctggcaaccattgatctgttggaactgtattaatctgaccgtttttctccactctgtccattcatgcaacaaccgtttattgataatctatgctgagctccattttaggtgctagggatgaaatggtgaacaagactgacatagaagtttctatctggaaacaagataatgaacagtagtaaatcagtaattccaaattgtggcaaatgctgtgtaaagaacagaaatatttctgtgacaacagatatctgaaggcgaaatctttttttttttttagacggagtctcactctttctcccaggctggagtgcagtggcgcgatctcggctcactgcaagctccgcttcccgggttcacgccattctcctgcctcagcctcccgagtagctgggactacaggcgcccgccactacgcccggctaattttttatatttttagtagagacggggtttcaccgtgttagccaggatggtctccatctcctgacctcatgatccacccgcctcggcctcccaaactgctgggattacaggcgcgagccactgcacccggccgaaatctattttagacactgttaagaaggttactctgagaaggcagcatgtaatctgaggactggaggaggagaagaagccagctgtgtgaggtgtgggtggggacacatggggtaatcattccaggcggagggaacagtatgtacaaaagagagttgggagtctagtgagtgaagggagcaatgccatgaggtgctgtagatagataggcagagcttcactaaggtgtatgtacttcattgcattgcagtgagaagccattgaattaggatggggctctaatggggatggtttgattgatgttttgagctctgtgtagaaaatctgtggtagaccagcaagaatggatacaggggaccagttgatttgcagccaccatccagttgactgttaatggaagattgggcttggcagcagctgtggagatggagaagggatggatttgaaatatattttagaagtataagcaacaggactaagtgtttaattagatatgggtaaggggctggtgaaggaaaagggggaatcagatgtgactctcaagagcttgcttgagcaactgggtgggtgatgctatttactaacatgagtaaaatattgagagagaaacaagtttgtattggaaaatttaaaagctggggctttggacaggctgaaatagagaaacccattagacatccgtttggagatgtgatgcccctagatggggatatgcatgtagaattcagaggagagctcagagctgaggagagagaaatttgtgtcatcatttaacttttaattattcattatatcataaatatacaatttaaatatattattatattttgatatattaacgttaatataaaatctgtattattaacaatttattcactgatatttattgagggcccaccatgagggagacttagtgaggaaatggaggtatgatggtgagtgcaagcctgtatgatctgagacaggctggcagtagtcacacagatatgtgtaaaatttaagggacctcagtaccacaaaggagagggttctatgaaagggcacgagagggagattcgactaaatctgggtggaggtgagggtcaggaaaggcttccctgcgcattaaagaatgaggaagtgggagaggatatcagattaaggaaagaacatggataaaagtcggtgtggtagaagaccagagattttggttctcagatgcactgtgattccaatttagatgtccagaagggcatcccaggaacatctcaagcacttcaggcaattcacattccttcagcaaatatttgttgagcacctggagtgtgcctgagattctttcaggtgttgggaattcagcaatttatgtgcaaaagttctttccctcatgaagcttgtttctttctggtggagctgattcaggaggttcacaaattccagacacatcttcagaaggattgactaagagatgttggcctgcaacagagccatgaggagtgccagcatttagagctctaaaggagcagaagcagcagcaaagaacctagagcaagtggctagtgaaggaaaaagagagaaaaggggtgcgtatagcaaaagctgggggaggtccagatggcaaaggtaatgaatggccagctaggtttagtggtgctgagggatcaggtagaataaaagcagaatagtcgcccctcagctttataacatggcagcattgggaatttttaccaaaccagttttatctgaatagtggaagtagaaaacagattgagttgcttgaaggagtgtctgggaagtgaaaactgacaaagtgagaagatattggcaattgagaagtgaaaaattgctgatgactttagagaagtttgccttcagttcgggacttcattattttcctgcaggaaagagtcttctgttagtggggagattaattaacttatttttgcccaacttgtctatctaaaaggaagaaagtagtaatacattaaaagattgagactgctgaggatgaaatggggtagtatatgcatgcagtggatgctcactaaaaataagagcttgcatttatagtattttaagtttgccagtctcactctacctgacataaattttcagtaattatcttattaaatgccaagtaagattcaaattattattaactgatactcaagggaggaaatagggtaagttaagcaaattgccctaataacgctgctcataagccatggccctcggagaatttgaatccatattttctgtggtttggacatggtttgtttgtccccatcaaatctcatgttgacatttgacggtcagcatggtgatatcggaggtggggcatagtgggagatgtctgggttacagggatggatccctcataaatggcttggtgctgttctcatggcagtgagggcattctcactcttgacactagattggttctcaggggaattgattagttcctgcaagagtgggttgctagaaagccaggacacccctgggtttggtccctctttgcacatgtctgcttcctctttgaccttctcagacatattttaatggaacacaaaagctctgctgaaatccaagcagatgccagtgccatctatcttgtaaagccagcagaactttgaaccaaaataaacctctgttgtttattaactacccagccttagctattcctttatagcaacacaaaatgaagtaagacaacatctgttgacttggttctatgctgtgtttgctccacttggtgttgtaattttattcccctataagaattgtatctgcttaagtggagactgagtattcatctactttgtatccccatacttaccattgcatttagcccagtgcctggcacaaagtttgcagttgtgagtggcactgatatgaaatttctcagcccttggcccagccttcttgggctgctcttgtttttgaagctccagtttatactcaggagaaatgctttggacttcagacctccaaactgattcatgttacacatatcatcagtggagaaagtgggacagagtaaagggtggagatagctcttgaacacgacagtagaaatggtatgatgttagcagaaaattaatatgtgcacatcttgttgtactgagaaatactctaacattataaggaaacaaataaaactgatcattgctaggtgacgtattatatatatagtatataatgtaaaaatacatatatagtgtatgttgtatataatgtaattgaatattatattgtatattatatgcaatgtacatctatatatctatagatatctacccttgtgtatttttttcctacaaaatgaaatactttcaccatcagagagtaccaagtaggaatattcccaggagggtctgagattgggatgcaatctcggaacccattaaagagcctggggacaggtgggctgtaggagtcctgtggagagcttaaaaggtgtctcttacctcttgaaagaaatgactgtgaggggtgaagtaaactgacccggtgtacgtctccctgggatatattacttactaacttttaggtcttacctaggacacgtatataggaaatgttcctgaatcatgcttggctgcattatttccctgtagtggcaaaagtggcctgcagaagctgtgcattctgggtccttgctagaacccagatgaatgttgcttgggaattggagaggaaaaaaggaaacagagcactcccaaattctttcccaaatctcttggatcgaaacatcttaaattgccatttttatatgtccaagatggtcaaatagtaaccatttcacgcagctcaaccaaaaagtatgatccagctactacagagatgtggacattggaaggccttcttgttggtttcaagtttggccaattggtagacatctggggctgtatattaaggcatcttgattttgtgagccagagcaaaggccttcttgttcctgtctctatttgaatagtatctttggtgagagagtgccagcgtcatctatttattatccttcatgctcagtgactatgtgaaaagaaaggaaaagacctttaaagctggggtgattgtctagacagtcctaaaatagctgctccaggtgcaaaggaagccataaaatgcagacaaagcatgagactcctttggcgaaaatacagtgtgtttgaactctcataggctccctgtaaattatgaagtagaaaatgcccaggagactagattccaataattatgatcattagttattttaaattgccaccacttacttcacacagaggcattctctgtgtgctaaattaaatttaaaatattttaaaaataattatttgaataattcagagctgaaatagtccaggttgaactatttagcaggctgaaacacctgtgcaagctttaattcaaaatatacagagaagtgacttcatttttcactccactgtggaggtcttctaatacaaaacaagaccttcagcaggagtccatgccccctggttctgcaccttcttgccttctactttgtcctgtgcctacccactgcactctcaaggtccaccatgacccggccctgctccactccagccgtgtcctctaggggatcgctgccaccttttacctaggcctccccaccatggcctctgccagagccagctccttgtgggcccatgtggaaatgagacctccagatcccatcctgggaaccaccaaagcctttaagagggaaatcaacagcaaaaagatgaatctgggagttggtgcctaccgggacaataagagacccagttagattaccataaaaaatttagacaacagcaaagacttggaaccaacccagatgtccatcaataatagactggataaagaaaatgtggcacatatacaccatgggatactatgcagccataaaaaagggtgagttcatgtcctttgcagggacatggatgaagctggaaaccatcattctcagcaaactatcacaagaacagaaaaccaaacagcgcatgttctcactcataagtgggagtttaacaatgagaacacatggacatagggaggggaatattacacaccggggcctgtcacggggttgggggctaggggagagaaaacattaggagaaatacctaatgtaggtgacgagttgatgggtacagaaaaccactatggcatgtgtatatccatgtaacaaaactgcacattttgcacatgtaccccagaacttaaaatataataaaaaaatttagacaaggaatacctgcccatttggggacaagctgaattttccaaggcatctgcagaaccagccttgggtgagaagagcaaagtgttgaaaagtggccagtctgtcactgtgtggatcatttctggaactggggtttaagggttggagccagttttgtgcaaagatttttaaagtttttgaagacagagatgtctctgtccaaaccaccctggggaaatcacacacctatcttcagggtagctggcatgcaactacaagattatcaattctataaccccaagacttgcagttttgacttcacgggtgctatggaggacatttcaaaaataccagagcaaagtgctcttctcctgcatgcctgggaccctcatgcaaagcagtgaaaggaaataataatagtggcaaagaaaaagaaactgcgttctttgatatggcctaccaaggctttgccagtggtgatggtaacaaggatgcctgggctgtgtgcaacttcattgaacagagcattaatgtttgtctctgtcaatcatgtgccaagaacatgggctttatatggtcagtgtatgagagccttcactgtgatctgcaaagacagtgaatgaaaccaaaagaggggagtcagttgaagatcctgatccatcccatgtattccaacccttctctcagtggggcctgtattgcctctaccattctgaacagcctgggtttgtgaaaataatggttgcaagaagtgaaaatcatggccaactgcattactagcatgcagactcagctgatctccaactgcagtaaggagagttcctcacacatctgacaacacatgactgactaaattggcatgctttgtttcacaaggctaaagcctgaacaggtggagaagctaaccaaggggttttccatctgtatgacaaaggatgactgcatccctgtggcagggatcacctccagcaacacgggtaatcttgcctatgccattcaccaggtcaccaagtaatgtccctggtgtgagggaacaggtacaacttttctgtcttcagctgctgctaccgtgagcttcacatggaggataagggagggtagatggtggtgagtagatctttttttttttttttaaccacagtgcgtaatactgagtgattgaatgcatttctcagaaaagaacatgtagcgacattgggcagaggcatctgtggctggtatctggaactttgtgactctaaaccaaactctcccccatctttttatctccaacttttccgaaagggtttacatgtgtgagaaactcatagcaccaaaaaacttgtcaattatgccactgcaatatttcagaagctttaactgaagcatcttacggtgtcaggggttcttcatgagaaatagcacacattagaggctttgagagaagacctagttctgtcattaacagtcagcctcaagtttgtcctcccatgatggagcaaccttatcaacagaccatatcgcagaagttgtgttttatgaaaaccaatgagtttgctgccactgcagcaaggaaaataaaaggtgctttttcctctcatttaagaaaaagaaaaggctatctcttctcctttttcatgctattcttttccttatgcacaaagatttttaactatcctagattttcatcccattctactgctggattgaccatctaccctgtattagtccattttcgtgctgctaataaaggcatactggagactgggtaatttataaaggaaagaggtttaattgactcatggttcagcatggttggggaggcctcaggaaacttacaatcatggtggaaggggaagtaaacaagtccttcttcacatggcaggagcaagaagacttgctgagcaaaaggggcaaaagccccttataaaaccatcagatctcgtgagaactcactatcacgagaacaacatgagggtaaccatcccattgactcagttacctcccaccgggtccctcccatgacatgtggggattatgggaactataattcaagctgagatttgggtgggaacacagccaaagtatatcaagccccatcctacttggatttatttaagaataaagaacataattttctaatgacgccatagccttactgttctcagtggagaaggtaactgcaatttatctgagcatcttcttcgatgattgtgtaattgtctcctgctggatgttgcctctgcccagttggacatcctcccttcattgaatatggaaagcagattagtggttgctagatttaagaagatgatgagttgagagggaggtgcaaatagctgtaaaggggtagcaagaggaatccttgtggcaatgaaactgttctgtgccctgactattgtggttgtcacacaaagatacatatgtgataaaattgcatataactaaatacacacacatacacacattcacacacaaatgataacatgtaaaacttgtgaattctaaataagatagttgaatcaatgtcagtttcctggctgtgacattatactatagtcatgaaagatgttacaactgggggaagctgggagaagagtataggagatggctctatattatttcttacaaatgaatgtgaatctaaaattatctcaaaataaaaaagtttagtctaaaatgcattcatcaacatgaacttgagtcaaaccatcttggaagagaggcactttgatgtattcacttcacaaagcatagggatgaagatctctggtagtaccagcaagccaaaacacatgactttctgctgtctgtaccctgtggccctgcactgtggataagggaatgtatgtgtcctctagaacatttttgttttgattgctttgtgtttgtttgcatcaagaaaaaagttgcaaattaatgagaatatatgtgtatatctctaagattcatcagcacccaaaataccagagcaagccagacgtcatagggaagccctgagcagaatctacaaaaaaggattgaataatttgattattcagagaaagcatatttctaggggatggatctaagagtagcttgatcatgaaaatggtgggaaaaatatagcggcaagagggtcactaggtggaagtaatatgtctagtttttttgagaaccacacttgagctaaacctttaaaatccaatcaaagaatgaaaatgaatagattagtgtgaggaggtaaacgtatcatttgaaaatagccttggacttgggtactttgctctcattgatttagcaatatgccccattttgttagttgtttatacagagcttcacagttttaaagtaagcatagccagttatgtctatgatttctctgtattcagttatatttgcccaggaaagtctaatcaacaaacagttatcagttatcttacccatgacaacattgtgagatgttgtgagatgccaagaatagaccacaagagcctctttgtgatggtctcagacctccaaaaccaataaagaagaataacacagtaaatcagtaacatatctatagcatttgaattcacatagagaatttgtttagtgggcctgactaaatgccttcactttgcagcttacaggggcttgtgtttattctgcctatcttaagcatggttttactcatttagtgggagcagttggctcatgtcttttacctatttcatttactaactctaagggagtcaagaagaaacttcccctttgcgctctaaagggtcactgaaaatatactggcatgaggcagattgattaacagaagaaaaggcatacacgtttatttaacttgtatacacagaaaccttcggaatgaatacctaacatacaggggaaaatggacagttgtccatttttatgcttaggttcaacaatatgtggacagccatgtagaaatgtgattggacagaaagggtctgatttaaatgctaatggactgagtaggggaaacccagtaaggcctgtccatctagattattcttggcctctctgagaagcatttcttccttcttgatgtgagagaggaccctgtctggaacaggagtcttaggatctacagtcaaaccagttaggtcagatcatttcttcatggccagtttttacgtagaatatttttaggttttatgactgactttcaggaaaaggggttctgatttgtatgatctatcttggggaaaagggattctagtttccatggctatccttagggcaaaatgggactgagaggaggacaggagaaggtcaggagaaacttttgcttctgaagctgctcagcagcagtcttcattttgagatactgttttctgagccccaacaaaattcttctaacatgctgaacatgtgccaggcactattctaacatccatgagaatagagaggaaaggaagagagggatcctgcagctttccagttgggtgctgagatgatgacaccattcactgggtgactccaattgatttgctaaatctattctctgcattttgactctgccaccttcttaccgtgggtctatgagcaagtttctccactgttctattaaatatctgtgaaatgggagcaatggtggtgttgtgatgattagatgagtaaacacatctagagcatagagctctatgcctggcacaaacgaagccctcagttaatatttgcgggatgtgtaaaagattgtgtttatctggttttcaagaccatcctcctcagagacgccaaggagatagttgctatgcttcctggcgttctaagacccacatgcatctcgttaacccttgagaaatctagtgggctctcagaatttttaaaattatatattaataaattataattgtatttatttggtgaaaagtgatgttatgaattttgaatacaatgtggaatgattaaatcgagctgattaacatatacatcccaaatatttaatctttttgtgattagaacatttgaaatttactctctgtaattatgaaatgtatggtactcagttattagctatattcaacatgctgtgcagcagatctcaaaaaaaactcaaatgtcttcctcgtttctgaggctttgcaccctttaaccccattgctgacatcccccagcctcaccagcttggtggaacaccttgagatgtgcttataacagtagctgggatgtagtcagtgctaaaaaattgttagcttttgctgttgtgcatgtagttgttgttgttattgtaaaatggtggctggaatccacttgcgaatatgcagtcatgttacaaatgaggatgtttctgtcaataatggaccacatagacaacagtggtctcataagattataataccatattgttactctacctttctatgtttagatatgtttagatacacaaatactattgtgttacacttacctacagtattcagtatagtaacatgctgtacaggtctgtattacaggagcaataggctgtaccatctagcctaggtgtgtagtaggtttgtgtaagtacatgctatgatgttcacttcgtggtccactaggtcactagtaagcctttctgtacctttttgtatgtaactctttgtatgtctgccacactgtatgataatgcttaggtgtttgtataaatacactctatgatgttcacaatgacagttttctcaggatatatcctcatcattgacacgtgattgtactttaacagagatacaattcttgaacatcttgttagaaggagatgggagaaataacagaaataaaggtagtgtcttgcatttttcaattattaaactaatcaattcattaaaacagctgtcattaattacttaaagtcaggcaggtgagggaaagaatggcttgacgttttctaatttatcactctttcctgttgcccctgactaaacaaactgtggctgctgctacagctaagtatgtcaaactgttgaatacccaagccaggcttttgaaatattgaaaaatgactactcccatgttgatccataaaatctttaccatcttacagagagctgatgaatcatctctctagcaccaggttcacgaacttcccataatgatctcataactctggtgccaacattgcctgggctcggtaaccttcatgaaatttattattaaagtttgaaattcgttcttgtgtaggtgtaatgggattagtcgaattgcaaagatgatagggctgctatttacagaaaaagctcctttctaacacttgccttttctaatgagtcaccataatacctctgtaattattacattgattgtcttttgcagaattagatttttttgtaactctgggagattttgattagaacattcagttattatgtctgaagagtgatctagctacatgagttaatagtctttggattgaatgtgttgaaaattaaattgaaattagaatttttgtacatcaaggcttcaggtgccctttagcaactttgggagacgaagatatctccacactcagaaataggttttactgaaaagtttttggtggtgaaaaaaataaaatacctcaaacaagctgcagaaacaaagattttcccagaaattctcaacaactatgaggatagactagaagttctgcaagggcagacacttgtacatcattaatccttgacagaattggtaggaaacctttggattttagccagtgtggcagagtaccctgagacgtgacagaaaagagtggtggtggtcaggcactgaattcagttaactgttactggtttctaagaactcatcatgcattcacatagaatctttgtcaacttcacaaaaatcctagtagagtgagatttttatccccattttaaaagtgagccatgtaggtaactcgctcccaaattactcaataaatgctgcatctgaattagaatctatcggaggctggctcccccatctggacttcagcatgacttcattaatgttccctaccctctccagccctatgctggtccactagtcactggtgtaccttcctataccataactgtatctcctgtacagaataataatgctcagatgtttggagatgtatgtgcaaagttcagaaatgactttagacaacattttaccttccttcacgatgaaatgagaaaaattaacaccaatctaataccaaaacaaaataatttaccacaaaagtgattatcttgtaatgtgaaggattcaatatgaactatcactgaatatggtttgaaagggttccatattaatgcatgtcagagaagcaggccagatgctgactaaatcagcaatgtctttgttgatgctttttggcctgtaaagtacctgtaaagtacctgtaaagtacctttaaaaccctgtaaagtatcttgtaatggtgtagaataatcaaagacttgggataacttctgtggtcacaaagcctgttgtaaatgaataaccaggacttttgttttgataaatctaatctacattcctctgtagcacacgattatactcaaaagcaggttatgattgcccccaaattcctaggtaccattgtgaagtcaggctcagacctgactttttgatatctttttacctgagcccctacatccctggcaccaatagaggacatggtaatagtcactaaatgaacccataatatctgtgtttaggaggagtgacattttttggcttattgctggtattcaaatgcctctttactcacctatctttgacaacatccctctggattatggtactcacttagtatgcccttcccataggtgttcaacattccaaaattatttgatactttgcaaaacatccagcaacatcaaatattttccaatctttaaagggctgaatttagtttggccttagaacaaaacaatctgattgaagtaatgcatactaaaaagtgaatgacgaatatgttttgttttgtattatttgaaattttagacaaacttttcccttacaagtctttaaaacgaaatgtgtgagcaagattttcttttctttcttagcaggaatgaatgtcagatgtccttttcttacctcaacttctctttactaccccattcagaaacttgacacctttctcctgaagtgttgatgacatgtaatctaaagaatatcttggacatttaggaaaattaaacacataggaaacttttttttccttcctagcatgaagttttctatttttccttcctttgggtgggacaaaacattagtaacttatacagtgctactccctaatgtaaaattataaagtcatttgtatttagggatgtaggggttttttttagatttaatgtgtacttatcatgaaatcagtggatgattgggtcaagtctatgacattatttaactaagcggtctgccatggcattatttaatgaaataatttttaaaaatgcttttattttactgtaagccattgaagaaaaattttactcaaagtttaacaagtgtttagttcatgatgaggcatttgcagctgtaagcaatcatattactgtgccatcatttagttttatggaaaatgaaaacgtttacttaaggctgttaaaagtttgttttttaatagtgcctcctaagcaatacaggctaccacttacttttgacatcgagggaaaaagagttactcagattcattcaagctttagttatattgatttctacgatgggtttttcttagcatgtcaagtgattcctgttttatagtgaaggcattactttgagtcaatatcaaagtacatgatcccctcaaccttcaactgtgtttcctgctttgtgaggtgccaacaatagcaagaagggataatttaaattccgctttccataggaaaaaaaaaaaatcccagctgggcgcgatggctcacgcctgtaatcccagcactttgggaggccaaggcgggtggatcacctgagatcgggagttcaagaccagcctgaccaacatggagaaatcctttttctactaaaactacaaaattagctgggcgtggtggtgcatgcctgtaatcccagctacttgggaggctgaggcaggagaattggttgaacccaggaggcggaggttgcagtgagccgagatcatgccattgcactccagcctgggcaacaaaagcgaaactccatctcaaaaaaaaaaaaaagaaagaaagaaagaaagaaaaagaaaaattcctttggtaaaacattatatactctctaaacagggattctcttcacaccattttgaattgcgtgcttcttgccttgttgcacagattaaactgggaaacaattttatgtgtagcagggtttctaaacctcagctctattgacatttgggggcagatcattcttttttgtgaggggctgtcctgtgcattgcagaatgttgagcaggatgcctgatttctagccgctagatgccagtagcaccttcccctcagttgagacaaccaaaaatgtttccagacatccctaaatgtcttattgggtgtgaagtcatcctcagttgagagctactaatctagcaaattagcatatttctagcaaaatagcataactacttttaaaaataagtttggtctaggatgtttttctctttcaaatgaggtatattttagataattttcacttcaataataaataataattacagaaaccaaaatacaggtttcagatgttatctgtgtaggaatgtgaataacagtgacaacattttctgaaagaaaaatttgtatgtagagactaacaaaggtgttttttctcatttgtgcatttaattatgatacaataatttgattatatttagtggtaaatgaataatcttcattagaaaattatacaaagaaatgaacaattcagaaaaaaataatagctttcatattttgtcctgtattattgaagtaagcatgttgcacccacttgatatgcttattattcttaaaaatttcccacatttcttggtaaatttgagtaattcctgtattgtcagtgaatacattataattttaatagtgattgataagcattttgatctctagatttattatcattaaacaatgcagtcacacactttaaacagaattagtagaaacattttcttatttttcttatttggaacatttatcagactaaagaattttaagtgtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagtcgagattgcgccactgcagtccgcagtccggcctgggcgacagagcaagactccgtctcaaaagaattttaagtgaaaccaaccactactttgtgctgcatatatgagagcacttcaaaaagttcatgggacaaattaaatgaaaagataagaaataataaatagaaactttctcagcatcaagctcaagacacttttttgatcaatgatacccgccattttagtccatctctaaagaactaagggtcctgggaattttaccatgtcattgcaatcttttttattttattaactgaagacaaatgggtgccctttagattttttttttttttaagattagtaagcaaaaagaagtcagaaggagccaaatcaggactggaaggtgagtgcttagtaatttcccatagagactctcacaaaattgcccttgtttgataagaggagtgatccaggagcattgttgtagtcatttttctgctaaagctttggctaactttctcaaaatactctcatagtaaacagatgttaattgagttttggccctctaaaaagtcaacaaacaaaatgccttgagcatcccaaaacgctgttgccatgacctttgctcttgaccagtctgcttttactttgactggaccacttcctcttggtagccactgctttgattgtgctttgtcttcaggatggtactgggaaagccatgttttatttcctgttacaattctttgaagaaatgcttcaggatcttggtcccacttgtgaaaaatttccttcaaaagctctgctcttgtctgcagctgatctaagtgcaatggttttggtaactttagggcgtaaagtttgcttgactttaatttttcagtcagaattgtgtaagctgaaccaattgagatgtctatggtgttggctattgtttctgctgttaatcattggtcctcttcgattagagcatgaacaagatgaatttttttcctcacaaattgatatggatggcctgctgctgtgggcttcatcttcaatatcatcccttcttcttttttctttttttttttttttttttttgaaatgggggttttcactcttgtcaccagactggagggcaatggtgcgatctcggctcactgcaacctctgcctcccgggttcaagcaattctcctgcctcagcctcctgagtagctgggattacagctgcccaccaccaagcccagctaatttttgtatttttagtagagacagggtttcaccatgttggccaggctggcctcaaacttctgacctcaggtgatctgtgcacctcagcatcccaaagtgctgggattacaggcgtgagccaccacactcagccctcatcacttcttaaaatgagtttttcatttgcaaactgttgatatctttgggggactgtcctcataaacttttaataaagcatcagtgatttcaccattcttccacccaatcttcaccataaatttgatgtttgttcttgcttcaattttagcagaattcatgtttccctgacaggggctcttttcaaactgatgtcttatctttcttagtgcctcaaactagatcttgttaaggcaggttataacaagttagtaagaatttattttggtgtaatatacatttgaaatttttgtatagttctttcataatgcatattttctatgaactttttgaagtcccctcatactttctctttgttcattttactagcgtgtttgactaagataagttttaaggacaaaagtatgacttgtatggtttttataattaagtatttctgtaatattccacattattgccagttctgtccagggagaagtttttccagctcattcctgaataattgttacaaaccattcacattcatctaaggtatttctgataactaatatcaaaaccttcagaattcagggtatactatgcttagcaatattacttggagcttctattcaaacagcagaaacagattgttttcctttatccaaaatataatataagttacatcatgtaaagcagtgataacattttgggttaaaccccaaatcacaacttctgggtgagaatccttcaaattttaatataatcagcagaagcattctagtagagtttaaaaatgtttatacctaagaaatagtcactccagatttgtcaatctattgtgcttaaatatgaaaaatgtgtacatacaacacttaggcaaaattcacagaatgagttctgtatgaatataacattgtggacaattttatcctatttaccacatcaattgatcaaataagtttatgtgaatgtatgctatcttggaaggccaaggcaggtggatcacctgaggtcaggagttcaaaaccagcctggccaacatggtgaaaccccgtctctactaaaaatataaaaaattagccaggcatggtggtgcatgcctataatcccagctacttgggaggctgaggcaggagaattgcttgaacctgggaggcagaggttgcagtgagctgaggtcatgccattgcactccagcctggacaacaagagtgaaactctgtctcaaaaaagaaaaatatgctatcagtgtttttcactggggaaattttgtacctccccccaggacacatttgccaatgtctggagacttttgtggtcacatttgggaggggtgatttgctactggccaaggatgctgctaaacatcccacagtttagaggacagcaacacccaccacaaaaacaagtgatctcgcccaaatagcaagaatgccaagattgagaaactctgtactgtagagatgatcaataaaatgttttctttattctccagtgattttcttgagatgttcttcagatttgggacattttgcaaatgttaacttgcatcactgtatctgtgggtatgccaacagtcttactcacatatgtcacgtcacagcagaaagaaaagataatctcttaattgtcattttatcttattttccagagcgccactttaactgcaatttcttcacaaagatttctcaccaggaaactggcagctgtaatatttatgatccgtttcttttttatttttaatttgttttaatttttaatgtttgtgggtacatagtaggtgtatattaatgatgaaagtgcgccattcctgtggcaaatgtttttgaatttttgatgcagacttgttttgaacatctgctttgtgctttatttgtactctttagaatcttttctttttgaataatatgaaaattgctataatggctgtggctaaactatgcatttttggtgtgatggacagttacaacttcttttaacacaggcttatttttaataggataacattgaatttgaaaatgtgtgcgtatatgtgtgtggctgttgaagttctgggagctcagatctgagagccagcaaatttagatgtattattttattcaatcattcattttattgagaagttacttgtgagtagcatttattgcactatttttatattcaaaatattactatttttagaaaaggtacttattttgaaaaatgttcacttttcctgctttttatactaacttttacatcaaaataccactgtgcaactaaatttgtgcccaattgaacaaatttttaaataaattagaactacaggccaaattgttacattagaaaacacttagaaattgttaccatttcttctattttgttgcttccagtaaatttccttcatggcacaatttacaaaaagtaataaatattgaacatgtatttaacattaaaaacaccgcttacatccatatacagttatggctcttaaaatgcagacttttgtattgtagcagtctatgagctgtctcttttgcaaaatatttttctttgtagtaacagctttatttcaatgttggctgactatatcttttattcagggactatttgctgaagtatttgcaactaggggcattttggatgtttaatgggaacaaggagaccttatatataattagaattattccataaggtctgagtgtgtgtatgcatgtgtgtatgcatgtgtgtatatgtaggtgtatgtgtatatatatacacatatatgtgtttgcgtttatatatgtgtgtgtgtgtatattatacacctgtgtgtgtgtgtgtgtgtgtgtgtgtgtgtgtgtgtgtgtgtgtaaagagatattttctttgaattgagcaaaacacacatctcccttttcttcattagggcacaagattttttcctattcctttaactattctgttctgataccataaaagccattcacaataggttgtaggtggctgtaatttataatcatttcagtagtaaaattcatcatccctgggattattccctctcttgtcacacgttaattcctggctccagattgtctttgctgtgacttcatctgtaaagatttgcttcccttttcaatgtccgccttttgctttctggagatataacctttgtttctcaagatctgaatgcatggaatatgaaactttccccaactccaccagcacaagtgacctctttctctcaaccctgcagttgtttatccattaaaattaccaattaaatttccttttatacatgtcttgtctcccactaattggtagccgctgaggtctgagacagcacagcccatattctttaacttgaccctgaggagatgccggtctagcttttatttaggttagggttggcatctgaggaactgtgttcctattgcatgctgcagtcatgagctaacagaacgcttaaatcaaaagctgtcaacctaacatgaagaggcatccacagagctgtctctgagaagctttattctttgactcacatctccaatgtgagtaatgtggttgaaacctagcaaagtcaaaatttacttgaagtgatatggtggatccggtgctgtagatgatgattgtagacctgaaaaaaagaagttacgcgaataacatctgcttttctgtgtgatattttcccccccagctgtttagagaattagaaattgctctgtcaagggtttgtttacaaaagcctggccaatttcaaaatgaagctgcctttgagttgtccctgtttcatctcactgtttggaaaataaatctgaaccattaagatgtaaatacatcaagttagaagccaaaggcagtgaaaaccaagtaaaagcaagaaatgtaccacgatttaagtattctcctgggaggaaaaatatacatggtaataatttttgtatcttataattttattattaaattaaggggagagaaatttgaaatcagcataatatctattttgtgtagtatttaacactgtgatgtatattgacaattgataatgaatcaaaatatgtgcgggtaactgtatgttcattaaattagagtttggtaatgagatagaaagagagaatgagaggggtacaggtgtaagcagcagttctcaaagtgtaatcccggaaccatcagcagctgcatcaccctgaaacattagaaatgcaaattctcaggccctgttgaagacctactgaatcagaaactctggggatggggcccagtaatctgtgttttaacaagccctccagaggattctgatgcatactccagtttaagaagcacttctatgtagatggatggatggttggatggctggcaagatatgtgggtacaatgacacatacatatgtaagtacaagtataggtatgggtataaatacaaatatgaatacaaatacagatataaatacagatattttgagagagagatatatagatagacatagatatagatatagatatagatatagaaatgtggagttaccatcacaggacttttttagaggagcaaattatttccttttacttattatatgattgaataaaagctgttcttttctctaggcaatgggtctatcatttataaactgagaaaatctactggtggtccatttgttgaaccattttccattaggttcacttaaagtgtttgttccatcaagtctgccacctgggtggtttccttcactgcaaaactggtttgctcttccctcccctctgtcttcttggcagctgctgtctgccctggttcttatccattggtagatctgattgctttggggactggatcaacagttgaatcctcacaggattttgaagccaacaatatcctacatattggtccatttttcagaatttcttcatttgtgttttatccttccatttttctttctaagcatatataatttatttagattggtgcagaagtaattgcggttttgccatggaaagtaatggcaaaaaccgtaattacttttgtaccaacctaataatttcagccaactattcatatgcagcactgtttacaatggggatgaataagtaacagctaaatatctgataaaaggggatgttttaaatatagtagattgcaaaataatatgatactttttgagaagaaaatttcaatatgcaaaaaatataggggataatattcattaagacataatcaatgattgttggattatggatgattttaattttactcattttgcttatttttatatttatgattacattagttgtaagctcaaattgctgttataagcaaagataatgcagatttatatgtatatatataaaacagtaaaataaattgattgtattttttatcttcttcctttccccactatgctatgaacttaaagtccagcaattatgccagctgtatctattcatcatttttcacattaaaagcaatattgctggatagtagaattaaatgacaactctgcttttggaaatgacaggaagtctgctgtaaatagataattgatgtagacgttaaagccaaatagaatttccatttatggagaagggaatatttaagggtatgtggctataagaaaatatttccttttgcttttaacacaagatgtaacatgacttgtcatgctcaggatgtgttttgaagtggataatggcactttccctaatatttggaggcaccgggcttgatcctcttttgaaggccttcctttgaagataaacatagacattggttttagcttaattctccatccctaaaattccttcctgctctaaaattctataattccataacaacagtgtataagcaataattatgaaatggaaaaatgagccattctacttgccatccttcatgtaaagctgtactatggaatcctgctctaaggtggggccggtgtcatttctccaagcagtatgatgccctggaagaaagcaatgtacagtggcctgtgattctggaccttggatcactttgatgcccttggcttataataaaagcaaaatccatttaaaccaccttaaataattaggaattttagaggctcatgtcaccaaaatccataagtatgtagggtttcatccagtgacttgacctttttcctgcagtgctcttcattttatgtccctctaagtgtcacctctaggctgatagcaacagaacctgtggcagtttggggataaatatgacgatgtctaagctagtgtttctcaactgtgggtgaccaccccaggagacatctggcaaagtcgggaaacatttttggttgtcacaagtggagaggtgctactggcatcaagtgagtaaaagccagggatgcttctaaacatcttcggtgtgcaggacagccccaccagagagaatgatccaacccaaaatgtcaatagtgctgagtaactctggcatagaagaagaaaggtttcctctgcctataactcacttacattctaggaaacatttccaaaggcttccagccacatttccctcacatgctggtgcctatagtacaaaaggctttaggcctgggttctgagatcaatcgtgggtggggaacagtattaccaagatcagctcactgagccccaaaatgcatgtggcatgtccatgctatacactgtcaaccagaacaataaatacccgtcatataatagtactattttgttattagcaagagaggggaattcaggcatcattactattcagccctaaaaaagaagaaattcctgttatttgcaacaacatggatgaatctggaggacactgtgttcaatgaaataagccaggcacagaaagcaaagacaaatgctgcactttctcacttacatgtggaatctaaaaaagttgaactcatagatgcagagactaaaatggtgctttccagaacctgggggtggggctgagggttggagagatgttggtcaaaggatgcaatattttacttagacaaaaggaataaattcaagagatctattgtacaacatggttactataattaacagcaatgtattttattttgaaaatcactaacagagtagattttaagtattctcaccacaaaaagtgacagctatgtaggtaatgcatatgttaattggcttaatgaagacatttcacaattgtatatgtatgtcaggacatcatcttgtacacaataaatatgtacaatttttatttgttaattttttaaaaatcctgtgaactgctaaagaataaacatactctccaaacctttctgtgggatttggggaagtgtttcttcacctgtatttttttctgggttatctgcattaatatctttctagaaaaggatatgactggaagtggcttattgacaatctggattttcccaagagaaattaccttcaaccaggagagatgactactttaaagaagggctttgcagaacctatgtctttactgagtcattcagcaatccaagtgagagatgatgatagcttggaccaagatggaaccattgaaattatgagaagaggtcagattctgacatattttgaaggtacagccaacaagatttactgacagattgactatggattgtgaaatggacccattggtgatagagagtggaagttttggcctgatctactggaaaaattgagttgctattgacttagatggggaacactatagagaagaatattgagaagaagttgaagaactcagggaattcaagaaaaaaatgtcctagttggagatataaactaggtaactatcagtgcatagatgtcatttaaagatacaaggttggttaaaatcaccaaagaggaattgcagatgaaaaataaaggagattcaagaacagagccatggtgaattccaacattatgttacattcagagaggtgatagacactcaaaagagtgtggcatccacaaagcttattctcacatttgttaattgacgtcaaaaacatggctggttgttttgtttttgtttttaacttaagctctttcaaattctggaatttgggtatctttccctaaaagagaaaaaacagccttcgtcttttgagcaagccaggaagcctcttcctgccgtcaattattaattttcttaacatccacttatcatctaaaacaggggttcccgacccccgggccgcagaccagtaccagtccatggcctattaagaatgggactgcacagcaggagtgagcattactgcctgtgctccgccgcccgtcagatcagtggtggcattcattagagtctcataagagcgctaactctattgtgaactgcgcaggtgagggatcttggttgcaagctccttatgagaatctaactaatgcctgattatctgaagtggaacagtttcatgctgaaaccatccccgccgcactgtctgtggaaaagttgtcttccacaaaaccggtccctggtgccaaaaatggctggggtcagctagtctaaaacatagcgaagctatgggctaaggaacttaccttgcttttgtttttccatctgggcaaatggttcatcctgcccctccagggtgagaaatgcctgtccctttctctcaatctgtatatgcaggctaacaaaagatatttttcagagatgatttatttcaccagaacgattattgataatttgcatttatggacacttggtgatcttatcaatatttttatgttttctcttttttagcttttaagttcaagggtacatgtgcaggtttgttacatggataaacttgtatcatggggttttgttgtacagattatttcctcacccgggtattaatcctagtacccattagttatttttcctgttcctctccctcctcccaccctctaccttctgagaggtccccagtgtgtgttgttcccctccatgtgtccatgtgttctcatcatttagctcccacttataagtgagaacatgcagtatttagttttctgttcctgtgttagtttgctaaggatatataccatggaatagcatgcagccataaaaaagaatgagatcatatcttttgcagggacatggatggaggtggaggccattatccttagcaaaatgttttccctttttgtgggacattatcttgaatttctcagaaatcaaccacaaatttaaagagtgaacactggatatctattgcaaatttttctaaaataacatacataaatctagctatgagaaaaacagctttcaatttttattttgcataagagtttcttggaaagtttcttaaaatgcagattccttgacatcagaagttctgttatgatcaatttgggactggactccagctggtccatttcatccatcccacaccattatctgattacagggcagaggatccacaagctgttcaggagctcatataaatttctgcaagctgaaaaggaaattattgactcccaaagtaatgatgtaaatactcacctatatatctaaaaacatagcaagtgccaatttcattgtcaactagtatttttaacaatctcatcacatgtaaaaacaattcgtaatgtacattttgttctcttaacaagtattcctgaacacgcacaataattacttaaaaaatcacagccaaacgagaatccgatgaattacttattgccaaatcatgtcaaaatcaaaattgtaaaaattcttgataatacaaggagatgaacctcaaaagtaagtgcttaaaatagctcagagctcctggaactcacttttaacaaaaagtaaccccaggtgattctgtatttgatcttttgcccacacttggagaatctaaggtctgtgtggggatgcttcatatcatcaaagcgtacttgtcttccttcaatcatttatcaaaattcttagcacctaaacctagcatcttagcatgatgctagattataaaaatacagtgataaacaatctttctaattgtgaagcctccagcccagtaagagagacagccaatagacaaatgcacaaacaagtaaaatcaattataggttgagataagtgctaagaagaaaatcaacagtgtgttgagatcaagaagccaggaaacattaatatcagattggggaagtcaaggaaggctttttgagcagatgatatttaagcagagaccagaaaaaggaggagccagccctgtgactgacgccttaggaaagcagttcaagcaaaggaaacagcatagacagaaacccctaatcaggacccagcttgccttgtccatgagtgtttgaagaacaggaggaaagagaggaggcatgaaaggtgaggctaaggaagttggtccagaccctttgacataggcaagttctatgtggatggattttattctaagtgcaatggaagcccgttgatgatctttgcttgcttgtttgttgttatttttttaaggttggatatggtgtggtactttgtgtagcagttgaacacataactcgagccagactgcccaggcaggaattctggctttgcctcttataggcagagtaaagttgagcatgttctaacctctcttcactcacttcctcattgtaaaatggaagtaataacagtacctacctcttaaggttgtttagcagatttaataaatatgtgatatgctctatgtatgtctcaaaatgaagaattgtctttaagaagattactgttatttcccccatgaacaaattgagtaaggacaagagcagatggctaggttgtctggaaggctgctaaatttgtttgggagaaatgtgatgggggctggaattggagtgatgaaagtaaagatggagaggaggggtcagattcctgatttattttggatgcagagttgacagaagttggtaatagattaaaagtagaacatgcagtgaagaggagaataaagaaaatgacttagttcctggctcaactaactgggtggataaaaataatcattatttaataataataataatcatcatcatcatccacaacaacactgattaagcgagtgctgcataccaggcaggcattgtgataaatgctttgtaaacacctctaaagatgtgggaggctaggataccaaaacatttgccagaagagaaagtcaagagttcattagtggataagggaagtttgagatgaccctgagacaccaggtagaagggtcaagaaggcagctggatagtcagctccataaacacaaagatgattggtttggagatagtatttgagagtcctgaactttgcaatgggatttaccaccatgtttttttgtataatggcttgggctgttacgataatatttttgtcttttttggtctaattctttttagttcaagacctgctttgtaaaaaccttagtgtcaatcaaattttcagtcagttctccatagtgtaaaataaagtattgcattaacatttctgactctgaaacaactctactgaactaaactacttaatctgaagtttgtgttgtgtgtgtctgaaacatttcctcatcaaaattcaaagaaactttagttcaagttatggcctgaaatcaacagaattatattaattcatatggatatagaaaatcatttatttacagtatttaaattgacatttaaacagtttttccaatcccacacagttagtggcataaggtcttgagaaagcatgaaacattttttttttatcagcctcatatttcgttgagcttgccaaacacagttcattttccatagaaatttgcaaacctgagtagtggccaaattttcagagtcgctgaatgtaagccaatgaataaaattgttaaaccctttgatttccccccacttttttcccttaaaaagtaacatagcgtgtgcctgagttttattttttgacatctattacccacaacactcgagtgtgtttcagaatcagcctgtatggacatttcagtacaaaatgaacacagccggcgctttggggaacgttcatttgcagctttgttatccttagacaggaagccttctcctccacactttgatcgacatttttcagaaggcaatggcatcaacctttaaaaatggatactttcaagggtttaaaggttgagatttttaagacaaacccagaataggcaaaagttacatattggccaaaaatgtgactccagaaaccatgtgttgtagctaactggggccactagcaaatctttcttttgagacttctgtcctgttagcagaatgcactgatcgaactaaaccttgagcatgacacaggatagaactagttattgttaagaaaataatgttcaagggcattggtccattgtacccaggaatagtttggaaagatgaaggatatggaaacaaacaagcaaaaaaagaagaattaaaattaataattaaaatgtcagtaactgtaatgtatttctcttagtggatgataaaattacataagaatgtcgaccttttctttaacccaatgaccatagtggcagtctcttcattggactgcttccttcattggcatcgccttctaatttcatttttacttatgatagtgaaaatgcacaatggcccctggaggcaataccctaatttttttgtttaagtgctcaaaaaagtatatcctttccctgcgaaaaaggcagagggtcacaattaattactgaatttcagctatgaaaaacccactgaactgtgagagtccattgtgcttaagttgcatttaatctctttggagatgccaactacctgatatacaagagcaactgtaagttccaaaaaaactctcacagataggaaccatagacatggagagaagggagccactactcagaaatgaaggagttggggaggagtggggctgaaccatgaagccagaacagaatttttgtcagtggcctagaagcaaagctgagaagaagggtctgaatgtgctggggaccagtggttgtagctccacactgagatggaagcctcctctcactgtagcttctgccaaaacacataggtaaatttgcaggagtaatggtgacctcggaagagcctggtgtaattggggaatgattgttgcaagggaataagagccagtatttcatttggtcttttgtgtctggcatttttcactcagtataatgtccccagggttcatccatgttgtagtatttatcagtacttcatccctttttgtggctgaataatattctattgtagggatatgacacattttgtttattccttcatctgttgatggattatttgggttgttttgactgtttgactattaagaataatgctgttaggaacattcatatgcaagtttttgtgcagacttacatgtttttcatgtccatatttcttgggtatatacctaaaagttgaattgctgagtataatggcaaatgtatgtttaacatttggagacacattctcaccagcactatgtaagggttccacatccttaccaacagtttttttttttttttaaagctatcctagtgggcgtgatgtgataattttttttttttttttttttgagatagagtctcactctgtcacttaggttggaatgcagtggcacaatcacagttcacttcagcctcgacctccctgggctcaggtgatcctcccacttcagcctcccaagtagctggaactatgggcacgcaccaccacaccaggctgttttttattttattttaatttttgtacagacgaggttttgccatgttgctcaggttgatctcgaactcctgagctcaagtgatccgcccaccttggcctctcaaaatgctgggattaccggcatgagcctcactgtgattttgatttgcatttccctgatggctaatgatatcaagcatcttttcatatgcttatcagccatttgtatatcttcttcagagaaatatttattcagattttttttcttatttttcaattaggttgtctttttattattgaattgtaagagttcttcagattctggatacaaatctctcatcagatatgtgagtgagcatttttttcaaatgattttttccctccagcaatcatactgcatttctaccatctactgtaaactgccatatgtctacctcatttatctcaactttttaactttttaacttttacacttttcttcctagtgggtgcttgggggctttcagccttctgtgcctggggaggactttcagaactaagagctccccagggtgtctgactcagaggatcacagtgacccaaggctctctccctccgagatcctctagttgtgcattccagacagggagactgcctggccggctcctctagcactttgagcagtgtccctccctgcctcctgtctccttctctgttcccacactgcacaggggctctgcgtggggagtatgggggctcgctactgcctggagctgctgctattgctgaggtgtaagaaccctggagaggtaagaagatacggtgtgtgtatttcaggctctgtgtttcgtgcctactgctagaagcaaggtaggacccaagccaggaagacgtgaaagattccatggggtaataatcccagagcagcatctggaaaaggtgaacataagtaggaaagaaggagggaagtaatagcgttggagggatttgctcaatgtgtcctggcgcttgagtctcttttaacatcaaagctcaggtggttcaaatgacagtcacactgcctctgcctgttgctttaagagtaaattcagagtcttcaaaccaggcttattggaatattacataccattgccaagacgtgtatatttttattgaaagttcagagcaaatcatagtaaggacccaccatttcttctgcaccattccttttggctattttctcagtatttgaaaatcaatggaatttgactttaacatgcacattggcttataatgttactgttgcatgggtcttaatgttactgttccagtccagtgtttttgtgctagaggtaaggaaactgaagttcagagtgaatcaggcattgccaggatcaccagactaatccaggatgagccaaaacatcattgctatggagtgtctctttgggtctcaatcattgggtactatataatgactgacgactggggacaagggcataggttgcccttttccttagtatgatgaaggatcaagattctataacatcgataactgattagggtactaatgtggaaccacaaaatgtggttcagctctgtcctgtggccactccatgcagcaaagacagatggctggttcagaaaactttggttttgttgtttgcatacaataaaggtagcatctggtgcaaattttattttttttaatgattccagggttttttctttaatgatttcatagaaagaaccttaaaactcatcttttcagaatattaatttagattgttaccgaagtgttcacagagcctaattaaatacttgctggtttcatatagctacaagtaaaagctgctttgaatccttcctaaacttatattggtttatttggtgaattgtgtgttaacaccaagaaagtgaaatcattggcttttctacagattggtgatctattaccttaaacaatatgatcaggccacatcaattcatttgcaaatttcttcctctctctatcatgtgcacatgccaccataggtataaagtaattaaaatatatacgaattatttagtttgttaaaagccaagttgcttttgaagaaaatttgctgctcttagattatgattatttacagtttgttaagtgatttcattttgtaggcatagactttttattgtgattctgattatttacagtaatagcaactatcaaatcaactaatgtggtggtgattgcagatttttggatatctattactgtttatcgggaacattttttcactaccagaacggggaaaaaaaagccacaaaagcagtaaatcccattgctttccaagtgtcattgtaaatcctgctgataagaactgcacattttagcaatgtttaataagtactttaaaaattgagaattgtctcaaaagaaacagattttgaagttcctctgttgtacctacttccagattaagaaaaatcatttgtggaaaacaagttgatcccaagttcctaatcacagggagaagatgggattttgtaaacctgcagagcctgaatttgttattgcatgcagctgtgcaaatttgcaaacatttccttccctagtcaggaccctatggaaggagccagtttggactgctgccttgatagctaacatttgtagaggctgcagtgcaggaagctattggggtacctgaactttgtcatctattttaatctgggcattagatgccaggtagagagagtatgcaagccaattagttctgcttcaatgtcatggtagggatatatcagtagccttattattcttgtcattctcggtgaatttcagaatgctgcttgaaatgggctttctgtatgcgttgagtgtgtgttcagtgggctgtctgggaaggaagatagcggagggccaaggcctgggtctcctaaaacacatgattatttcattgaactaatcagtgagagaaagacagggccttgtggtttctacgagcactggacttgcgtttctttgttttccatccatcctttggaaccagagaaggcatgaggaccatccatgagcaggttcacactcaaagctggttgcccttaccctggttgccatggcaatgttgtcctagcgtaggggatacttgcctatgtttgtagctgtctcctccccatctttggcagtttagcacaagaggcaactccctcatgcaactacagagcatttaatgagttagggattcttcattttgagttacagttagctctctagtatatttttgggaggacaaatgggcaggaaaaattaagtcacaggagacaagcttcatgactctaatggagttgaatttacatttgccattaaaaatagctatagattgtttaattagaatcctagaggcggatgacgaattagtttatctttcaaatggtactcataaaaaatggggcagtgtgtgtgtgttttaaaagagcctaacttcttgttaaaatttaaagttcaaaccctcatttgtaaattggtgatagagacaattctataacgttgtgagaattaaatgagctaatacatgtcatgtgcttagaatagtgcctgaaatataataagcccagtaaatgttcagtgttattattatcattacttttatatgacagcatcctgggtgtttaatgctaatgatggctcattgagcagatattaagcatactgaccagtttccaggtatttttccaaatctgcctcaaggagcttgacagctaagggggagacaaaagtagaaagaagcagttgtttgaaatagaggcatggtcaacatatcctgggaaacctctgagcctgtgcactccagccctgtggactagcgagagaggtttctagaagaggtgacattgaggtgttggtcattgatggctgctcccagatgtgtggatatgggggcaaggagacaggggaacctcacttccaggagtgccagccaacgtagagcagtgagagaagatttctagaagaggtggcattgaggtgagggtcactgatggctgctcccggatgtttgggatacagcagcaaggaggcagggagatcctcacttcagaagtgccttgagttggttatttggacagatagggtgttcgatggcctgggtctgtcagatattctcagctgcccaaggtcagtgcttaatcatcttctctccttacaatacactgctttatattctccatggctgtaggggttttattctgtaacaattttgtaacaaaaacttcttaatcaaaagaatcattcttttggagagtggtggttctgaaaatcatgagaattaaggcatcttaaattactgcccactttatggacagaaccactcatttctcattattctgccagatccaagcaaatctcagaacagaacttatcccagactaattgaataaccttgaattcagtagttacactcatggctaaatttattattttctcctctttatcactcgggtagacacaatcactttcagaggttcttcagtctgatttacaattagctccttagcacatctttggaaggtcaaacaagcaggaacaattaactcacaggagacaagcttcttgtaacctcccaagaaacaaatactcacttctaagtaagttctgaagaagcaaataactattctaacttctgtcggacggtttttaaaaattttgttttaatttactttttttattttatagatttagagggtggacatgctttcttacatggatatattgtgtagtggtgaaatctgggcttttaacaggatagttttgatttagagacattagctgacttaatcacgggacagcactttctttattttgcaaattctccttaacacccctaccactccccaagctgttttgatttgtttagatccctgttgtgactccagacattgccaaaggtcccctaggagacacaactgtacctgcttaagaaccactcatctagaggaaaacggtttggtaaaggccgggtgcagtggctcgcgcctgtgatcccagcactttgggtggctgaggcaggcagatcaggaggtcaggagattgagcaatcctggccaacatggtaaaaccctgtctctactaaaatacaaaaaaaattagccaggcatggtggtgcctggctgtagtcccagctactcaggaggctgaggcaggggaatcgcttgaatttgggaggtggtgattgcagtgaaccgagattgagccactgcactccagcctggcgacagagcgagactccatctcaaaaaaaaaaaaaaaaaaaaaaaaaaaagtaaaagaaagaaaaatgaaatccttataatgtggaattagctgaattgtgccaatgccagagtgacaagggaagggtctgagttgggagtcactgtacacaaaggctcagccctagaaagaaggtaaaaggaagacatgcagagagaggtggtctcaagttctagcctccacttagtggagcgcccccatgacacttgcctggtgttgctctcctgttaccctcagagtggtgaattgaggatgaaggcttgtcttggaggcagcaaagaacagtgtctggggatatcaggtaggagaaggcaaagatcatttagggtcacaatcagtaagggaggtgttcaggtggctacactgtcagagtgatgcactgataaatgacagacatgggccgggcatggtggctcacacctgtaatcctagcactttgggaggctgaggtgggcagatcacttgaggtcaggagttcaagaccagcctggccaacatggtgaaaccccgtttctactaaaaatacaaaaattagctgggtgtggtggctcactcttgtaatcccctctacttgggaggctgaggctggaggatcacttgaacccaggaggcggaagttgcagtgagccaagatcatgccactgcactccagcctgggtgacagagcaagactctgtctcaaaaaaaaaaagacaaacgtgatgtacttcagtgcctgtggcatcaaaaacttccatgtcatatcctaattttgtatcactcctgcttccaactgggtagtgttctctttgggagtctacagaggcaggacaaagctctctttctgattacaagaactgtagctaacatttattgagcttggggctcattaacatgaaaagactcagagcagagcatgatattagtacattttatagacgagtgtactgagccatagagaggccaaaaaaattgtccaagtttccacagcagataggcaatggtcatgattgtgaatcaaacggtttggttatggaggctgcaccccctaccatcacactggaaagccggctttgtgcttctgtggacacttaactgacacccccagagcctgcacattccatggccaaatatgaagcatggaaaattatttggagaggcaaacaaaatttggctgtttggaggaattgagattttaatatcgttcatttttaaaattaatagtaaagtgaattctgggtcctgtggtgttttttgttgaccataggacaatgatatttgcaaatgggctttattaatttagattttgtgatagaggattcaagtgtgatttattgaggtaaatgtttcgaacccaaatgaccactcctttcttctctcttcaaatcctcaccactcccagcccaatcttattcctcaataattatttatcgtctggaagagtcaggtgtttcaaatgaggccagcatggacttttcccaacagggaggtattttttaatatctaaatgtcggcctatggcccttgctgttaaggctccagatcaaataggggcaaaaggaattgaaagccaaatcacaaaaataagtaaaaactccaactaacaagaatttcacaacagacataagctgatgactattttattaaagcaatgtggagtactactaaatgctactatgttctggaaatgtaggaaattggttgaagtcgtttttctcttgttagtctcatgttaagctgttcatactaggatctcttgggttattttttcccaattaatacagttgtctactaatttattttctttttaaaagtcttggccttaaactcagtcttggtattttcagctattgtttactaccaaaggaaaaacttcggatttagagaaaagtctgtatttttattttgtgtggagttgagaaaggggatggtaaacttgacattgcttggaaatgaaatgcacagcttgatctttttttcttgatatgatttttgtattggaagaactgtagtatgtcttggtggtgataatgaataccataaccacataatcattctctaaatgattgtaatggaaagaagttttatttaaaatttcaagttactcaaatggcacatgtctccacatgtgtctttttactacaggtaaacccagaaagcatgcgtggttatgggtgtgtgagtgtgtgtaacgtgaatgtgtgcctccctctatgttatgttgcactattagtttgaaccacaaaatagaaaagaatgtaaatatcttctgaactctggatttatctgttctaaatgaaagctagaggggaaaccattttagtatgtaaagtttggcctgaggaagagaatggcacttctacagttcttagaaaattctcatagaggatcaggattactggcatgcttggggaacaacttgctgtgggtagctgagattttcagtttcaaccagcaaatctgttttgtttcatcttttgtttaaaatatttgaattaataagaattatttttcaacttcaagaagtagtacatagagcaatgctgtctgataaaactgaatggtgatggaaatattctgtatctgtgttgtccagaatggtagccactagccccatgtggctatttagcgcttaaaatgtgtctactatgacggaggaattgaattttaagttttatttaattttaatttatttacatttaaatagccacataggacaggactaccatatttgacagtgcaagtattagagtataattaccagttaatgtatgtctctggtttgaaacattcctctgtattatcacactacgtatctgaattttgatttggaaaccgtggctgaatgctgggattgattccagctctgccaacaggaaaggagtggtgaggaaagctgttggacagctagccaaggatatttgccatatttgccagagtgttttgactgtacttctgtcatagtattaataccatttggcctttttaattgttatttgtgggcttattttacccctttggtagattctagattccttaaggatggggccttgctcttttcaccagcacatggaatagtgccttgccctagagtgtgcttaataaatattgactcaattgattagaattggtccatgccaattgattaaaagcttttctacctttaaaaaattgaatctaaattctttaaaatcaagttatttgtttgaatattgacaccctcccaataaagttatgtttattcattccagaaaatgattaaggggccttaatcataaaggtactggaataaagttaccatgggtttgtgtaatataaaccctgcaaagactgtttacaattctgtgtgggtgtaggaagaaaaaaggattcaaatataaatatgagtgagaaagaaaacttgttttgagtccattttatgcatttgttaacattttgaagactatacagtacaatttatcttaaagttatgaggtgaaagaaatgacttgtgtttaaaatcactgcaattctctatttgaagctccattgataacattttttgaggaaaacaaattacttgaataactttaaattcagtacattattatgcatatcacataatttcatttaaaaatcttttttccatagaatgagatcaaaagaccagattttgattgccagtgtggtgtgaagtgtaaagccagtgttccatgtcctattttgtttcataatataaacattcttcaaaagtttatctttcttaatgtaaagaatttttcatataaacttcccttcatttggttcaggttttagttattgtacatattcataaattttcattttatcaactgttttaactgatgtataaactttgttttttaaaaaagatttgagacagtataatttaaattttctctaaaaagaaatatattccttatttgcttgccaaatggtgaatttgtatgactaaatgagcagttcctacctgattcaagaatactcattcataatatatcatctcaaatgataggaaaatttaagtttcattcaacacaaagacatgaatgatttttaatgcattttattgtctgctaatggtacttttttagttacagaatttgctaagtaaagtgattataagcaaaaatcattgtgttcttgtgtcactcctgaaagcatctgaagtattcattcccctctcatcttctgatcttttaatcctgaaaaaaattgcaaaagaacagttaaaataatttacaaatgttcctagtgagtaccatttacaataacatgtctggcttcagttttgtcaaaacaatgtacaaccatttaagttgaactctataatttctgaagtttctttgttatttcgttgtcattagatattaggtgtccatgaggactgcttccaccttcaggacacttaaagcctattattttataataaaataacaattgctacctttttggggggtacgtcttgcatgtcaggctccaagcttatcacgctattttgttttccataaaacaactctaagaaactatcaatgtttatactcaaattttacacaaaaagaaactgagttttaaagagttcaaactatctgcccaaagtcacctttccataaatagctttgtcaagatgtgagcacattataaagttcatggtattaattattcataaagaagtaaatgcattttctatgtacagagagaacatgtgccttggactagaatagccaatgataggcaccgattacttgggattcaatcaattttcaaaaaattctgccccatattttccgtaaacatgctcacaattatgaagccatttatgacatatattatgatttttttaaattcagaaactatggtatttataattggacagagacttgaaaataatctgatttcgtcattttcccccatttaaaagaaaataaaacaccgatacatttgaagtaacttttacaatactgcctcgtctttgagggcaaagccagaattggaacctttgtgtcctggcttcttatcctggtcatttccacctcacttctctcttcttctcagtagcaaatcatcaataacatgtataaattggaattacagttggatacatatacatgataggatcacataatctcgtatacatagaagtaagactttatggatgtagattaagtttgttttgttgactattcccattcatttgtaagagctacctgtaatggaagatttagtgctaaattgcagtaacttcttgctaaaagcttaatcatctatagaaccccagtacagaaaaggaatctaacagtatgtttagtttagccgcctccaagttagattgaaaactactggaaatggggaatcttcctgtaggtttttgaagagatttcccgtctaccttttgtagcctgttcagatatttgcactctcaaaattatccgctccctcttgtcttaagccttcagtgcaactctagcctattcttgctagtcaaacctttgaaatataaggagaactgatattcccttatactgttgcccttaaaattcatggggtttagtaatatatatttctattaatgggttttggtaatacatattctggtagaaattcagtaatagtaaaattgaaacctaccataaaaactgtggtcttaattaccaagccatttagaggaatttgtctttaacataaaggtatagcatattgcttggactaatagaatcatagacctgtaactactacaactctagatccttggttgtcggagaccttagaactctggggcctattttgctgcaccattttcacaggatttgcattgtagtggcttcaaaatatactcaccacttcctcccgcttggtcttgtctgttgatggccaagcttccagagtcagatcaggaagcatgggaggcaggggctgcatggggaacatcggaggcagaggtggctgtggcggcaggggctgcatggggtgcacaggtggctggggctgcatgggctggtgaggctgtggctgaacaggctggggctggtagggctgctgggcgggcggagggaggtttggctggtggtgttggattggagtcatggagtgttggccaggaacgggcatcattggttgctgggggatcacgggctgctgagctggcaccactgggatgtggtgatgaggctgcagggtgtgagtcggggggtgctgttgggacagcacggggatgatttggtggtgcagccatccacccatgggctcgtaaccataggaagggtactggtgagaaacagagaggcaggtttaccattggctcaggtgactccaaccagagaagcagcagtgttttctttgccattatggctataggaatattttattcatttttcctttgcaaaaatttgtaactgtgtacacagatatgattttttacaaactaaatttcccattaatgtctgcatgtggagtagacatgatatttcacttaatatgggaattttaatgcatgcctaatattttcagggaataaggaacaaaatgtctacataccggtggccttatgctctggtaccacttcaaaggggtaagcaccttaagagaaaaagatattagaacccatttgatttaatttactttcatccaatatagaaactcactgatgcagtaggaaatatagactcactaatgcagtcctgtcaacattgatagcctgagaatgtgagttctacaaaagaaagaagaaggtaaaaatttgttgggtgcttcctgtgtgacaggcactgtgtttacatccatcacacacattcttcatcttttcttatatgctaggaggcaagtattattactctcactttttagataaggttatggggagttaaagagattcattaacttgactgaggttacacagggagtaaatctgtttaattccatagttccttcttttcattgtaagagcaaaacaaacacaaaattatgacataataatatgacatgatgttaatttcatttttttctttgatgtcacaatgggaaaaagagaggtgcaaacactgtccctcatcctagaaacacagattgactgatcagatgtgtcaatcttttcggttcaacagaaaatcttgcctcaaaatcttactaacatttgtcttcagcttttataagtaaataaactcatagattgttacctgaacctgtgagagaagtaagaatcttattcctttctgaacagtatatatacttggttagccttaggtttgaggattcttcatatagtaatacggcatttaatcgatacaaaaaataatcagtaaccttgctcatattatacttgacaaagcacttttcatattcattaactatattactctccaaacaatattttgaaatatggttattataattatttcctttctccagatgaggaaaccagggttccagaaagaggaaatgatttgcccaaaatcacaaagttagtaagaggttgaggagaacctcaaacccgacgtccaaaactcatgcattccgctgttctgcggagtctctcctataccacttagtcactaatatttcagcagaggcaagcaagagacacacatagagtgtgactatcttagaatcaggagttttttgagctggaaagagttttaaataacatcttacctaatccttacattttactagctgggttagaaccaagctggtcagagtttactttttgccctatcatggagcctccctgagtagtggttcatgatgggtaagcttacggccatatttaggaggacagactgagtcagagtggccaggcgggaggctgctgggacgacacaggcttgaggccaaccatcagagcttaaactgggaagctggtggtaggaactgtaaaatcaggaccacttgagaaacatctgggataaagaatcaacacactattctttacagagcccagggcattgttaacgcaaacaatggtcaaaattagtaaagagaaaaattacctcatagctgaagttgatataaccagggtgcccaggatgaggtggtagcttttacagggaggaggggaggagaatagaaagagagaggaagggagagagtgaaggaagagaagagagaggaagagattaagtcagtatgcaattgttcacattaaaggagactgaagctactttaaaaaaatctatatagtgcagaatatacttgaggtctgtttttagtttgaacaaatgtgctgtatagaagaggagaccttttattttaaagaggttcagaacagctaaatgactgttcctggggttatagccttatggctggagacctggaagcagaaaccagcacacatttattctccagtgatctttggacagcatcccacccccacgcccagtgttttcaatgaatcctaccctatcctgcccaacagtttacttgctgataaaactcaccccataatggggagagaagtgtgtttctctttcacaataaagaaatatcaacaaggagagaattgtctcacgaatgttcccttgtagatcaggaggtggtcaagtacttttaagtatcaaagggatttctcataattgacatgcaaagtaaacaacacttccatacaacaaaagaagccacaaaagaaaccacaaggtgggaattattgatgaatgccagaacaagatgggtggagcaaagtggaaacattataaatcccatggaaaatgaaagagttgatttatgacgtttaggccgatctttttttattattctgccaacggttttatggcagaaaaattttcaagttaaaaataaaaggccacctgaatgatgatctgaatcaggactgtctgtcctctcaaaagtggggcccaagtgtctggtgcctgtattgtggaactctggttgtgcctggggtccagggaggagagacggtcatgcagaaaatctccctcagacattggcctcatttaggattggctctattatattctttaaaaatgctcacatttcatgggaaggtttattctctctcatctggatgtgaatggttttagtcaggtcctataccctcttgaacaataccatcttagagagtgggaaaagggctgaatttgtaaggcagggacccctgaggaaactaggaatcgctgcaatgcaggatttcaggaagtcagagcacagaatcttggttttgtgggtgagagaggaagagaggaggcaagggtgcaagcttgctggcttctggttgtatcaactgctctttattccaccaaaaagcagatgcagcctgcttggcatgcatgtgatctaagttctctgcccttatgcacctgtgtccagacagagtgggtctaatgtcctgatctttaatacatttgaatataaaatatatcactatgtattgggtgtaggcaggatcccgggcaaccacaaaaaagtcacgtactcatcagatgtacccaaaggggtggggcctctgagaacaggaatgtggctcaaaaagtggattcctaacacaaaaatcttaccccctgaggggtaagagcagcaatatgtggagggcaggaagagatttggaatcttgagaggaattgggttttagacaaaactggcatctctgtaatatttgtccaaagctggttaagcactttctctggagacctttcaagggtcccttccaaaagcttcctccatctagagatgggtggtgatatttacaagctaacagttccaacagaatctcctggggtgcttataaaaatgcagagtcctgggccccgccccagctgtaccaaatcagaatttttggtagcggcatttgagaatatacctttttaaaacaagctcctgaagtgtttcttcaacccagagacatatgaagacatctgatctcatactgttttaaaccctaatttcaccaactatgagcagatttttatgtccaagtttgtgaaattggacactgacttatgcaaggggtgttttactcacaggcatggcaaaagctgctcccaggaggcaggcaaataaaatccaggtccccatttcttgatggttctgaaatgtaagtcaacatccacttttcttatctcttctgaaacatggatgtaatgaatgctccataaaacacacataatctacattagtctattgctagtaagaaggatggagccattgtttgtgaatttacttcagtcatatgtgatttccagctctcagcctatttcattgtttctggagtcacagtagtgataaagatgcatttaatttaggttgagggctaaacaagttacagggacatgaatgatctatcttcatatgactttgcatgccattttcctatgcctatacagcccttagtcatagaagctaaattgtatttataattaatgattaaaggaataaagttggctctaaaggttgggaagatcatcaaagtgcacagtattttataattttagaacaaggaggcacagaaatgtctcgtgcacagtctacctggacattgctactgttaaaaacaaggactaatcatttgagaaaatatattaatttgccaagatagattttagttccagaaattcctatctacagaacttcaggcaagaccctccagtaacatctctgagctccagattgtggagcaaaagatgtggctgaaccaacaggagaggatggtacgaattttatgtgattcttcaatgaattttgaatactttctccctaagaggtttcattttctttcaatggaatcttcattttgtttgatgttgcactgtaattattctataaataagacccttgggacattaagcaaaacaggtcctcctaaaatgtgcacattgatttgtggcacaaattactgggaaaactgtcagaagaaagaccttaaattttgtataagaagtgaatattacatgtgataatgctgtctatgaaaagtacactaaagttttctaactcctaaatttgttttttgtttgtttgtttgtttgggttaatgagaaaaaacacttcatggatggttctattttatgtaattaaataaaaagcttttcaaagtagtagatcacagcctgtgaatgtattatttttactttaatcgataattaattaaaataaatattttactgtgaaatgtggccaagaaagacctttggaattagacaagcactttgttgcattataaagttaaaaatcatttcagtaatcagagtctaatttaattatgggccaactaaaaagtaactattgatggcatatagtattagaaatgtagaatacatttatatcttttaaaagaaatgcagagaaagaaataagcacaataaaaaggatatcaaattataaataaaatccacatacctttgaatgtattcagtgcaagtttctgtttgaaactcagggatgcttgatcctttagatttcttccaactataagctcaatttatatcattcatggcatctgtaacaaccaatccagtttctaaaggaaaaatgtgttgagtataactaaaaatccctgtatcatgattttttagaagctatgatcagacataaggctgtatgttgtgattagtgcatatggaatctttcattatgggcaataataggtttaacaggcaaagagtttcatcacgctattttgaagtcagcaaattagttgactgtacatgttgatatattcagatttatttttaaaaagcttctctgccatcgccttttcctcagttctagcaaacaacgttgttctttacaaaaatcaaggtaggtggttgagattctctagtgtaatctggatatcctccaggatttttccagccctttcagatcaggagaaattgattcaaattcccatttgggtaaaaccccaaagctctctctagtttctctctgaggaattataattttgggatcaccactgctctattatctgcttccattgaaggtattttttctctgttccccttggctactcctttatcacccctctggtgtccaccaaaacaggggacaaagccccttctcggccccatgctgaaacccatctaccgtaaaaacaatcaggaacttaaggttcttgcagtagcaaagcttttactgatgatctatactacaaggcaaggagtgcacaccagacagcacattttaaagtaaattttgttttttacaagcaaactcatgtcacaggggatgttgtcctttgcctcccatctcacagagcagcttggcctctcagtatggcggcccttctttgcccatatccttctggcccaatcccactttctcatacaggcaaacccaaattcctctctatttttcagagtctcttaactgtctggctagctactttgtttccatgttctcagcagcctcccctttccctaagcaatgaccaaagctattcactttctaaaagaacctctgatcatctacctattaaattcatgtgtgttttacccctctaccttggtataacacatgggctttttctttcattctggaatttgattagattgatctaattgagcaaagttgtaattagtggcaggagctaactgacgagtcgtccatcaatattagatcaataaaggagatactgaatatctacccagatacagttgatgttatacttggatctctttgaatacacaagtaatacttataaagtttgtatatatacatatgtttatacgtatatatacaaattacttagcctgtctgagcctcaatttcctgatatgtagaatggaaataataacagaacctagctcagggaattcatgtgaaaagtagatgagtgacatctctggggaaatggaagtctatttattactctccccaaccctgtcagctggcatacagtaaatgtttaaagaatgctaataaacaagattccaagatgatctttggggataaatcagtagggatgaatattgcaaagaaaggtaagaccttccaatcagggagagagagattgcaaagaaggaagtagaagattataacaggtaaaatgtatgcatgaaaagaaacatagaatatgattctaaaagccaaatgtccccaggatttggctttatttatgaatatatttattggtgaattttatagcagagacaagaaggattccctttgaaggaagttggaaaatggaccttaggaggattggcaggggtgtacagcaaggtggtaagggagaggaaggaaaatgtggatcacattttattcactttcaatctttttcccccattttatataattacatatattggagtgtctgaaaggattcaggatattttttttttctacaaagttgtgggtaatctctactaatgaagtcaatgatgaattactagtagccttgtagttttagaaagattgatcttatactttttctcaccttctaagaatgagaggatgatatatttggccataatgatcaacaggatgctgccttaatgtggcattaattcctctggaccactggatagtgagttaccgctaattcaccatggacagttgaacaagctttgatggccgattccatagaaataattgattttcccctactgcatatcctgaatcataggacattaaaatatggatctctgtttgaaatctcttccactaatttaggccccacttacacagcttaaaaattggtaaatgttttgaggaaaatgaaatttcaattgaaatatttttcctataagcaattattttatttatgaataaattgactgcataaaatagttcttttgctcatttttttgtagtaggtattctttttcttgacttgcagcccagtacgttttgctgttctcacaatgcttatgttagcaacttccccacttctaatttgctgcttctaatttacagtatgctagaaaatcatatgcccaagcttgttaaaagtatgcgtgaactgaaagtaaaggaacactctaagtggggctggcctgggagggcctcgcctgtgagaaaagcaaatgaatttcggttttgtgacacttatttttgactgctgggagggtgtttggtttgttttggggttcctctccactggcttactgcctgggtttcaacagcactcggggtatgagggtggcctttggataagtcaggtattatgagtttgcaaagcctttcctatcatctgtaagagttcaactcttgagccttcttttaaagcatccccagggttatccaatattctggaataatttcaacagtgagtcttcttaagtagctggagccaaagctggcttttaaatattttctctgtagatgtttacttacaagaaaacatcattctctaggatagcttttttttttttttttttgctggggtagagttggagttgtatgatcttcagatcttaggcacaaaaccaccgatgaattccgatacacatcgtaactttgaccccaccgcaacccttagaaatcaggtattgtgtcttatactttcttgggagctccttggtacctagaaaaagctcttatacaaagtaggtgctagataaatgtgttgatgaattaatgaaaatgtagaaaagttttccatgacattgtaaacatagaaaatgtggattctgaaagaaatcctacagtgatttagatggaccttttcaatagctaagatggataattcagcattgctctcaactgctcctgtggacttctgtgcaaatgacctctgataagtatctgaaaagggagatgctgtaaaagcgctagaatctattatcctaacagtctcattacatttggctctgacctcttagttcaaattataatatactccaaacaaatacactatgatagataattttttgttgttgtttttgagacagagtctcgctctgtcgcccaggctggagtgaagtggtacagtctcggctcgctgcaatctctgcctcccgggtttaagtgactctcctgcctcagcctcccaagtagctgggattacaggcacatgccaccatgcccagcttatttttatatttttagtagagacggggtttcaccatgttgtccaggatggtctccatctcctgacctcatgatctgcctgcctcggcctcccaaagtgctgggattacaggcatgagccactgcgcctggcctatgaagtaacatttaaaacaaaatgtctaccaatagcggggctggttcaaatcgattatggcacaaatagcattcaagatgaggatgtcactctgcgtttgtcaacataaaaagatgttggtgatacattgttaagtggaaaaatagattttttaaagtccccttctctaatttttttctccctccctccctgctctcccttctctccatttggggagatattcgccaaaacacagtagttatctagggactccttgaaaatctctgggtagccgaggtttaaatttatttcttttaaataatctgtgaatgcaacaaatgcaggggaaatacgagaagtttggagtatgatatttctcactcatgttcagcaagagagatgagtaagtgatagtgctacttgcataggccctgggtatatccaatgttcattcttagggggaaaaaaggttcaacataaaatccaagacaaaaaaaaacacacgattttttaaagtgagagagcccttttaaatcatgagtaggaaatattttaataatataaacattcacagcaagagttcatacagcttgtaatttgaaaagtccgtaggcatttgctaaatatcaggtggaacaattttcaacaagggaaattatatgcagttgaagagtgtgttgtttggattataattaactggtaactgtcaggagtgaaaatggtacatctgtgttaaaagaggtaggacagtaatgtaaaaacaagcatttttattcctgtttattgggtaaaatataccaaagtaagttcaactttcctgctgaggttcagtggagacatacatagattagtagttttttaaaatattgttcagccataaaatggaatgaagcactgatccatacagcaacatggatgaaccttgaaaacattacattcagtgaaggaagccagtcataaaataccatatactgtatgactgtataggaaatgccaagaataggcaaaatccatagaaacagaaagtagattcatggttgccaggggttgagggaagggggaaatggggagttactgctaatgagccccaggtttctttttgtgatgatagaaatgttctggagttagacagtggtgatggttgcacaatcttgtgaatatactaaaagccactcaattgtacactttaaagtggtgaatcttatggtatgtgaattatatcttaatttttaaaaggacacatattatatatggtatgatatcggccctcaaaaaatgtacagcctttatacattatgtaaaatatagattaaaaggctaaacacggtgtaatggtacagaacaatagtgtaagtgttgccccacgatgataaagttgatgatgacgactatgatgaagatgaaactaacctttattgccagccatggttctaagcatttaacatgtttaaatgtttattggtcacctcccgcatgccgggtatattctgggtttatgttttacatcagtgattaaaacacacaaagactcctactcacagtctcacagaaagcaactatgaacaatggatataataaataaggacagcagaagagaaagcctatggaaaaggaaaaagtagagcagctaagaaggattagacgtgctgagttgcacgtttcaatagggtggtcagttttaaacaatttcttgaagaaggtgaggtgttcgcctgagcatctctgggatcagcacaaaggcaccagcatggaagtggcccagtgtgttagctagctggcaggaacccagcactgctggtgtggtgcaaggtggagggcataagaggagctgaaggccaaaaggtgacatcttctcatgcttccatgatcttagcaattaaatgtagaattccttgcctaaaataattctattgttcattgtgtgccaggggcttcaggctttggagatgtgaaggatttggatagacatagaggctatttcctcacagggctgagtcattggaagaaagagaaacgggaatgggcagagcatgcttggtgtgcagaaaaagaccagctaggcagcagcagaggttttaggtagaaaaagggcaatggcagatgggctgttgggaacagagagaccctgaatgttggacagggaaatccacttgtgtcccctctgcagtggcaaagcactgagcatttgtatccactgtccttgcttgctagggtttctacaagaaagttcgtctggaagctcagacttgtgtcaagaatgagaaggtagaaacacaaagcaatcagatgacttggctgtcttcacatcacattgagagtcagagcagacgcaagacccctgggctctggccctggctcagacactcttcacccacttgctcacagatgaatgaggcataccttggggccccagatcaaatgataacattataagaacaactggaaatagataagtctttaaaaatacagaacataatgtttttcctgtgaaatatagggttgcattcaaaaactgttaccagagaatattctccagagaaacctacagctattcaaaactgctctacaatataagctcttgtttagtaagaaataaaagctatttaatgaaaggtctataaaaacggatttaataacttaatacataattatatgctataaagttcatgtgttgaaagggtacacttgagtgggttttagtatatttttaatgtatttacaaagtttgccaccatcaccatagtctagttctagaacattttcatcacctgaaaagaaatcccatacccagtaacagtgaattcccattctcctccccttagcacaagacaactaccaatctatttcctgtgtctatggatttgcttatttggtacatttcatagaaatagagtcatacaacatatggttggaaaatgtgtctctgagaacctctacaaaaaggtttgtcggtgttagcactcttggcatttggggccagataattatttgctgagggatgtttagcagcatccctggcctctaccttctaggtgttagcagcaacaaccctcgctcttaagttgtgactaaccaaaagtgtctccggacatcgcatatgtttgatgggggagtgagggggcaaattcgcccctagttgaaacccacagatttacagttacctaagaactgagctgggtgtaggggtgtataaagtgaggtgggtgcctggacccagggtgctgttgtggaaagacaactatttcagggtctgtgaaggtccaaagtttgtaccccaagttccaaaactctgtgattcattttagcaaataggaaagagatgactaggggcaagaggcacaactgttatttagatgaagttattgttcaaacaatagctggtggggaaaaacactcattttttcggtcactaaaaaagatagagggtgatgggtgcaccaaaatctcacaaatcaccactaaagaacttattcatgtaaccaaatatcacctgttccccaaaaacctatggaaataaaaagacattttaaaagatagaaattgttattttaaaataaaattcaatagtatatgccagtggtctttaccttccttataaaggactggaatcatggtgtcaataattcaaaaagtgtctaaatttggatttgggctgttttatgttacaacagtaagaattaatggttctcaaagagccttacttaagtcagctttaacattactctgcagactataaacaccccttgagcagcaaaaggaagcatgaaatttgatttataccgtagctaacgaaaacaagtgggcaatcacaatttgatcataccctactaatctaatttagtctcaggaatggactaaaaagaggaagcttgtggactttagaaatatgtacatttcagaaaatataagtgtgacctcttttcttttcagaattgtgtaagtgaaggaagctgtcatcctccctggtaaatccatttgtaaataaacgggctaaagaaatcatgactgtggtcctttctagttcttaggatctgtcctgctcagagtgggaatcacaaagtgattgaggtaataactggtatctttgttgttctcagtttaaaggaagtgttctctcaaactgccttagactgcgcagccttgaccctctaggacttgatgccctgtgtatggcattgttatcagatgcaagttagtaaacccagattgtgtttacaagtaggttgtcattatacagtggcttctctgtaagtacaaaatgtatatttcctttttatttatcatggactatagcaattacagaatgtagctcttgtttttatcagggatattactgaggcccttaaactcaagctgacttacatttattttaaaatacatgttccaaagatgtttttaaaattttaaatatgcatatttttaagattttcccctttaacctgttctcccatcctgacatttaggatggggaatagacagaacatctgagggagtttgggtctcacagatcggctgtaaaattgagtaagagcaaaatgtttggaaaaaaaaaaaaaaaacaatctgtgtggttgttcatctggaaagatctgttccccactcagtagcttacagaaggctcaacatgatatggatcagctcgaattcattatctgaccaaacagcaactcaggaatcttatgtcctgtccaaggtgtgctgtgggactcaataatctctttccagatctattatatctacataaaaatatgcatgagaatcagataaactagtgggcctcaaccaggaatgattgtgcccttcagggtacattttataatatttggaagcatttttggttgtcacaattggaggatacggatgttcctggcatctagtgggtagaggccagagatgctgttaaatattctacaatgcacaggaaagccccccaaataaagaattatccaaccccaaatgtcagtagcattgaagttgggaaatcttgttcaaggaaattcccagtgcctcaggttgtcttatgagatgtggagcatgtcaatatccacagttgccagttgtgccatatggaatgctgcaaggagaaaatatagatacacatgaaaatgtgtttttgggatttggggaaatacatctatggatttgatactttggtgttccaaagatgtggctatttttgcccacaagtgttgcccaaaaccctggggctatgtggtgcctttttcacagagcaagtacataaagtacagactgttaaacagatcactcacctgctataaaatgtcagttaataatgaggtcctatcatggatattagttgaatgataagtgccacttctttcctcttacatgtttattagtgtcatctaaagcaatggctctcaaaatgtggtggctggaccagcagcattggtatcacctgggaacttgttagaaatgcacattgtcagccccctcccacacctactgaatctgaaacttttggggtagggcccagcaatctgtgttattttaacaagcttccccatgattctgatgaactttaatgcttaaatcggagaactgttggggaccaccagcacctgggagcttgctagaaatcacatgactaggccaggaccttgttgaaaggcagattctcatttagtaggcctgagaaagggatcaagatttgggactacagatatgatagcttgggtaaaaactacaaaatttctcctttttgagccttctatttccctcttcaaaaattgggaagacattgtattggttccctgttgctgctataataaataatcacaaacttagtcgcttaaaacaacacaaatttattatcttacacttccagaggtcagaagtctgaaatgggtctcactgggctaaaatcatggtacctggtgactgtaggggagaatcatttttcttgacttttccattttctagaggctgcccacattccttggctcatgtttccttcctccatcttcaaagccagaaatggcctggtgagtctttctcatatcacatcactctgacactgacccttctgcctccctgttccacatttaagttgctcctgtgatgatattagtcccatatacataattcaggacaatctccttattttaacagcatatgattagcaacattaatcccatctgcaactttaactcctctttgccaggtagcataacatattcacatattcttgagatttggatgtggacatattttggggggcattattctgcttcctacacaaataattttacctttattctccagcaaaatttgtgtcatagagaaaaatcttggaaggaatccagtcaggaccaatctcctaccaattcagaaatcttcctgcaaaatcctccaaacttggccatgtgatactagcttctcagctagactgtaagctgtatcctacagaagaccctatcttatagttattctccatctcctcagtgcctagaagagaatttagctcataatagatacttagaaaacattctttgattggtacactgctttcaggcacatagagcacgatatgactatatagactgtggaatcttgactttgtgaaactgagggattgatgctgaatctctgtcaagccttattaccctcctgtgtaaaatggggataatattacattctgtataggattgttgttggaatcaaatgaaatgttgtaaatagagcacatggagatatagatataatttacatgaaacgtctgaaaccataacatggtagaatactaccttgtgataatttgctaacaaaactgcacaagataaggacaggtggtattgagtctctttacataatgcttactgaagtgtcgcctctggcttcatttataacatcaatttagaagcagtgtttctcaacatagactatatttttgaaccattcgtgtagcttttaaataatatttttgcctgggttccattctacctagtttctgatttacttggtctaagcattggctccaactcttgctatgtttttgaatcccctggggaagcttttataaatatcgatggccaggtgccacctccagaaattctgtttcgatcaaatataatgtgtagccatggttgagatccattgaacacaacttattctaccttataaattgttacatctgccagacctttactgtatatgagaagttgtagttttatcaactttgcctgaatcagtggatgtttttctaatttccattcaatgtcattggtggaattaagaacactcaacataatgacatttgcaattataaaggtggtatcacatccccagagttttagcaggatggcagaaccacagtgagcactcagaaaacgtttgctaatgatgggccaaaaaaaagtgtcttttatggtctcttgatttattcaggaatattgcattgcagttgagtctctcacagagtccacttgaggctgctaacatgttgatttaatgaatgggtgcatttcatgaaccacccatccgagtgaattactttgggtgtagctgttttgatttttccttcctctgagtatatggttttgttaatttaaacaaattcagttgttttaccattttgtagacacattctttgtgtggccaagaatcttgtttgtggtggccacaccacaactggatttgaatgtagagcaacccagcaaagaagtgctaatttgaagcaattgttaacattgccagcaacaaaccaaagtgacctccatcaatgggttcagttagcaaccctgaaggcaagacactctgtttattccattatcgtttccttcatctatcagaaaccctaatcttcatggatgatgaaataataacaatctcaaacttaagatatattttgttcatcttaattttctaaatgtccttttttcccctcagtacaaacataatacatgtaaataaattccaacactataaaaattcattaggcagtgtcaaagtcccacaaatcccatcctccagtgatggccactaataaccatttgagaatatataaccccagatctccctgttaaattataataaacatttatgtccataacttgtgttctgcaacttctttgtttaactttacatatagtggatatctttccaaatttattcagagagaactactccactttttttcatgactgcccagaattccactgaatagataccccgtagtttagttagccagttgctcactgatggacacttaggttttttatgtttctttaaacatatatgcatataactaatatataataaaattaattatatataagtattaatatatatattttggtagattataatacacatgtagagaagtgcacataagtttacaacttaatgaatttctgcaaagtgaacacacctgtgccagatggagaaccatccctgaccagcacctcacagggatcccttggactcccttccagtcacttctccccaaaggtaacccctattctgtatttttgtagcatatattggttttatctggttttatagattacattactggtatcctacagcatgttattttttatgtcagacttctttcgctcaacgtgatgtctctgggattcatctgtattgttgtaggtggttggagtttgttttttcattcccattactgcatagttttccattatgtgatataccacaatttattcagtctactttcacgaacatttggataatttacagttcggggctgttttgaataatgctgctatgaacattctagcacacatattttggtgaacatatgctcacatttccgttgtttttattggtgactgggtttttttgctatcagatattgtactgaagtgaatgtctttgcaaatgtatcttgcacattttgcaagtattgctataaagtagatattagaattgctgggtcaaatggtattcacagaactgctccgaaaaaaattttgattttttttttttttttttttgagacaaggtcttgctctgtcgcccaggctggagtgcagtggtacaatcatgtcttgactgcagcctcgaaatcctggactcaagcagtcctcccatctcagcctcccaaagtgctgggattccagatgtgagccaccatgcctggcctaaatattttgacttttaagctaggtctggacctcaagtaacctattgtggatacacccctttgctattaccattatctgtgacacagacgctgctattgtgtcttcctgactacaaggcaagactaacaaaaaccagaatcttctggctcttttcagtcacgctctagtgagctagtgcctctttcatgtatccactgagggacaaaaagataaaatgacctagtgtcccaggatgccagcttaaacttttgagtacattgatgctatgataatatacaccaaatggactctgtggctctaagtaccatccactccagattgagataacctcctttcccaagtagagaaagaagattctaacctggaggtgagagccatttgcatgtcttaccaaaaaatgtcccattcagaatgagctgacattgggagacattaggttagagcagtgtttcccaaccttggaactgttgacatttagggtgggatcattctttgctgtgggggccgttctgtgcactgtaggatgttgagaagcatccctggactccacccatcacaactggcactttcctcctcagttgtgacaaccaaaaatgtctccaggcaatggcaaatgtcccttgaggggcagaatcaccccagtagaggactactaagctagtgcttatagaagaccccagctctaaatcagattatgttcagattctggctcagccactttttatgtgacctaggacaaagtacctaagttctctgcctcatttggctcatctgttaaatatagatattaatagtaatatttacctcaattggttgttgttgagattaaatgagattattaatgtgatgcacttggcatagtctttggcaaaaaaataagtgtcgaaagttgttaggtttattagtcataatctttattattattaaaaaaaaatggaggggtggaagaaggggtcccattgtgtatcctggaaaaaggatgaggataatgcatatctgaaaaaacatcaaaggacaaggggctcataactcttggaacacaggcaatgggaaatggaaatgtggagaaaacattaagtgctatgatggaagacaatggcatttggttgtctctctctgttccttctcaagttaacatttggaaactagaatttgtggaaaatagactttggcagcagaattaggcatttttaggaacaggataaatcactgtggggaaatattttattgtattactcttgttaatatgaagttattaaactttcaatagtgtgttgaatgcttttatcttaaataataaaatatattcagtgctaaagcagctgtattgtttttgatattattaagtagaaaaatttatctgttaggagctttgttgggttgattttcacctgataccctcttctcccaccaaagatctaactttcataaattctggcaatagaaaaacaagtcatcatgttaagctaggtctgaaccttaagaaacacactgtggctgcatccctttgttattgccattatctgtgatgcagatacagcaagacagagtggcatcctggacgggactccagatggagagtatgagtccagggttatgtctttgtgttgccaagctgcaccttggcttgtcacttcttcccattgtgcctcaggttctgagcagatggaattagtttagcatgtcccaactatattctggggaattcgagtgatatggagagatggtctgaaaattaaaaaaaaataaaaaatagaaggaggtgagattatagcaagtgtatttaggaggtactccgagttatgatttcccctctgcaggacttctctattattcttattgtttattgtgactacttaagttgaagctaccatgcacaactttttcaaatatatttgattatggaacagcttggaaaatcctgcattaaataatgtatgtgtcccttgcaggcataaaaatattctgatttcttttgaattaatctgtcatcatggctgtgacaaattaccataaatttagtgccatgaaacaatacacatttattatcttaaagtgctgtaggttagaaatctgacacaggttgcactggacaaaaatcaaggtgttgacagagctgcatttcttctggaggctctaaaaccacccacactccttagctcatggcccccttcctccagcttcaaggccagcaatattacatctcttagatcattattctatagtcacatcttcctcaaactctgaattctgctgaaaggggttgtcctattttaagggcctgtgtggttacgttgggcccacctggataatctagacttctgtccccctctcaaggttattaacttaatcatatgggcaaagtcccttttgccatgtaaggtaacacattcccaggttccagaaatcagggtgtggaaaccttaggggtgagagatattattctgcactacctatcctagtggcttcttccatttctcaaccctggagggtgtggggtcgtgttctgtagagccaggaagaagttcagcatttgttcatctgcttttgaccctagcaactcatgaaatgtgcaatgactatcttgtaaggggtattaaattcttctggcttttcctcacccagtaagcaataaaatcaaagaggacaagagtaattaaagcaagcctattgatctattttgtgtagcattctttttagcttctcttctgatataggcaagaatatctccctgaaaggaactaaactctgaactgtactttaacaagtaaaattgccatgctggatatcaacaattagtctttagagttaaaatataaacataaatgattaaattagttaatctactctttgtggtatagccattacagggctaatttttttttaaaaaaaaaaagaatactagaaacctctaaatttttcaagacactcatattcatcagactgtaaaaagcaaaagaaactgaaggattgtgttccttatcacagcttggaaaaagctctgatggctgatctatatgaagtggaaacattgcatgagttttcttgtaattgttgatatctcatgtgaatggaatgaggcggaaaacaagttttgcactaaaataagtgtttgaatcttgctatttggagtcatgttgtctacgttttttttttttgtttttggctacatagttaccatatgatccagcaattccacttctagttatatacccaaaatcattgaaaacctacgttcacacaaagtgtgtatgaatattcacagcagctttattcataccagtcaaaatgtggaaagaacccaaatgcccatcaactgaagaatggacaagcaaaatttagtatatctatacagtgaatattatcctgccataagaatgaatgaagtaatgacacatgctacaacgtggatgaactccaaaaacatgctaagtgaaagaaaccagacacaaaaagcccacatattatatgattctacttttatattaaatgtcaaaaacatgcaaaaccatagagacagaaagtagattagtggttcccaggggctggggtgagaggggaatggggagtgactgggtatgggctttccttttggtgtgatgaaaatgttttggaatcagtgatgatggttgtacactatctatgagtatactaaaaagaaacacagaactatacactttaaagtggtaacttttatggcatatgatttttatgtccaagctcttctattattttactataatttatttttgaaaatgtaaatttcaatatgcttcattgctcagagaaagcatgattttctatacatcagagcaaaagtatttacacaggtctgtgaaatactgtgtaatttatcattttaaaagtcgtatattgaggagaaaacatttttgaaaaataaatctgaaaagtggcagctagaaaatcagatgtgaaccagtaagtgcagatggcttgttttcacgtcatacctgcatttggtgtcatacttcatgttggtttctcccttttcaattttcccttttacatgtttgtctcttaatactaaaagtcaggaagcaagattttcttttttttgcatttttactggaagtgattttagctactttaaaataaatgtcctaaatataaatattccctgctggtcttgtttccatgctaatagacagaaatgattttctgtatagacagaattgctactctccttcaaattttctttcaaccagcaaatatacaaaagcacaaaatgttagtgctgtttctattcttccagaacctacagtctagccagggagaaaaggcacaaatatagataatcaaatagctttccaatgtttaaataagagtcaagaaaatagctgagatggggcagggtcggggggagatgagtgtgatggttacataggagggacgtatcggtgacgttagagttttctggaaaaatagctgacatttaaacattcccacccctcctctttcctccctcaatgagacatcacaagtgattgtctagacatctcaagtgtctaggtcatttggaaccttgaaagaagcagattcgccttctttaacaaacataaggtgaatttcctttggtcatgttttggtgttccttataggtccatagtaaacttgtttgtgttttagatggtatgattttcttgttaatgtgatgattcatttgtaatgtccctgtagggggacgacagggcttctcagaggaggtgatgctcagtaagcattacagggtgagtaggaaggcatggggaagccatttgggctgagagcacccctcaccctaaccatgaagtcctctgggctcttccatgtggctgaaattaagggatgtgaagtaagtgaggcttggtgaagcccaagagctaagcagtggccagatcttgagcgatcttgtgttttcacctcagagttgagaacttcatctggaaagctaggagcctcaatgatggctttcaaaagggaagggacaagatgagttttgctttgtagggagagacagcctacaagagtgtggaagtgctggtggacattcccagagaggaagtgttaaaggaaaggacagtttttaatgaggtgggatccacagaaactggtgactttctgagtgtgagtaggagagacataggaagcaatgttaaaaatgattttgcttcagttttcctgggtcactgcagggaacccatactgatgtatttgaaccacagaatcattgcccctaattttattgtgtgtattttcaaataattggtttacttaaagcaagatgcatttgcatacgtaccctttacccactgtgtattatcacatacctattataaatatttgtctatataagatagaaatatgtcacatatataattcatcatataataaatatataatagtcaagagatacatatagatacacatagatgtagagatagttaaatctatttaatatggagacaaatctataatgtttgtagtttttaattacaagtttctcaggccggccatagtggatttgataggcatcactctagtatgaatgtcttttctttcgagaatacttggaagaaatgctgattcctaataagtagctcataccaaatactaaagtccatgctactgatttcactttttctccctgagctttttctcattatgtgcgtaaaagaaaattagacattgagtgatctctgtggacccatctgctcatacatacagagatgtcacaaacatagttttaaaaacatgtggttcctggacacaggaaggggagcaacacacactgggtcctgtccggtggtggggttgggggagggagagcatcaggataaatagctaatacatgctgggcttaatacctaggtgatgggttgataggtacagcaaaccaccatgtcacatgtttacctatgtaacaaacctgcacatcctgcacatgtaccctggaacttaaaattaattaaaaaaagaaacagaaaaaaaatgtggttcctttgctgtttgaaatagtgaaatgctccaccatgaaatgtgaacattgtcatcccctatgtcatatatctggtgatttcttttcagtgggtccagatctggggtcggcaaactttttctgtaaagaatcagatagaaaacattttaggtgttgcggatcatactgtctgtgttgcaactactcaactttgctgttgtatcggaaaagcagccacagacaataggtaaatgagtgggtgtggttgttttccaataaaatttgattacaaaaataggccttaggctgtcctttgctgaccctgctttaagtcaacagttgccacctcaaggtcaaggcatgcctcagtcaatgtgttagaagtaatttattacctataataattaagttacaaactttagaatatttgtaagaaaactaaatgagagagaattagagatgagcctagaaccacctcatacagttattttgatgaattttcttgagtaggagagcaaggtgcagaaaagtagcataggatagtggttaagaccacaaactcaggactaaggtccctgagtttgaatttcagccatgccacttgcaatatgtgtcctgggacaagttacttgactgccctgtgctttgatttcttcatctataaaatgggcatattaataaacctcacattttaagattgtttaatgattaaaaccatgagtacaccataagggactggaataataatgggtacacactatatgtacaagagatgatagtcattccccacatatctaaatcttttggatttagatccaggacatagctctcagcttattttatctgtgctgtgagtcactgatgaataatccttactgtgcaccactaattagtagttgtggtgactacaaatttttatgttgctaatgggttgtaattttgtagtttctgaggttaaaaaaaaaatctacccatagatggatacttaacaagaaagaagcagcaaaactctgtgtagaaaatgtgaacgtgcacaaatcagtaatgcccatgagtgaaaatgacatgggaacatgttgttagggtacaacagttaaaattaccaaaaggtcaacaaagcgattatgtacttgaacattggacatcatgttctttatgttcatatcactgaattctggaattctgagtctactggttttttttttttacaaatgaaataaaatgtagctatgtttacagcatacccttccttgtccatcctattaatattaactggtggcatggaagtcaagaaaaatgactcattaaaataaaaatttttaataatttttaaaaatcagattaccatataattgatttttttgtaactgttttcaaaatggtcttcatattgccacgttaatttatcaaatacttggaacatgcttttagggatttcatgactttctccttcaaaagttggccccgctatttgctttatttaccaaaaaaaaagggtgaggtttggggaggggtgtagggaaaaagcaatcaaaacctgggtctatcagcgcatgtgacacgttcatttatcataagtgttacatgcatagctctctcctccctacaggactattttatctccactttacagagcaggtaattgaggcttaaaagcgttggatactcacatggctagttatatgctgaacttgaattcaaacacaggcagccagaaggagagtcctccctgtaaccactgtgctataacactgcatcccatttgaatgaaacagtggcaaaatgaacagataagatgaaagctgcttaactgtgctactgttcaaaatattccccatcacatctatggcagagctcatggaaagtgacatctggatcaagcctgtgcacgtgaaaaacaattttaaattatggatgtatgtgcttggagacttaatctcttaattggtagcattgttaagttttctttctgctgtcaatggaagagaaaggaaaaaaagaatctgagctttgagatgagggcacgttatgctctcggtgtgggagaaatctggcagaatcagtcaatgaaggaatatatggagagtgcagtcatcacatgagtatgtggaagggtgcaagaaatgaggagtggaggcaggagggagggaagcaaaggtacatgacaaattcttagtggaatttggagaaaagttatggatcctggaaaaagttcaaggaatttgtcttccctgatagtttcattaagctctggccattacaatggttctcaacctggactgcaccttagaattttggggaaagctttataaatatatcattgtctgagccccaaccccagacagtctaattgacttggtctatacctgtgctgtccaatacagtagccactatccacctgtggtaatttaaatttgaatcaattaacattaaatacaattaccaattcaatattcagtttctctggccatatctcaagtgctcattagccacgggtggctagtagccaccttagcaattagtactgttaacaaaaatgtccattgttatagaaaagtctattggaccatgctgttcttggggagagggacatggtcataaaaatttttgaaaactacagcaagtaattataatgtgcaatgaacttagagaactgttggtccttggagaatacatttgttctaaaatgtatcaccacttgtatctgaggtcattttgctttggaagatgattctgaaaatatcattaatgctagactttttctgcagcctagaaatgtagccgcatatatttttatttaaagcagcttgcttgctcatttactctacaagatttagatgagttaactaccagactgcaactaaaaatgaataacttgcttttccccacttagaatgaagtggtacaacaattcatgtagattttgaattacttattaaaagagtttaataggataaattatcttacagtaaaaccgagaggctcattgtccacagctcacattttaggcaacagattagaagcaacgtctatatatttgatgatatccaaaattaatttattaacttaatatgtttatgaagtcgcatgtaattttgaggaaattgttttcctttctcattagagaagaaccccactgagaagagacttttgcaaagtgccaaagtgcaattgatgaaacacaatgtcaccaaatatagcattgaaatgagaaagtggaaaggaattcactttggcattttttattttgcctagtttgtttggcctaagagttttcaagctcctaaatacgatattcttctatccttaaggcttgttttatatcctgctgatttgtaaatatctgacttgggattgggttcttcagtttgaggtgacagtacttcagcatccctgtatcttttaggtaatcttgctctgaaatccattccatgtttaatgagcagtgaatatacccataacagaataaatgacctgccctacaaagagttcacatgacatcttacctagaatgagtgccctcttatctgagtttccttcttatttcaagaaacctgaagcatccaaccttataactcagcgttcctcactacatgagtagaaggagcagctacaaaataagtaccattctctgcagtgtggtagaaccagcgatatacagatttctccataagaatcaagataaaatgcttttctctaggtcaaccctcctgggcacctaaaatgagatgcaaatttcacactctgtactcaaaggtatttctccagctataatcttgggcttaattttctggggatccatatttattggaaaaagagagggactctcataaagaaagaattcctagagtcagcttgttttattgctgcctagactcgcttcttatcagttcattccacaggtagagcctccgtttaccggttacattgtagactcagtttgcttcctctctttatccccttcctatcagttctgcaccactcggcctcattcatctttcctaaaacatctctttcatggtgttacacccctacctaaaactgagagtggctagttctacttgtaaaggatctggcatccaggaggttttctaacatggctgttccttttttctttaaatgaaatacctgtccctctccttattcctggaggtcattgccccatctattggctttcttttctctgtttcatcctggtgccctgcctctgtttctgcatatttctgtgtctcaattccacagggctttgagccctgagctgtcatctatgtatttaccaaaattctcccagttgcagagaggccttccagtctctgttggatgctctgtgtcatacttactttgtttataggtcttccaaggaagtgaataaagaaaaggttgctggcatgctgtgatattgcctaggggttaaaattattgcatttgaaaacagactgcctgggtttgagtgccaactctttacttgccagttgtgtgacttctggcaagctctttacgctttacgctctctttgtttcaactttcttatctgcaaaatagagataattctagtgcctgcctcctagaggatagcgtattcatggagacaataagtactcagtaaattttagttgttctttattgtggttttgactgtttcagattcatggtcttaaatagctttccagttactagatttgctttgatggtagagtttagatctgaaggatccaaaacattctctccgtgcaaataggtcacagtagcatcagaaggacgctagcaattagaccaaggtcagggtgctaggaatggggaaaggacggacagctacagttaaggaagcaaatggcagcaatgagagaatatacattggcttatcacctagcccctggaagttctgagcaatacaaagatagagtctgatggttaaactgatggtaccacattttcactgagcactgtaaggcagcagatgaactaaaatgtctctcacaatttgcatttttatatatagtcttaaaaaatattaagaccttacatgcgaactctatgctacactcaaaaaaggttaccaggaccaatggaaggtttatcagtaatgaatataatctaaatgaaatttcactgtgccattttatgagtcagtcatgattttgaaagataaaagcattacctatttctaaccattggctatatattattcaaaatctgaaggatgtcattagaaatatatttgtcttcttttatattaaagactttctacatgctcagcaaaacaatatataaagagcaatttttactttaccatccagttgatcaactactctgtttccaagtgagaatgtaggaagggacgaaatgagtcatgatgtcgttcagtggggagaagtataggaggagtttcaagcgcaagggctccagatcaggctgcttagatttattatctgtgttcatatgggaagttcaggaaagtgaggtcagctgctatatcagatacatccccaaatttcacaacataagtctatttgtcattcatactgttagattggccacaattggtgggacagctgtgctccaagcaatgattctgaacctgggctgcttcttcctttcattcagctggaggtagggtgggctggatttaggttgagacattggggcaactaaacctttcacgctggctatattgcctctccacgtggtctcttcaacatagtggctacacctatgtcatgggggctcaagggtcctatgaatgcaaaagcagaagtttccatgccttcttatgtctcaggtccagaatgggcttggcatccccttctgccacattcagttggttaaagtaactcatagagccaggcgggcttgaagggcaggggactacactaggcaaagaacactgaaaaatgtggtccactcctgggactaccacacatggctatgcaggttgcctggatgctgtctccaggtttttatggactggggctagaaatgaagcttgtcacttcctctgacattccattagctagactccagtcatatgaccactattaactgcaagagaggctgggaaatgtagactagctgaatgcccacgaaaaaggggctacgggcttcatgagcagtcagtgttttcctcactgtgcgccatccatttctgtgcctccatcacttcctctataaaatgaaattgttggaggcagtgaatacatggcacacatgaagtgcttagcacctaatacatgctcagtaaacttctactgttatcattcactattatgtagtggctatttgattttattccatctaagtaaaagcacaccgcactggataccaggctaaggaatttggactttgtcctggagctaaggaggagacatcaaagggttttaggcaaaagagtactgtaatcagaaatgtattcactcaaaaagtttgacagtgattctatgatatttttgccttaaatgtgcaaaatatcaccagtgatataaacagaaataatccagaataagagccaagaagaaggtggaatgaatgcttaatggcatagattcttaggctataaattgtttcttggtatgcttagatatggagggttaaatgggaaaaaaatgaccattgtgctctcagcactttttgtgattagcgaaactcttccacagatggaaccttttagttgcttcctgatatttatttccaaggctctttcagtgactctttggtctcttattggttttacttaaagagttgttatttaaatcttaaaaaggattccttatctttatgttttgtttttctggtttgaatgcattttccaaagaataccaaatatacacaccttctccattatttctgcacttcctcttaaggcctgccttgcttccactcttaaaacagactaggaatttcacaagatgttgtctctcgggattatttgagattattcacttagtcaccttcttacgaaacatttattgacctgacagtgtatgtctccatcaaataattgatttaacagaccactctagtgttaggtaaacattcttatttcatcactgtctcttccttattagatacttataacatggctcctactagtactgactctgaactgtggttttgtcttccagttaatttgtaagctcatagtggttgggatgacagccgcattacttatgagctgtgaatctttgagcaagtcacttaactcctctgcgcttctgtttcctcatctgtaatatgaggataataatgtaacctactgctaagaattattttgatggttagataagtcagtgcccataaaatgcctaaaacaatgcctgacacttagtaagtgctcagtcagaactacatgttgctgtcatctatttataaactaaaggatcatttgcctaataataaaaaatgaattacatatttatcaatttcatgtgaaataatatattaagatattagatatattgatattaagatattagatatctttaaatgaggatgtaacttccattgatgagtatccagtatgagccatgttgactgtctactggaataatgcgtattttcaacatcagtttttaggatagtggtggtggaggtatgtgcagtaacaggtagattttactctgaatctctgtttaagtttaatcattctagtaaagaaaaccacctggaatattttactgctttaaaattccttccttagcagcagcagcagcagaggctatgtgtggcttacatgattagtttcacagaatcctagtaaaagcataccgagtccttaattttgaatcagtaagatcttccatgaaatcatttcccggtttgtaaattataatcacagtgattcttttgttggaattcacttgagacccatgagagaactataacttcctattgactgggaaacaaagatgtcttttcgagttgtatttggttcagtgccatgtggaatgcatggagatcaaggtaattcgcgattggaattaatcttcccttttctctctgctcttcatggatgccacccccaacccccaccccaacctgaaccctcttagatatggccatgtgggtatattcactctgacctccacaccctctgttcaggaaatgaacaacttctcaaggactgctgtcccacaaagaggataaaatacagagcatgtgttatgcttcagtgtgaaagagaatgaaaacttttgctttttagtgtgtgtggctagtgttagaaaaatggagtcagtagttttaaaatataatttaagaactgagaatttgtcctaaacaaagaaggcatcctatgtgctttatcttgctctcaggggtttcaccagtggcttccaacattctttggttgattcctaataaggacagtttgcacagttacaatccaattaccgtttgtagatccctgtggaaaagaggattttttttagaggaatccttttctaactcgagtatatttcttcaaaatactctcattctttttgtcccttccctcccctctttcctcctccccaactctctctctctctcaccctctctctctctctctctctctcacacacacacacacacacacacacacacacacacacacaggcacacacgcatacaaacacacgcactcactcatttgtgcacttactcagggacacagcctgcctctgttctgaaaggacaggaacttctcaatgatccgatgaaaagattgcatatttttggtcccaagattcacagtagcggaggtctctggcaacaaaaggtatcgtgggagtcacagctatgccagctgggccatttctcagacattcaatatgatctgccatttcaggatgcattttttaccaaaaaaataatttttttaaaacagactcaacttcctactgcaagcttagttcagttagattagagaggacagcaaagacgcggctgattataatttatgggtaagcaatataaatatctatacttacactactttttcagaaaataattgtgataaagttttgtgattctttcacatccatcttgtgatttaggaagaaaactggaatgatcagtgtctgagatgtgtgacagctaaaaactgtctgtgtcaatatggatttatgagaaccttatttttagattaatgatgtggcagcttgaaatgagcaaactcaagcaggaaaggattgtgtcatgattaacagaacagcataattgagctaatttctgtaaaagattcgggcacaggctgttttgaagtctgaaagggtaaagtggtttatctttccctcttaacttcttgaatatgggtgcaacattttagttgctgtggctgtgataaatatgggtttaggggaacagtttggatattaaataaggctaataatacatcggatgtgcttgtgctgtcttttacaaaagaggaaactttaagcctctgaatttttaaacactgtctggctttcattattataagggtatgtctcataatgaaagggcttggtggtggaaagaggggaacatgaccctgatgtcccagatcccattatgccactgcagctgctttgctcatttgtaaagttagaggtttggattggtttatcatgaaatgttatgaaatacatatagtggttatgagtctaaattctagaacctaaagcctggcttcaaatcctaactctgccacttaattggtgtgtgctcttggcaagttacttaagttctgtgcctcagtttcttcatctgaaatatgggaataatgatggtaacatagtccttaggttgttgtaagaattaaatgagataatataaataaaaggcttagaacagtaactagcagagagcggaccatctataaatgtgagcagtatcttcaaggtctaatctatctccggaggtcgttctaatttcagtgaactaaatttaattagagaaagacaagtagaaccatcagctgctggccctgtcattaagaaatttctaattcatgccagtgtttccagtttttgcaaccctgagatttgtgcaggccatcttaccttcttcctcccatccaagactcgagagaagcttagaactgagaattaaattgatggccattagaaaagtccacaattcaactgggactacacagaaatgaaattgaccttttgctctgacgtttttgcccttgaggacttccagtatgtcccctctatgctaaccactggaaaggttctttccactggaaacaagatgtaagtgacatttgattttttagatggtgttagcccagccctgggtttgacaatgttcatttctacttctttagtttatcggtaacccaggtgaacaggccatttgcagataaccacttctatttcatgctagcatttgcatattttctaatatgctaaattatgttgtttgatttttttttttacaggctctctgggatgtttctcagagacaaaatcttaggagaggaggaaaatggtgatggcaaaaggcagatcctaatcatagatgtgtctttacttttagtccagtccaggggtcagcaaactttttccataaagggccagatggttacctttacggaagggcagcttcatggactgtgcagtctctgttgcaacaactcaactctgcaattgtggcctgtaggctgccacagaaaataacaatgaatgagtgtggctgtggttttcataaatcaataaaacttgatttatgaaaacaatcagtaggcagtacttggctccccggctagtcagcttgtatcagcaaaatccctgtcatcatccccatttcatagatgaggaaaatggggcatggggaatgtaagtagcttgctaaaaagccacatggctggctagtaagtggcaaaactgggactcaaactcaggcagcccagcttgccaccccttgcttttagccaccaggctatgctatacctatgtcaaccagtctctgcctgggctgctgggctcccaaaacctgcctggctcattccctcacctccttaagggttggtgcaaaaatcatgttctctgtaaggctgtcctggtagctcatgcagcactcctattcccctcaccctgtgctacctccttctctatctcttatcaccttgtaaaacttgctgtgtaattcagcacacatttcttaagagtttttggtgtctctaatacttccaagttaagatgctgtgttaggtccttcttgtatcaccataaaaatacctgagactgcgtaatttataaagaaaggaaaagaggtttaattggttcacagttctgcaggctatacaggaagcatggtggtgtcatctgctcagcttctagtaatgcccttgggtaacttgtactcaggatggaaggcaacagggaaccagcctgtcacatggtaagagcagaagcaagagagagagggaagaagtgccatgcccttttaaaaaaccatatctcacatgaactcagagcaagaattcactattgcaaggacagcaccaagatattcatgagggatccaccctcatgacacaaacacctcccaccaggccccacctccaacattagtgattgtatttcaacatgagatttggaggggacaaacatccaaaccacatcagatggtgatgcaaatttagagtggtgatgattaatattaattataacttaaatttccatttattcaggtcttgtgggagcttataagccttccacaagaaattcatttgtattgtctgatattatccctacaaactgagagttaagtcttgttcttttctccatcttaataatgagaaaaccgatgatcagagattttctgaatcttaccaaagaactgccatctatctgaatccaagtcttcaccaccatgccagtgagactcaacttttattatgcaaaaagtaagactcatctggggatgctgctttataatggaggtgcttgggacctattccctgtgactctaattctctaaatctaccttagagccaaaggaacctacgtgtttaacaatgatcattctgcccacgtgattccgatgccttgggtccacaaaccacattttgaacagccctgcctcaccccttgtttggccctggggagtttacagttggatgagattaaagagatgctgcagttagagactagccccaaggatgtaataaaacaatgtggtgtagaacaaaaccaaaattatttcaatcaattttatttcatgggaaaatcaagtctgtaaaggtgcaacttagctcaaaagaatgactttctgaataaagcatagatattagattgtttgggttttagtttgtcttttgcttctttttttctaaacatagagacatatacttctggtgggaaggaaatctctttagttaacacttttggtgagttgttctccagttaatcaagactctattgttttcaaactttttttggtttgcttcttttaattaggtttgtagtgtttgtacttattaatactagcttaaaataagccctatgattctgtttatgtgtataatacgtagaaaaatacatgtaaaatacacatagtaatgcatgatatataaacgaatatatagtacatatttttatgataaacaaaatatataaataattgttaatatttccagcaccatcattttaaggagattatatgtaatctgggcttaacagcagacttatttatgctaaaccaaggtttctcaacttctgcactgtagacaagttgatccagatagttgttgattttgggcagtagtcctgtgcattataaggtgcttagcagcatccctagcctctatcttctagctgccagtatcaaacgctgccccagttataacaaccaaaaatgtcttcagacattgctaaatgctcactgggggcaacattaccccaccaaggaccattatcctatatcattttatcatattgctgccctttattaatgctgtcacatagtaccctagaatagaaagatgtttttacaactgccaaggtctttagtctatccagagacattggatgaatttcaatttcatctacatttataaaatctaaacaaatttgaaatcatccattttcaatccttaaaaaaattccatgatgatcactcaaaagactagattcagaaagccttcaaatgagtcattcatttataagataaacagtcaccaaagaaaaatgctggtctggaccatgcatgtgagccttgagaaaccaccagaaacatattctagactgtgctggtaggctttggtgcccttcctgggtgcttgtttatcactttatggtccatgccatgagagtcaaagggagactatgacctttgtgttcatgtcttactgctcctatgaagtctgatgggtgggtataggtatcacggattaactcttccccgcgtcacctattatcacatttattttctcccctcatgtactggcatgggtttttcttggcttatcaacaggctatttcaaaagactgtctcttaatggtttattcgaatccagaatacagtttcccacatatatacaacattgtatgggttggttaggtttccaatttatttaactcatgatggggctggttcattagtccctagattgacaaatatttattcagtggctgttaagtgccaggtactgccttagataccgagaacatcaaaatgaataagccagacaagggtcttgccctcctgaatctagctgttgtatatggctgataatgcaaggccctaggactgggttgctggaatatggctgtagatgctacacaaatatgtgtagggcactacatgaccctaatctccatatcaggggttggcaaacaacagccagtgggccaaaagcagcctgatgcccgtttttgtatgacttgcaagctaagaattatgtttacatttctaaatagttgaaaaaaatttgaaggaaggatattttgtacacataaaattatatgagccttgacttttcatgtcatagataaaatttttggaatatttgtttatgtagggtctatggctgtttttgccctacaatggcaaaagttgagtaactgtggcagagaccataagacccacagagcgtaaagtatttactatatgtaattttctataattctattttatgggaaaagtgatttcagaattccagtcttgggacctctccagcacaaatcattggtgatggtacctgtagtatgaagcagcaccttagcatcaggtagcagggagataagaatctgatggaaggtcaaaacctacttttttaagtgtctgcgagcatgcccttcaccccaccaacttccttttctaatgctcccccttactcttgaattcatttcctattgctgccataacaaattatcacaaacttacaacacaaacttacataagtctcatgtgggcctcactgggctaaaatcaaaggccatgttccttctggaggctccaggagagaatccttggcttttcctgcactagaagctgtgtgcatttcttgtcttgtggctcctttttccatctgtaaagctagcagccaagctctttcaaatctttctctctcccacctctgcttccattatcacatttttgtctcgcttctgcctctacctctctccttgtgatgacattgcactcgcctggataattcagaataatctccccatctcaataatctgaaattaatagcatctgcaaagtcccttttaccatgtaaaataacatactcacaggttcctgggattcgggtatggacatctttaggggagacattattctaccaaccacaccttccacctgattacgccttactgtacttctctctacctccacagaacaaaatgtgggcagaggggcaactcacaagcttgcaacaaccagccagaatattgtagtggctaagagtggcttctgagagtgtcaggttcaagttaatttttttgttgagtgaaaaaataaggattatgtcatcacttcatttgtttaataaaagaaagcagggtcatgcttactctcagtttcagaaagtaacgtccttactattatgactgtcatagaaatagctttctttcccttggtagatttgtatctttctttgacaatggaggacttcttggattttctagacttactacatagcacttattatagcctaactgaacaatgtggatgcacactcaaactagaatctattcaagccttgagctcagtggttctcaaccctggctgcatgggagaatcattagggaacttcaggaaaaaaaatggacaaagaaaatgtggtacatatacacaatggagtattattcagccataaaaaagaatgagatcctgtcatttgcaacaacatggatgaaactggagattgtcatgctaagtgaagtaagccaggcacagaaagacaaacatcgcatgttcttacctatttgtgggttctaaaaatcaaagcaattgaactcatggatagagagtagaaggacggttaccacaggcttggaagggcagtgtgggggatcaggggaggtggggatagttaatggctacaaaaaataattagaattaatgaataagacctaccatttgatagcacaacagggtgactatagtcaacaataacttaactgtacatttttaaaataacttaaagagtggaattggatggtttgtaattcaaaggataaatgcttgaggggacagataccccattctccatgatgattattatgcattgcctgcctgtatcaaaacatctcatgtaccccataaatatataaacctactatgaacccacagaaatttaaaaagtaaaaataaggaaacaaaaaatacagatattgtcttggtcactgggtctgccataacaaaataacctcagatctctcttttggttaacaattccaaatataacaaagaagtttaaaaatccaagaagttaagaaccgtgggctgcaatatataatggactaaagtaaacttgaagcatcgcactttactttttattatgctaactgtagtcatttgtaaacagtttgaaaaaacatatattatttgattgtgttggaactgttttaattgagagtacaaaatcaaagctcaagaaaaatataaattggccaggttctgttttgccagacttagtaatgttttaattctgttttttcaaaagaaaataccattttcaccatgtccaaaactgggtgatcttccttctccccctgcaaacataattccctctgccattccccatcttggtgattagtgttactgtctgcccagttgctgaagctagaaactcaagagtcatcctagattaccccttctcttcccctcactgcatccagtttattctctagcatctatgtggttctaagtttctcccgtgtctgttcaaattggaatcagcatcccacttagcacggagtcttttctcatctccacatctttgacttgctctcccctttaattccttaggaaacttgtttccagtcatcttccctatatttcaaatctgctcatgttcctctctagctcaaagttcctgaatgactagccatcgtctatggaggaaaatctaatctggtttgcattgccaacagagacagccctacagaatctggccctgacttctgcttggcttcacctcttgcccttttcctccttccagccttgtaattccctgaacaagcctgttttctcaaactcatttgcctttgcacctgctgctaaagttgcattgctactgggcgaaccctgccccctcttactcaactttcaagcctccattgaaacactaccttctctataaagctttccttgatcctccagatagataacaaagccttgtctcctaggcattcattgcatttagtacttacttctagtaccacaatctctgtgttttatggattgtttgtgttcttcctacctgaaggttaactctgaggacgaggactgtgttgtcatcttaatagtcccaagcctaccacagagcttagcatctcatctgtgcttattaaatattgtttgaattaattaaccaggaggacttagtaaataagaacaaaatgtcccttctaggaattactttatttcagtcataagctatagttcacaggttgggaaactctagcccgccagccaaaaccagcctgctgtttttgtaaataaagttttattggcatatggccacactcgctgatttataaattatctgtggctgctttcatcccaccaagccagagttgagtagttgtaacagagatcacatggctcacaaagcctgatatattttctatgtggtctttacagaaaaagattgtcaaacccctactacagataattaagcccattggaggtcacatctttgattgcttttaaagaataggtatgtaattctgttttgacacttcaaataacagtcagctcccgtaggtacctaagcttgatatctaaaatttataaactcatctggggactttctatctgggagaaaataataataaaaaaaattccccaatagtgttccttgtagttctctaagcttagagggtgtgagtgaggggtacacccaaggcctgagtccccaaccataatgtctatatgtcctattttttcttagtctggttataccaaaaacataaaagaaagaaaaaattcaaaatacactggccccagaagaattttcttctgttcactgaatgtgactgcagcctcctcactttgactagatttgctcactcactcctctccccacatcccctcctgcatcaccctccctgagctcctcctgggttcctgctagtcttcatcattatccactggatataattcatacatgtcaaggcaaagaaactaaaagccataacttctttaacacttgctcaaattttgccttctcagtgaggtctttcctggctgctgtctctaaaactgcaaattcctttcttctacttccccttctttgcctttttctccttcctagcagttatcattatttcacacaccattccttttacttaccccgttcattttctgcccctaccagagtataatatattcatgtattaaatgagtgaatgaaatcccagataaagagggaaaatatcaaagaattaacatcatgccattcacttttggaatgaatacactagacaggaatttgtcaccagtgtgaaacaaagtgctatggcactttgttgctgggaccagtctttctgtctcccttctttaaggtgagtgacttcttttttatgtttttaagacagagttttgctcttgttgcccaggctggaatgcagtggtgtgatcttggctcactgcaacctccccctcccaggttcaagcgattctcctgcctcggcctcccaagtagctgggactacaggcatgcgccaccatgcctggctaattttgtatttttagtagagacgggcttttgccatgttggccaggctggtcttgaactcctgacctcaggtgatccacccacctcagcctcccaaagtgctgggattacaggtgtgagccaccacgtccaggcgagtgacttctttaagatggtgaagtcttatgggattctgttaagtgttccatttattgcaatgagtccctgcgtgggccagtacctctccttccctgatagaacttttctttcttgatcattgagcaacagtagctgcctcctcaaatctgttgcagcatgcctgatacatgagattcacaagaagtctttagtaaggagacactgggtttcagaggattgtaaagtactttttctttggacgtcactttcttactgtctgcattgagggtggagccatttaccctcagtggcctgcaagggtgtgcatgtgtacacatgagtacacttttaggattgtggaaatctttgctttgactctttgatgtggagtattttagcatcaaatgtctctataaatactgaacatcttcctgttgatcataactctaagcttattgtgttcacaataactcatgagagtgctacaaatagaacctcagtggttacaatattagcatagagtttaaagccctacattcttagcttgagtccttattccaaatcttataagttttatgatttggggagaattacttaacctcctcaagactcagtttcatcatctatattatattggtatatgttactatactattcatataatatgtcataagtataaactttactattataatatattctcatatattatactagattatattattaaattttacatgagataggtaaaaaatgttaaccacttcataaggttgttggagggattaactaaaaagcccttgactatggttaacagtaatatatgatctcaaatagctagaaggaggatattgaatgttagcaaccaaagaaataataagtgtttgagattagttactaattattagaaatatatatctaataaccatatgtatagaaatatcaccatgtgccccatgaatatgtacgatttttatttgccaattttaaaaaatgcccttggtgcagccgctggcacatggtaggctctccatacacactcatccccctatatctgatgtgtgtgatggcaattagcagcagcacagtgtttcacaaaagttagaagttcccatgtgttcccataaaaaggaggaagtaggaccctcacagtatctttctacatagtttcctcaggcctatatgcataatgagataagatcatgtgacccagcagatacttgagattttgacatttgcaactaactgagaaaatccacagtgaactaaaagaggatttgactttgggaattgagacccaattttggaacacaaaggtggtttgcttgactttattactaagagaggatgagatttgtgagaggtaagtgaactctgtaactcttgattttttttttttttttttttttggcctacagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaaggtaaggcctcttctgcctttctgccggggaacactgcaagtcaaatattggctctgccaaagccgtgagctgtgaactcttctcacacctaatattcacacaggaaggaaactacagcttcttggttgttggctggcattagtgtccatttgaaggacatgttcaagagggacaatttgcatgtcaggtaatacatttatttaaagggaaggtcaacttggagcattacaaaggaaagctgtgtgtatatcaacagtctatatggattctgaacaaccaattaaaaataattttcaggaaggtcatcttaaagggtcagaagaaaagctgtgtctatctcagtttggtttcaaaataacccatttgaaaagaatgccttaacactctgttaaacttgtcgtttgaccctatgccaactcagaatcagggattttaccgaacctaactcctttttagccagtttttcagctggtgtgttgtatgttgcactggagccagtgcacacctgattggctgatgtttgttttttaaacagatcctgattccagtaaagatgagacacatgtacttgaattccttgaatccataaaactttgtctctgtatgtttactgttgtctataaaggcactttttttttttttttgagatggagtctcgctctgttgccaggctggagtgcagtggcacaacctcagctcactgcaacctccacctcctgggttcaagtgattctcctacctcagcctcccaagtagctgggattataggtgcacaccaccacgcccagctaatttttgtgtttatagtagagacaaggtttcaccatgttggccaggatagcctcaatcccttgaccttgtgatctgcctgcctcagcctcccaaagtgctgtgctgggattacaggcgtgagccactgcacctggcctataaaggcactttttaatttgtattagtatgtagcagacagctactttgaggcagaatgaaaaactatgatgttatacacataaagtaaatctgccatgaaaagcaacattgggcagggtgcctgaaacttaaaggaaagcagaagagggataggaagcttctagaaactagaacatttccacggaggattttggtatctgcaaaacttctcttctactttgttttcttttggaggaggtcgaggggatgcttcatgaatatttattcataaatagttcatatatatatacacaacatatgtgcatatatatgtatacacatatacacacaaataggtggttctcaagcagggttgattttgctccccatgccctggggacatctggcaatgtctggatatacttttggtttttgcagcttaggggatggatgctcctagcatctagtgggtaaaggctgaggatgctgaccaacaccctataataaataggacagccccctgcaacaaaaattatcaggccccatgtgctgaagttgacctaccttgctgtacacacatacattcacattctgtcacccacagtgccagtggtgcagttctcttggctcagctgtggctaacagaaagaatgctggcttggaggtctaaagactaggacttgtgaactcatcctgtcactcctcacacctgtgagcttgggcgacttgcctctgcggtaggaggctcagttctttgaccagaaagagtagcacaaaaacactgaccagagtttttctttggatagtgagtcttagggccacgttttttcttgaagcagaacctgagactccattggaggttatgacagagttcagaagagagagatagacaaggccaatgggctgacaagacatgcatatttcactggcatatgccttgcacctttggctttcttgtcacggtttgttcactaccacaaccacagcatgttgtttccaagaggaaatccccaccctgttttattttttcatgctaatctcacacatagagaccctcagctcaaataagaagaaaatcacttaggcaattgtgaaaaatgaatactagtgactgtcaggccgtgtcgctcttatccttgagaaacgccctcctgccttacctggtattggtttggttgtagggtggagatgaggcctgttctccctccaacataactcacaaagtggcccatgtggggcccgggccaagagttttgtctccctttaataagcacagacattcttttcattcctaaggaaaaaaaaatggcaatattgttagcaaacttaatttgtagtgaagagaatgatgactttgaaaagtttttgaaacttggtttgaatgcacatcagataagatatcagggaacagatactctctgtggctttgtttttaaatccagttgatttttttctttgttcctgcttgttaaagagtccactaaacaaataacctttaccaaaaacaattttataaaacttgtctactagaggctctgtctccattaattatttctgaggctgtgtggttatccgcacatccagagaaagatttgtgctatcgaaatgtttgaagatattcccaggccacagcagttattttcatattttctgtcaaaataggaactaatgatttacaaataattttctcatttatagaggagagagggaattgtgtggctggtgaaagaaacaggcatcgcatgagggtttctgaagctactgaattgggcatatgaatatagacatcaaatatttactgagatccttggaatgtgtggctggtggcaagctctatgacagtagctttggtctaaatgtggccacttgatccccatgcaaaccttcaaatggaggttctcaacagggtcagattcactgtgtgaataattttcacaggaaaataaatactgtagccaggacctaaagcctaaagaaatgatgccaaacctaataggatataatgaaaatcatgatacaatgaaaatggacacatagtcaagctcacatttctgttctctgtcacattaggatgatcatagggatttatttgtggttatctatttgtagaaccctctcctgtgagtctggtgcttccagggttcaaatgaatgctattataacatgatcatcagctgccagaatttaccatagagaggaaagaattgaggatgggggagttgggaaattactgggtgatttcctagagtagaccacaagggtgggatccagagcacaagtggagggtttgaccttcttttacactataatgatagatgggcattagttatatggacactgatgcaagtgagttagaagatggtgggagggcacgtgggattttactccagattgcgtctcagcgtccaacaaaataggaagcaatttaatccactaggcgtgaggatggcgaagaggtcctggaggtttgaggaaagaggagaggagtggaagagagggcagctaacgggccagcaatgtcacaggattgcaggacaggccaaaaggtccgtttgaggttagtagctgggaattttaaatgaaaaataaacatcctggtatctaaacactgttaagctaaatacaccatatcggacttttaattccccagccttagttaatccaaatatcctcttttgagttaggacttttctagttcaattcaatgaaggtgaagagggacatggcagttgagaatatatctgtagtaggcaaaataatggacccccaatgatggccacatccacatccctggaacttgtgaatataatacctcacaggccaaaaggaactttgcaaacgtgatgagttaaggtccttgagatagggagattatcctggattgtctaggtgggctcaaactaatcacatgggtactttaaagtgcagaaattctcccagctgtaatcagggagatatgtgactatggaagcatggtcagagagatgcaatgttgccggcttcaaagatggagaaaggggccatgagccaaggaatgcagatggcctctacaagctagaaaagtcaaagggacaaattcttcccaaggggcctccagaaaggaacaaagctctgctgacacctcaattttagcccagcgagacccatttcagatttctggcctccagaactgtaagatgataaatttgagttgtttaagacactaagtctcttgtcattagttatagcagcactaggaagctaatacagtatccaaaggaatgattctaatcccacaacacagagtctcaactggataagaaaggaaattaggaagtaattcaataatataaagctgtaaattttgtcattaattatctataagctgaatgtgattccaaaataaagtaccaacagaatttttctttttgatgattttactaaattaatctaaacatcatctgggaaaataattaagtgaaggtagtcaggggaaatctgataaagagataaaatggagattaaccctgtccatttattaaaatgtgtcacaaaactgaagaattaaaaatgaaccaaaatacatatgaaaatttattacgtgataaatacggtatttttgtaaagggaaaaagatgggttattattgtatttgagataatgagacaatcatcattaagaaaataataaattgatatggaagaaagatttaaagattaaaaaatgaaactataaatgatgcaccagcagaaaacataggtagatatatatttttttacactagggaaggcctacccagaaaacataaacaaagagaggaacaagtttcactacattttaaaaaaatagaattatctctgacagataagcaaataactaaactttatagcacatttgacaaactaaaggctaacttctctattgcataaaactttattacaaattaatataaaaagaaaatctaaaatatagacaaattacaggtggctcacagaaaaatacaagtggtataaatagatttgaaaagatgctctccctcacattcattaaagaaatgcaacctaaacaccaaggagattttttttttctctcagagtggcatggctccaaaagttggatgatacacttcgtggggaaacaaacactctcatacactgttggtagaggtgtaaattgttgcaacagggtgcaaggcaatttggcaacatttgtctaaattgtatttatttatttattatttccatggttttttaggaacaggtggtatttggttacacgaataagttctttagtggtgatctgtgagattttggtgcagccatcacccaagcagtatacactgaacacaattcatagttttttatccctcacccctttcccaccctttctccctgagtccctgaagtctattgtgtcattcttatgcctttgcatcctcatagcttagctcccacctattagtgagaacatacaatgtctagttttccattcctgagttacttcacttagaataatagtctccaatcccatccaggtcgctgttaatgccattaattcattccttcttatggctgagtagtattccatcatacttatatatataccacagtttctttatccactcattgagtgatgggcatttgggttggttccacatttttgcagttgcgaattgtgtggctgtaaacatgtgtgtgcaagtatcttttctgtataatgacttcttttcctctgagtaaatgcccagtagcgagattactgggtcaaatggaagttctacttttagttctttaaggactctccaccctgttttctatagcagctgtactagtttacattcccaccagcagtgtagaagtgttccctgttcaccgcatccacaccaacatctattattttttgattttttgattatggccattcttgcaggagtaaggtggtatcacattgtgattttgatttgcatttccctgatcattagtgatgttgagcattttttatatgtttgttgtccatttgtatatctgcttttgagaattttctattcgtgtccttagcccactttttgatgggattgtttgtttttttcttgctaatgtgtttgagtttgttgtagattctgtatattcgtactttgtcaattgtatagattgtgaagattttgtcccactctgtgggttgtctgtttattctgctgacttttccttttggtgtgcaaaagctctttggtttaattaagtcccagctatttatctttctttttattgcatttgcttttgggttcttgcatttttctaaattttaaatggcccaaccattctacttctaagactgtatctcacagatacatacttgtatttgttggggtaggctaaccactcagtgccttaacaccactacaaaagtatatttcttactgaagcactatctaatgcaggttggcaatggggtgagaagggcaaactctcttccaggccgttattcagggacccaggcttcttgcatcttgtggctcctccctcctgtatatccatttagcctggagatgtacacactgaataactaataagataaaatagctgatgagcttaatttgttaccccttctaaacttaacatggttcaaaaagagacttttgaaaatgcttttgagaatctggagacatttttagtggttgaaatcaggaaccaatcattttccctgtgagcccaaaattactccatggaggcaagcatggactatctgattattcaaatggctactcttggcataggctcttggatcagactatctagtttgtaaatggccaactcttagtcacagaaccaggaaacaaatgtaaaaaatagtcaagaaattaagcaaaacctaatggtctacacaaacttttcacttatttaaaacacatccaaagagcactttttgtatatcaagtagtatgttaggtccaattaatattattttggtaacattttaatacaaatggtcaaaatcaggggttagcaactgaaccatggccaaaccaagcttaccatctgtctttgtaaataaagtcttactgaaacacagccatgctcattcatttacaattcgtctatgcctgttttcactcaatgtcagagttgagtagttgtgacattgtctcagaagtttactatctggccctttacaggaaaaatttgctgatgcctgatctaaggtaaaatgaaagaaaataacttattcctgccacaatcactatagcacgttagtgtaggcattatggcttaaccttattatattgtaaaccaatatttacagttgaatggttctataagacagaaatgcatatttgtgttttctttagagctgttttcttcttgtatcagttcatttctgatatcacaattgagaaaggctttgtttatgcattttgaaaacagtatcatggaatgaggaatagctgatggtttaagaaaatatggagaagagtctcataaaagagtaccccaatgcctcaaaattgctcaattatatggcttccttataaaatgatccctcgccattatcccttaggcaatgtcaaatccaagtacacaactcaatgaaataaggaaaattacattcttgctaggccaacactgcagctgtcttcagtttgtgatttaaatgttgatttagaaaataaaagtaacctggtaggcaaggaaattgagattgggtgtttatataacaacccttgacagaaaaatttaactgtcctatttctgttattctttctggcaatgcccagttgaagaggtgatgtgctagaactgtctgccaaagccttttgtgtaagtaaaaataaggttgaaacctggtgcagaatccacaaaatccactgtaggtagaaatgccaatgggaagcaaacaccaccaaatagggatgatcacggaataatgagaccactgtgcccagaggccctcaacaaaggtctctattctgtgaactgtggagctgattgtaccttctgtgtgtccacaatcaccttttctgtgatcttcacacaaaggatggtgacttcccatggagtagggctacgtcttattggtctttgatctggaacatcatctgtactgcctaatacacaagtggccctcagcaaatctttgagatgtgaatggatgcgtgcaggcatattatttaataataagcttttaaattaagctctttctctcactcttccccatatctctaaagagcatcgatcacctttctcccactgtccccagtgtctccagtaatgattttaaaacaacctcaacacttccttactccttcacttcatgctcagtttccagctttcattgatggtctcatagggttgatgtgagatttaaatgaaataataaccataatgagcttaaatcacttcctgacatcttatatactctccataaaacttatccatcaccatcatcatcatcatcattgtcatttttgccatcaccatatcactttgtcctgtatctcccctcaaccctatgtcactgcatcattatgcttgattttaattatagtcatagaacccctacctactttcctcaattcagggcttctcctctattctatctaccacacgtaaaatcaccagagtgaaacttcaaccacagtggctactcctttgttggaaaaacaaaaagcaaacaaaaatcccaaggctccctattgtctactgatcttactatcaaagccattttatatgagatactatctatttcatataaaagaagaaatccatttagtttgcagcctgttctcagaatgcaccacagacttttatttgtttacttgtcttagaacagcaggttgcagattttttgtccacaacctatctgcagtgagaagtacattttacatctcagcccaggaaatgcatgaagccaaacagcttatctttatcagagatacatttggatattctttataatattctctcctatcctcttctatctgattctctttcattttcaaaatatgttttcatgatccactgaattttcttgatttattaataggttataaaccactattcaataacacagtcttggaaggtatatggaatagagaacagggaatcacaaaggaagcaacaaaaatatcagtatggaaaaattagttgatctttgctgtggctctcagggccttgataaggtggacgggaacttctttttccatagggccatggtgatgaacctaaggctagagccatacctgagtatcttatgccttctctctctagagccaaactgagggagtgacacccagagggcttcctacaaggcctcacagctctttcctcataataccaagggttatgcaacctgaaggagatacatatgtggggctttaaggtctagctgcgatagaggattcaacactatgtcaaaaggagttcctatcatcgagtagttcctagtcaatagacagagaaaacacagatgcatcaattatattaaaagatagagcagtggagatgatctgtccaagttgactttggtgaccctttagatagaagctgcctcatccacccactctggtaaaagccaagaatgacaaagacattatcctgcaggttattttgtaattttcttcttggatgctcttcctagcaccccagggtttttaccatgtaaagttctcaagtgtctgctgccactatatgatgctatgttggtgccaagcaggtgtgggattctttaagccatgtgctttgtaccatggtattcacaaattacttcctttatgttctcagacaatatcgttttctatccaaggtcttgtctcaactggtcatatttatacatattcgtatgtcttgttggagcagcaaccactattgcacaagactttggcatcttgaccaaaacttctgtcactgcagtttctgaaatattctggcacctttcaaagatttcaagactgcactatattctcttttgggatcatagcccaaaataaacttgataattatgaagaatatcccatccttcaaacatgaacattttgccttttttcttggtttccccatgggcaaaataaaagcaaatacgtatacgttgaaatttaatgctgagtgtattttttaaccaatcagcctttttaggtcatttggaatcaagccctcaagattacttaaaaattcaactagtgggtgttactagagctttacatatggaaagctctggaagagtagtttaacaggttttcacttaagatagatgtgggcaaactaagctcatgggccatagccagtccattgcctgtttttatatttttattaaaacccagccatgtccatttctttctgtattgcctgtgactgctttagtgctacagtggcagagttgagtagttttgacagagaccttatggcccacaagatcaaaagtatttattctctggatctttacagaaaaaaagcttgccaacccctaatttgaaattaatattatagtaattcattgttattttttatgcagttgttcaactatactattcctgttcatttcaatttcttcattattttaatttcatgatgtagtaattgtgtgctttttaaggatcagacctttgttattcttagatgttttagtgcttatattacagtcatgcattgcttaatgacagattcatactgagaaatgcatcattagatgattttgacagtgtgcaaaacttaatagagtatacttacacaaacctagatggcatagcctactacacacctaggcgatatggtagagcctactgctcctaggctataaacctatacagcatgttcctgtactgaacactgtaggtaattggaatgcaatggtaggtatctatgtatctaaacatagaaaaggcatagtagaaatattgcataaaagataaaaaatagtatagctgtatgaagcacctccattataatcttttcagaccactgtcttatatatggcctgttgaccaaagcattgttatgtggcacatgactgcatatgtgaccaaatattttttcaaggtgagatgagttcctttggtggcattaagcaaaaaataaaagtcaatatttttatgactggtttaaacaactgatgccaccatgcagtctatagacacatgagttatgcattaaatgggtaactttaataagtcaatcttcattacaagttattactttcactattactatcttgtttgatgactgagaagttagcaatattcccttctcatgtcctagaattgcaacacctgccagtgcccaaatcaatactgggaagtagaaataaatcactgggattggcttgaactaagggttcatttcccgagtttggggtgataactcatcccaggatgagttgcatggaggatgagcaactgacaaaatggagcaaggaagaattgcagtgagtaggtggaggggagcaggatagagatggatttagattaaaaactactggtatacggaagaacattgtcatcttctgccattgcagacaagtgatagagaggaaaccattcttattttatttgctttagcgtctagcacagtgccttatacatacctacagcacaataaatatttgaaaaattaaatgagatacattaaaaattcaatcatagcacatttatgtatatagtgtttccatagcatatggaattgttttgaatggctcaaaggataatcaaaaacatggaatggataagaaaaggataggtagtataatagtttcatttaattgcatcatcttttcaggtactgaatcagagagagctgttttcatgggagcaactggcaggaaattctaggcatttccaagactttaacaagtaatgataagactcccaaaatttgggttttaattttcttgagttaaccacctagaatatttattagggaaaaatgatttttgtatttttgttctcctgcctacttcctttcatttacactccaggaatgaaatgtagcttaaaaaaatgacttggcaaaagccattttccctgccccgatatttggaaactcctgtctctacaaatacagtgcctacctagactaaactaaaagtattgtcctccatttaaggactgttcaatgaaagatacaaattcaggagcctggaaggacatactagctcctagatcatgaaaagtcagcagcagagctgcccctttgagacatgtgctgaaagctttgaaaaaaaaatcttctttaaaaaaaatcatataacttgactgtggaaaaatgaaagcaagtaaaagatccttctagggcataatttgatcattagcagttcttacagcaagcagtgattacaaagaacacctagttaaggaaaaaccatagttgagcctttaaagctatggcatctaaaccatgagatcagcttccctacctcatgttttgacggaacaaggagacgtgttcaacaaatcaaatatcttaatgatttttctgtaatagaaaaccacttgctttgaggttcgaggatccagaagttttttttctcctcttgaagatgatatagaaaaattttagaactaatcaccctgccagaataatttacacaaaacagaataggtttcttcttagtgtttaactgaaggcatggtgacctccaagagtcgactttctctacagcagtgagagactcacagaatgttcttattttctgaccacacctttgataatttcaccaccacttcaacatgtaaactgtggggattagtacatttcacaagtactttggggagcctcagccctaaggagaggcatcgctattgcttaagaataccataaaacattttcttctccagggaaacatagacactttggaaagagattttggaaatcctagcccacaaagtgctagcaggaaaaagaaagtgtttaattcactgggacttataccaacaaaagtgaaccaatcaccctgttcctatctgcctttgtctatttcaattaaagttagtggaagaactgttaagtataagttaataagcaaaaactttgataacatgagtttggttaaataaccaacaatctagggtatgaaagatttcttgaagatgacacacgcgcacacacacacacacacacacacacacacacacacacacacacgtatccagcattgcctgaatgatgggaccagtttgggcttgaatacgttttccattattttccatatagattgttttcttccacaattattattttcccctctcttgaaccctggttcccacttaagaaactagcaatccactcctgaatttgcaattttctcatctttttcaccaatagaatgcttagttggtaaagggttggattataaggaatcaaacattaaaagggatagggtaatcagaaaggaaggatgtcctaaactaagctggtggaaacccccaccaaaattcaaagaccccagagagggataacttcatcccttaaggttgaactcaaacattagcctttgcaagcagaactggaagcagtcttctctcttttgtcctggcacctagtaaatgtcttctcctcactgaagcatttcttcatattgcttttttttttttttttgtcgcccaggctggagtgcagtgacactactctgtcgctccggctggagtgcagtgacacgatcatagctcactgcagcctcaacctcccaaggctcaggcgatccccctgcctcagccccccaccccaccccaccccacccagtagctgggactacaggcacgtgccaccatgcccagctaatttttgtatttttagtacagacaggatttcagcacgttgcccaggatggtctcaaacttcttagctcaagggatccacctgcctcggtgtcccaaagtgctgggattacagatacgagccaccatgcccggcctcattttgctttaattaggtttccacatgtctatctctagcactgaattttgaatttttcaaaggcagagatagcattcattcatctgggttcatagcacctagctcagaatctcacctattgatcaatcaaagggtggatgggtggatggatagatcagtgtatggaagatgacatttaaacagataactattatattgtaaataatattcccaagccaagaatagtcatcatgttctatggtacaacatccctgggcagagaatacttgcttaagaatagggaagagatccctgttttggctcccttcctaaatctctgggattcatcccaggttaactcttaaaccagagcattgcattggtcccactgttttccctttcctggtcccactggtttcgctttcctagattactattcctcttttctatcagagctgctatccattccatttcttgggatagactttgaatatgaagcaggcaactcaaagtagaaggagcaattttgaattcattccactcggggtggcaatggcagtaagtggatcctttgtccagcctgacttgtcctcaggtaacacctgttttcctatgtaaacttactgggccaatttaacttatgttgctgggattaatcattagaaagcaccaaacatggagtacaggcacaatgaatggctcccaagtgccaggggtcattaataatattgttacttctttaacaaacctcctgttccaaactggaaataaaatatctggttcagtctttctcttgccttattttttgggaggtctgtggcttgaaagccacaaagaaaagccctcaaagtgagaaataatgagatgaaataatgaattttagttttaataaaggacaaaatatggtattactaaacctttttacaggatatccacagatcatataactcaattcacatttatatgtacatatatatgtaaagagatgttatattttattttaaaaacaatattttggtttacagaataggcattggagcttaaaaatagatttctgtactaatcaaataatcggtgttcatgaatgcaaatgaaaaatactgtctggataacttaagcagaaaaaggatttagagaacctaagatttagaatcttacaacaacctaataagccacctatgaaaaaatcaccagccccataaaaacaaatctggtccatcttgttagctgtccactccctttccagcaaacaggctccaccagaatggcaaacataatagatgtttcatgtcagcttaggcacatgttttctttcagatcaaggagatgcaaataggagattatttcactagtttcagcctggcttgtgagtcacctcccttcttgtcactaaactgagctttcagttctgtggagcacttcagtgagcaatacaggcctccattttctcacatgcttgataagtgagtttccaacctttgcttgaatacatctggtgcctgggagaaaggacttatttttttttaattttggaataattttagaattacagagagttatgaagatagtatagagttcccttatgccccttacccagtttgccctgttaacataataacataacctcaatgctattatggtaacattaataccataaatgtattaccttggtacatttatcacagctaagaaaccaacattggtgcattgctatcaacaaaactatagacttcactcagatttcaccagtttccacactaatgttatttgtctcttccagaatcctattcaggataccacattgcatttaactgggcatcttttcttatctttttatttttatttttcaaataacaaacatttatcttgtaaaacagcttctgtgaatagcttagcttgggtgttctggttcaggggctcctgtgaagttgcagccaagcaaagatggggctgcagtcatcttagggcttgattggggctggaggagcagttcccaggctcactagtatagctttcagctggagacttaccccttagctttttgcatagggctgctcctgacctggtttctcacaaagtggaggggtgcaagacagaatacaaccaaatggaagccacaatgaatgatgctttgttttgaggcagctcattccactggttccatttgctggctagactgtcttcctatgatatcttcctgaattttcattctggcccatggagggctggccagtaagtctcttcatccaccatgtttagtcctctaaataaaaggaaagaaccacaatgtctcctgagtcttctctaaatgctaaacatccattcatacaactgttgactatcagagggtgttccatacctgatcctgccccacccaaggagaaaaaaacagttcatataaagaaatacaaggctatttcctcaagaaacttggcttattcccccatctgtagtcctagaaatttggtagaaagataattatatgcagactcccatttcttcgtaaattaaagaaaattgctattgtgtcccaaagtcagtgtgatacataaaggcttcataatttgtaaacacttttacattgttctgtttaaaacagaaactgagataaagtataacttgagcattgtgacaagtgggaaaatgtgaatgttttgttcacatttacatgatttgggttcatagctgctctctaagttgagttatacatagaccagtggttctcaactggagtaagtttagtccctggaggacatttggtgatgtccagagacatcgtgtgtggtcacaacagtggtggggtgctctggcatctagtagataaaggccagggaatgctgctaaacatcctacgaagcacaggactattctccactgaaaagttatctggccccaaatatcgctagtgcctaggctgagaaatcctggcacagattatatgcagtttctaaagggccacttccctactctgccacccaagtgtatctttttaaatcattttcccctcactttttcattgagctctcctcattgcctatgaatttcattggtttgctttctccgagagtcaattttattggtccaaatacatagtaaggcagctgtggctaatgaaacaggagatggtgccaaaaagcattccttcagtcttttctcagcaggatttttttcaaagctttgaataagctaggaccttccttttaggctagggtaggttcacaaactctgaggcataccaggtaatgtaagtgggtacagtggcccagggttgggtgcctatgctgccttggggcacatgtgaggaatgtgggacccagtgttgccagctcttccactttcctcaagaggctggaactctagatatgtatgtgaactttccaagattttgcattaggacttaactttttataaaactttgtgtgggctaaaaaccacctgaatagtaggggactggatatggccattttgcacccatgaggctggaaatttgcctgtgtgtgtagcagcaccagaggaggtctttgtccccagcagacatttagattcttttccaccctcatgtcatatttcagtgcaggtgatttcctttcctttccagtaatgtaatctttattgagctctgcaagtgaagaaatttaaaagggcttaaacattgatgccatatcccacattcaggtgcacctgtgaattgaggctgtttacactcattccccatgattgcctggatgagaaatgagccttagcgcttcttgcccatcatccagacttctgggagggcagagtctaaatgcattgcacaaatggatgtccgctgttttacaaacacctcctggataggagagccctgaaccatctctcatgttgcaaaggcaaagtgaccttaaagaaggacttccagcttctcctcataggcatctgggttctgctcttagccacacctctcaagacagaactgcgcttattggaaagaacttgaatttggcattgaatgtcagccctgccacctaccagttctgtgattttgagagaatttgcgttaattctctgattttcagttctctcaattgtaaaatgaataaatcaaaatgctatcccaatggatcgtgtgttgacacgtattaggtatatgatataaatatttcatatcattaaaaaaaagtacttcttccagtgccagtgcatatttagagcttggaaattgttagtttttcattcccctccctctctaactctatgttaccttgggcatgccagttcatgtatctggctcttactgtcacatccctgaaataggcaccacatttcctccactacagcgtaaggtagaggttagagcatgatatggtttggctgtgtccttacccaaatctcatcttgaattgtagttatgggaatataatacccatgtgtggtgggagggacccagtgggaggtaattgaatcatggggactgttacccccatgctgttctcgtaatagtgagttcgcacacgagctgatggttttataaggggcatcccccacttcgctctgcaattctccttgctgctgccatgtgaagaatgacatgtttgcttccccttccacaatgattgtaagtttcctgaggcctccccagccctgcgaaactgagtcaattaaacctctttcatttataaattacccagtctcagttatgtccttatagcagggtgagaatgcactaatacaataaattgataccagtagagttgggtgctgctataaggatacccgaaaatgcggaagcaactttggaactgagtaataggcaaaggttggagccatttggagggctcagaagaagacaggaaaatctgggaaagtttggaacttcctagagacagagggctcagaaactttgaaacttagaaagtttgaaagtttgaaacttcctagagacttgttgaatggctttgaccaaaatgctgataatgatatggacagtgaagttaggctgaggtggtcttagatggagatgaggaatttgttgggaactgaaataaagttgactcttgctgtgctttagcaaacagactggtagcattttgcccctgccctagagatctgtgggactttgaacttgagaaagatgatttagggtatctggtggaagaaacttctaagcagcaaaaccttcaagaggaagcaaagcataagagtttcgaaaatttgcagcctgatgatgcaatagaaaagaaaaacccattttctggggagaaattcaagctggctgcagaaatttgcataagtaacaaggagccaaatgctaaccaccaagacaatggggaaaatgtctccagggcatgtcagagacctgcacggcagcccctcccatcacaggcccaaaggcctaggagggaaaaatggtttcctgggcctggcccagggccccccggctctatgcagccttaggacatggtgccctgagttccagctgcttcagctccagctgtggctacaaggggccaaggtatagctcaggctgttgcttggtgcaagccccaagccttggcagcttacatgtggtgttggtcccgtgggtacacagaagtcaagaattgcagtttgggaacctccacctagattttagagaatgtatggaaacacctggatgtccaggcagaagtctgctgcaggggcatagccctcatggaaacctctgctagggcagtgtggaagggaaatgtggggttgaagtccccacagagagtccccactggggcactgtctagaggagctgtgagaagagggccacagtcctccagaccccagatgtcatctatatagcaggaatcatacaggctgcagcctcttcagattggcttctttcacttagcaatatgtatttcaagttcctcttgatcattttgtggcttgctagatcatttcttataatttctgaatagtattccattgtatgaatgtaccataatttatttatgcactcacccattgaaggatatattagttgcttccaaatttttgcaatgatagataaagctggttaaacactggcatacaagtttttgtgtggacgtaagttttcagttcatttgggtagttaccaaggagtgcaactgttagattgtatggctcagctatgtttagttttgtaagactatgcttagtttttgcaacatttggcaaccctattctcaatgagttgcacctcttttgaagaggtaaagaacaagcatatacttcaatgagaaaagccataaaggacatctgaaagtcatgttcattcattcatacattcattcattcacttgatatttgagcacagtcatgtgctagaccctggaaatacaaacaaacattggcaatggaaaaaatgcatgctgtaaaacaaagcaaagcagcataacaagggcagtaggaaaggctccaaatatgcaagtgacagaacaaagatggagaaattttccctgcagcagtttcaagagaggctcagagaggtatgaactagtgaagtaacacattttttacccttctcctacactgggtctgaggacacagctatcgtgaaacaggtgaccccacgcaggatcctacagaaaaacaactaaatcacgtttgtgaaactcagaactacaagctcttcctcatgatttggacaatagatgctttcaaagagtggttatttttcctatattttccttcccttctcttaatggagaattccttcttccaccctgaaaaggaaatacgaccatcagtttcccaaataaaaagagggaaatacatatgtgtataaacggtggtgaccacctagtagaattttaagcctttgtttaaggatattttccccctaaggactgcaatttcctaagttgagtcaacattcagaacttcagttaccattgtcctatgtgagatttgtgtgtcttgtatccaatgtactagttaggtatttctttataggctttttaagatttacaggtgtacctgatcaaaaatagctggaaagatctgagatggtttttactggataatttattccatgtgtacccaacagccaagcacttggcaaatgaccaaaaaatatgattttaaaagccagaatagctcatgcaagaaataagtagctgagagataaagaaaaaatggcaacgttatgctttaatggcaatgtaaactatctagaagggacatttatcagttcaacaagaattaattttcttcactctcaactcctatgaacaagccttctccttctaaaaggtaggaatgtctgccccagtaattaattgtttatgggtaactagtacatcacgaaaatctctataagacatctttctctggcacatattttatctttatactagatggaagataacaaccaagtgagctgtttgttgaatagggcacacttcaaagccaggtatggatatctgatttaatgcgcattagcaggacatcagtgcaattgttgtgtgagtactgaggcaagtaggcaaatggcggggtgaacttcactccttaaaatagtgagctaaacagacgtgaactacctaagttgtttgaatttgttccacatgctcttttaaaatgatataagacaaaagagatttaactggttaattagtgaaaatctagtaacaaaaaatgtctggttaattcatggaaaatgggaactttgaataaatttcaagataacgtttgaattaggccaataaagttaattcttgtgtttgcataaacacaaagattggagaattgctgtgtattcaccatttactctttcaaatgaccattactttatttagtacgtgtgtattgtgcacctcctgtatggctgggaacataccagtttccaaaaataaaattaggactatgataaagtttttacactctagggtaacagttcagtaaataacagccacaatacagggtttgagaggtacagaaccactaaaagagaggaaagggggcacaattttgtttgagaactaacagggtccagaaaaggtgaagaactaggtggtctttgacacaagtcttaaaagagtaagtaggcacttgccacacatagaggaaagaaagtgtagcagacaaatagaccagtcatgattattaactatcaactagttcatcttttttattttttatttttttgttcctttttgagatggagtctccctctgtcgcccaggctggagtgcagtggcatgatcttggctcactgtaacctctacctcctgggttcaagcgattctcctgcctcagcctccctgagtcactgggactacaggcacacgccaccaagcccagctaattttttttttttgtgtgtatttttagtagagatgaggtttcaccatgttggccaggctggtctcgaactcttggcctcaggtgatctgccggcctcagcctcccaaagtgctgggattacaggtgtaagccaccacacccggcctgtctttaccatttacttgcttttcattcctggacaacactgatctcagggaggtagtgagtagaacggtggttaccagagggtggaaacagtagcagggttgacggggataaagaaatgctggacaatggatacaaacatacagttagagagaagaaataagttctagggttcaatagcacactcgaataactgtagttatcatgtatttcaaaatacctagaagacatttgcgatgttctcaacacaaaaaattgataaaagtttgaggtgatgaatatcccaactactctgatttgatctttacatattcatgaatcaaaatatcacatttactccatacatatttacaactattatatatcaataaaaatcatgaagatattggtaactaatagctaacatttattcaacatgtaccatatgtctaaccttctcaccatcattgtttcctgtgacacagtaaccctctgacacagataccatcatcactgttttacaaataaataagaaaaattatttcaatgtgctttgggtgagcagcactgagagagccctgattcacctggataagaatgcaatgtgcggcctggctcaatttgacatctcagagcttttgtactctgagtgcaataaatcaggtgtatgcacagaaatcagggcagacttaagctcctcctaaggagtgagtcaagtattttgtgatttgactggatcaccttaatttagatatcttcacaaagatataagcctaggactccaagatgaaattttaacatcagggaaatgagatggtcctttccctctgctatcaggagaaaccctctccaagaggcagggaggcaaaagactgtttctcttcagtttcagttgctgaaataaaggacttgccactggtctgtgggcaaaatttcttgggcactgtctttgcatatgacctctgaattttgttcagtacatcactgctctaaggatatatttagtgcttttactttgcattttaacattcagctgctgagtgagacaatattaggagacatgatgctcttgatatcagccattcttcaaagcgggtgtttattatggaataaaagaaaatacgtgcttcagtctagaatttaaaagcactaactgcaatttttcaagcatatgtatgtaaattaaagttacctgtcttaccattttcttgagaaaagtgtatctttacgtttgttttagtgcgacttgtttctgatatcctaacctaaaatttcatggtcacaaatatataaattaaacgttatcttaatgaaaaaataaaacaggggctatagcacaagagatgtgaggaaaatagtcacacacacacaaaaagtaaccaagagtgaaccctgaagtaatctatggacttggggtgataatgatgtgtcaatgtaatttcatggagtgcaacaaaggcaccactctggtggggtacatggatagtggggaatgctatggtggcagaacagggggtaaatgagaaatctctagaccttcagatcaatttgttgtgaactaaaaacaattctaaaaaacaaagtcatatatatgtgtgtgtgtgtgcatatattcacatatacgtatatgcatatatatatgcatattatctatatacatacatgtatatgcatatatacatacacacacacacatatatacgtatatacacacatttatacacacacacacacacacacacacacacactcctaataacttttaaggtcaaaaactttcttcccttcagaatatctgccagagtgacttcaagtacacagttactcatttgaggtactaaggggtgacataaatatcaacttttggccgggcgcggtggctcatgcctgtaatcccagcactttgggacgccaaggcaggcagatcacgaggtcaagagattgagaccatcctggccaacatgctgaaaccccgtctctactaaaaatacaaaaattagctgggtgtggtggcgtgtgcctgtagtcccagctactcgggaggctgagggaggagaatcgcttgaactcgggagacagaggttgcagtgagccaagatcatgccactgcactccagcctggtgacagagtgagaaagactccttctcaaaaagaataaaaataaaaataaatcaactgttccatcactaaataccttgtggtgtctttctcatccttccactgtagaatagtcagatagcccagtatgtataatagaactctcacatggacctctgcagtgcttattttgcctctgtaactactgaaagagatctcaaataaggatcttcttagaaacttgaagtagtacttagacttacacatcaacacatgctttgggtaaaaggaaaatcctttatgaaaatgcaagctttaagaattaaatgctccccataaggattcacttattcctgtataagtgactgtaggcagaaaaacagaatctgaatgaactttttttttctttaacttggaaaaccttgaaaagataagagtggtatataggggccaattaaaatgaaaagaacaagggaaaatgagagtaagtctctcctctcctcccaatgagggtattgtgttctgaacaattcatgaatggaatttcagaaactcagcaaaagaatacatttaactgacttattccaaatatattctgaatttcatatttactaaagtgtttccaaatgaacattttgtatgttatgtgcaaaaactgcacattaaaaaggaaaggtaagagagttcatcatacaagattttagatgcatgcatacttaaactaacttccacatactccacaaatactaaacttaaaaaacaaagcaccctacataatttaccttgccatagatgtgaagtaattgttaagcatacataaatgttaataaaatactttgaatcaatgctgaggggtggtatcattgaatggtggaccaaaacaaactaaatggcattttgatgtctttggaaatgacatacccacaagccaatggctcagcactgacatttatatatcctgctcagttgtctcaatcatttatagtagtttaatttttttcaagaacacagatgttaaggtaagtttaataattttgaaaggccatagagtatatctattttttgaagtcatactttcattggaattgtctctttaacctaatgaataaatacaaagaatgcacagataaaataagttttgtcttcttttattagagaaaaatgtactgttccatgcctgtgctttctacagttttggaacggatacagatccacagaggccaaacctaaaactaaattatctttaatgttaaaatttaactgaccatgtatataactgtgcaattgctgctttctcacagaactgtctagggttcattcaacagatcacagtaacgaggtctggcatttaacaaacaaactaatgatagaggagatacactaatttatacgagaattaactaaatactgtcatgtggtttagtgtagctcaagttatgcttgtatcatataacataggttcaagttttttcatcagccatcagaataacagtggttaaagagacatctgaataagtgccaactcttactgcagttgtctcaaaaaaagaaatttaagtaattgcaatatacatttctacaaataaaatattccagtgcttacatcaatcctgagtttttaagattaaatatgcagtacttatggtctccgacacaattttattttggaacacggtgatgtattttttaagttgactttcttcaccactttcttcaccaaaaagagggctttcattatactcttccaagtcctcaatactctaaaacaaaaagtctagttcactgacaaaccatcactttacatctcaggttttaaacagggtaaattagatgtcaaaggaaacagcttttaatattcaaaggatgctggttatttatttcaaatttaaaaactgtaatcaatacatggagctccaaatacttaaattttttaattccagatttcagtgaaatattattatagcaggtccaacagtcatgtagtttgcttgaataaaatggcttgatgaacatgttacagacaagatggaccaaagacagaaaaagactgtcagtcttatatcatggaataccatattttttcaccaggtagtgaccatttgttatcactaatagtccacataacgtggttttcattgaagggataaaatggtctgtgatatgacctaatcaagttggggaaaacataactacgtatgaaacatatactagtccctcaacaaatagttcagcagttcatagtccctaaaatgttgtatgttaatactgaggaagacgtaaaaaatgagtacacaatctcttccgtattcctgtgacatgagcaaatgcacgaataaaaaaaaaagtaatacaaaacttgtgttactgctatggaagagcaactcactcggacatgtagccaaaaatggagactgatgtcgacttagttggcacaagatttcaatcagtcaaaaaaaaaaaaagaaaaaagaaaaagaaagattttaaaagcatttggagggaagggcatgagcaaagcatgggagtaacggtgagttccttcagggaaggctgtcaatctggagagttgggaggaaagacagagggtggcaaaacaagcctaagagggggtcatgtaaaggggagagtctctgaatatctaagaactgagacatgggcaccactgacaggctgggaagagggaagggctaggaagcattttagaaaggggagagtgttaggaagatagtattgcccatcagtgaaggatggctcagaagagaagagataactcagaaaagagcttaataatacaagcaaggaagaatgaggtcttgaactagggcagcctcagtagggatttaaagaaagaaattaaaggaccattacagcggtaaacgtgcctcgcaataactgcatgggaaggataatggactcagaggagtccaagatgataccaaagtttctaccctaaggggtaacatgtagcattaacattgacaggataacttttctagtttaatgttcataccaattaataaatagtttctgaggaacattatagcaacatgttctcttctcgtgacttctatgtaaataactgtttgtgtacagatcatccttaagttgcttgaaaattttattttcaaacgcttttcctagtttatttaacacatctcagttagtgtagaggagtgacatatgagcatgtcttttcacaaggttattaaaaagaatacctcccaaaagaaaattacattgtttcctaaataatatacatctacatgaagaagaggtcattgtccaataacgattagctaatatgctatatgacagcagataattcacaattcacaaagtgttaataatctgctggctttcacattctgttatacatctgaaccatctcttatgattacaaattttcatgtaaaaccattactagtcactaatagttttgaaagggaatatgccataaaacactcctacattccagcaggaaataaaagagatactcagtagtcaacacttgcctacttcctatttaactaaaactgtttaaacaagacaagtaaaaaagacatccagtaaggatttatggacttcctgcattccactaaagatctgtcgctgatctcctaaaaactgaatatgaaatcttcattaatgtattcataaagtatcaattttatacacaagatttatatttccaggtaaaatttccaatttaccttttcctgttttaaataactcccacaaaactattcatgaatcctaaaaatacacttaccaattatgttaaatctggaacaatacaaagtgaaaatggtaagtaatttataatgtataaccaaaaggtctgtccacttggaaccaacccaaatgtccaccaatgatagactggattaagaaaatgtggcatatatacaccatggaataccatgcagccaaaaaaaaggatgagttcatgtcctttgtagggacatggatgaagctggaaaccatcattctcagcaaactatcgcaaggacgaaaaccaaacaccgcatgttctcactcataggtgggaattgaacaatgagatcacatggacacaggaaggggaacatcacactctggggactgttgtggggtcgggggagggatagcattgggagatatacctaatgtaaatgacgagttaacgggtgcagcacactaacatggcacatgtatacaatgtaacaaacctgcactttgtgcatatataccctagaacttaaaggataattaaaaaaaaaaagaaactctcggggccaactgaattttataaaaatgaatttgttgtttggtgaaaaaagtaaaaactataaatcctagaagtcagttaaaggatacctgtaaagctctgtggaacaaatattaataaagtcaaactgatcaaaaaaaaaggtctttccatacattcagaaacaagcagactgtcttctatttttgttcatgagttgtattttataagaacgtattgtgttaccaaatagaacagacctttgtgaattgctcatgtggcggctcaatctctttcagttcctttcccatcttgttgccgtctcttttgttgctcttgaaatattctctagaagcacaaaactaaaaagtgattaaaatcggataaattttaatacttacaaaacataattctgcattagctttaaatggatactctttaaatcaatacttctgaacactattagacaacatttatgaccaattttaaacagttgtgttcaccactcatatgctaaaacaacataatctttctcatcagtcatggagtaaagaatattctttcttatatatattcaacatgtatgtcctaattcttggtttcaaatgaagagtatttgatgacccttcctacaatttgttgaccacagatagttaatttctaatacagatctttcttacctaagaaacattcttttttactaagattttaaacacttggtcatttcagtatgcacatagatgaaccttccaacaatgattgcctttctgcaccttgacctaatctccaacaacagtgttctcctctcctctatgtggcactcactcacacagtcatcccctagattttgtcattcccaatggctgcaacatctcccgtaataataataatagcaatgatagcaacgataaagagcaaccatgggtgagatcgcatcctgaaaattttaaataaacccattacataagaaccctttaatccttcaaacaactctgaggtaggtactcttaccatgtctcctttcatagataaggcaactgaggcacagagataaataatttgcccatatttccaagctagcaatggtcaaactggagttggatcccaagcaatgtggctgcagagtcccagcccctgaccactccactcagctatttctccatcttcccaacatacacagccactacctccctgtcactgtaggtcactcacttcagtactacagctcaggaatctgtagggacccaacacccaatggatggagcacttttcactgcccaatgcccacccccatgtgctccggtaactcagtcccagctgaaattccacagccagtcatcataaccgccccccctccaccaacatatatgccctgcccaactctccctctatcaatgtgctcagctacaccccaacccaggaaattccaaccctaaagttactcttgcacaaatatgccatctgggctgactttaacttcttaatccctatgacactgacctcagttggacccctaatgctgcatggcaattatattcccctagtccatgagtccactaatgggccccgctctctgggttcatgctctcttccttctttgctggatttctgcatgaaccattactacctgagacattgatacaataggttaattgtaaagctaagcctgataccaacaattagttcttctccttcttctctcttcttcatctttctgctcacctgtgatgtattcttcaagggtattcggctccttcttctttcttcttcatctttctgctcacctgtgatgtattcttcaagggcattcagctccttcttctttcttcttcatctttctgctcacctgtgattcaaggacagtcagcaacttcagagaacgtccataactacatttctgcctgtaacacataataagtaacacggtcatatgtcatagagagatgaaaaattaatcctattcaaaccaaaactgacttcacataatttatactataaagtagcaagggagtaatggcagctgaaatcttctttttgggaaaaggtgaaatgagttactgtcattctgaaaggatcccttcctaactgactactagagcagctatcttacattctttatgtgctgaaaacaaaggagagtttactgcactataaatttcccagaaacaataattttctctaacagcagtttacttttcatttcctcaaactaaataacatgtgggttctcataagtaggttcaagaatatcatagccattcatcccgtaagatttcccaaaagaaatacttcacttaactctctctccactttggtacaacaatgattttctaaaaggaatagtgaaaacaatttaactaaaatagataacctatttacgacataaggttgtccctttctacataacttaatattgttaaggatctacagactaaacgttgaagacatttatcttatatgcagctgccatatttctagaaatggataaaaattaattttacaggaagactatttttatctggaaggcaaaaagaggtcatcttcattggctttctagataatatacctcaattctgttaaacttaggttataaaacaaagaaacttacctgcttaaggaacaatcaagtaaacatattgttcactacagacaccaatatgtacaagatagtttttgaaattatttgcaccaatgaatacaaagaaatgatagaaatatccttattcaaaaaagccaacaatcatgcatttttagttgtattgttctcaaaatacgtttaattttgttgtttgtttcgttgcaagcttttgcaacgctttcaatcctttttctctttgcagcaagaccctttttaatgtcagctagacagtaaatgaaaatgcattaaaaattaatgttgaaaagtagtttatttgcagatattgaaatcaatatgggacatgatggttcagcaatatcagaaggatatttaaaatgcaaaatggaaagatcgtttcaaaaaagtaagatttaatccttttctgtaaaacctttcaggtattaataatagttttccaattccaattggtataacagcaaatcacttaattgacagatgatgaaaaaaagcaaataattaaaatagtttctattttttaaatgtgcagaaagggtaacaaacacagactttaatttctacatcataaaatgtccaacagttcaaacgacatgtttccatgaaatactgtcacaactcattaagtaaagcacataaaagtaagaccatcaaaagggtagacataacataatacacaataaagtatttttaagcaatctagtgattgatgctattaactgtattttaataaaagaagcaatgtccatgggtataaaaatttaggtttaagtagataaagaaatacacttaaaaacacgtttgaaatattttctgggagctttttatatgacatttttatccacaatgctgtttctgaaaactgtattactgcaaggaatgctttcctaaacatagtttcacatcagagatccaccatcaattgctaagaatagttttctgcagtcataaaagatctgcaccataatacaaatattttttacatacagtatccatctatagtggtcgatgtattaggcagctcacaaaaccagcactttgtcaccaccaagcagagcaaagctttccaaatatactgcttatatgaattattgctatagaagaactgaaaactaaagtaagctttttaaaaataagagtgttgtctccatcgtctctacagaaattttctcaaacttttttgaataaatggtcctataacagtcagtacaactaatatttcacatggcaatataaagtttatgagtttttggatccaattaattacatgtttctcactgggtagaaaagttgtctttacttttctactacacagtttattactggaataataatagaaaataatcattttagagaattcaattttttctcatactttaaagaaaacaaaatcagaaagctgtgacaatagaatagctaaattaggaacatgaaaaactcatattaaaaattctgagtacatatggacaggaagaggggaacaacagacaactgggcctacttaagggtggagggtaggaggggagggtgaggatcgaaaaccacccatcaggtactatgctataacctaggtaacaaaatacaaaataacaaaataacaaaagtatctgtataccaaaccactgtgacacgcaatttatctatataacaaacctgcacatgtaaccccaaacctaaaataaaagctaaaaaaactgatatgtgacttaatgtgtgtacactaaaaggaacgaatagagctgtttctcctccagtgtcctctaatatcccccaaacattaaatttccacgtgtatgaaagaaaagccatccctctcacttgcccattattagaagcattctcacattccacatcaacaataaaaaaggaagtaatacagatttatcaaacagactatgttaaatgctatatatgagaagaaggcatttaagacagtcttgtccactaattcgtacagcctattgtaacagttgtatgattgaaaacaattttcataaactacaaatagctcctaaaacatacctgcaatatcttctagcttctggatatcaaccctgtaaaaaaaaagttacatcagggaaatttatagcactaaatgcacacaggagaaagcaggaaagatctaaaatcaataccctaacctcacaattaaaagaactgcagaaccaaaggcaaacaaatgcaaaaactagcagaagacaagaaataactaagatcagagcagaactgaaggagaaggagacatgaaaaactcttcaaaaagcaatgaatccaggagttggttttttgaaaagattaacaaaatatatatttaggatagttagctcttcttgttgaattgatccctttaccattatgtaatgtccttctttgtctcttttgatctttgttggtttaaagtctgttttatcagagactaggattgcaacacctgcctttttttgttttccattggcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgcttgttagtcgatgcagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttggctgtaaagtattttatttctccttcacttatgaagcttagtttggctggatatgcaattctgggttgaaaattcttttctttaagaatgttgaatattggcccccactctcttctggcttgtagggtttctgccgagagatccgctgttagtctgatgggcttccctttgagggtaacccgacctttctttctggctgcctttaacattttttccttcatttcaactttggtgaatctgacaattatgtgtcttggagttgctcttctcgaggagtatctttgtggtgtaaaacagcatggtactggtaccaaaacagagatatagaccaatggaacagaacagagccctcagaaataaggccgcatatctacaactatctgatctttgacaaacctgagaaaaacaagcaatggggaaaggcttccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcagtaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccggaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaagtaccatttgacccagccatcccattactgggtatatacccaaaggactataaatcatgctgttataaagacacatgcacacgtatgtttattgtggcattattcacaatagcaaagacttggaaccaacccaaatgtccaacaatgatagactggattaagaaaatgtggtacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggaggggggagggatagcaatgggagatatacctaatgctagacgacgagttagtgggtgcagcgcaccagcatggcacatgtatacatatgtaactaacctgcacaatgtgcacatgtaccctaaaacttaaagtataataaaaaaaaaaacaaaatagactgctagccagactattaaacaagaaaagagacaagaatcaaatagacacaataaaaaatgatcaaggggatatcactactgatgccacagaaatacaaactgctatcagagaatactataaacacctccacacaaataaattagaaaatctagaagaaatggataaattcctggacacatacaccctcccaagactaaactaggaagaagtctaatccctgaatagaccaataacaagttctgaatttgaggcagtaattaatagcctaccaaccaaaaaaatcccaggatcaggcggattcacatctgaattctaccagaggtacaaagaggagctggtaccattccttctgaaactattccgaacaacagaaaaaaagagactcctccctaactcattttatgagtacagcatcatcctgataccaaaacctggcagagacacaagaaaaaaagaaaatttcaggccaatatccctgattaacattaatgtgaaggaaataagagaggacacaaatggaaaaacattccatgctcatggttacgaagaatcaatattgtgaaaatggccatactgcccaaagtaatttacagattcaatgctatccccatcaagctaccattgactttcttcacggaattagaaaaaactactttgaatttcatatggaaccataaaagagcctgtatagccaagataatcctaagcaaaaagaaaaaagctggaggcatcacgctacctgacttcaaactatattacaaggctacagtaaccaaaacagcatggtactagtaccaaaacagatatatagaccaatagaacagaacagaggcctcagaacaatgccacacatgtacaaccatctgatctttgacaaacctgataaaaacaagcaacggggaaaagattccccatttaataaatggtgttggggaaactggctagccatatgcagaaaactgaaactggatgccttccttacaccttgtacaaaaattaactcaagatgacctaaagacttaaacgtaagacctaaaaccttaaaaaccctagaagaaaacctaggcaataccattcaggacataggcatgggcaaagacttcatgactaaaacaccaaaagcaatggcaacaaaagccataattgaccactgggatctaattaaactaaagagcttctgcacagcaaaataaactatcatcagagtgaacaggtaacctacagaatgggagaaaatttttgcaatctatccatctaacaaaaggctaatatccagaatctacaaggaactgaaacaaatttacatgaaaaatgacaaccccatcaaaaagtgagtgaaggttatgaacagacacttctgaaaagaagaaatttatgcagccaacaaacatatgaaaaaaagcttgtcattgctggtcattagagaaatgcaaatcaaaaccacaatgagataccatttcatgccagttagaatactgatcattaaaaagtcaggaaacaacagatgctggagaggatgtggagaaataggaatgcttttacactgttggtggaagtgtaaattagttcaaccattgtggaagacagtgtggtgattcctcaaggatccagaatcagaataccgtttgacccagcaatcccattactggatatatacccaaaggattataaatcattttactataaagacacatgcacacatatgtttattgcagcactattcacaatagcaaagacttgcaaccaacccaaatgcccatcaatgatagactggataaagaaaatgtggcatatatacatcatggaatactatgcagccattaaaaaggttgagttcatgtcctttgcagggacatggatgaagctggaaaccatcattctcagcaaactaacacaggaagagaaaaccaaacactgcatgttctcactcataagtgggagttgaacaacgagagcacatggacacagggaggggaacataacacactggggcctgtcgggggtggagggctaggggagggatagcattaggagaaatacctaatgtagatgatgggttgatgggtgcagcaaaccaccatgacacatgtatacctatgtaacaaacctgcacgttctgcacatgtatcccatataacttaaagtataataaaaaaagaaaaaagttacatcaaaattttaacataatgctacacaaaatgccatgtttgtttaagaagaagaaatgtcttatgtgaaatggtgaaatgttctgcatagaacagtgattatatgatccaaagctgacttctctgcctcccagattcaagcaattctcatgcctcagcctcctgaatagttgggattacaggcacatgccaccacgcctggctaatatttgtatttttggtgagacagggtttcaccattttcgccaggctggtctcaaactcctgacctcaagtgatttacccacctcggcctcccagaatgctaggattacaggcgtgagccaccatgcttggctccaaagctgatttttcttagaagacgttatctgacaggcaaaactgacttaaacactttaccccttgtcttccgcatcgatttcagcaaaatggtctcttttccgctgcttatcaattgctggagtctttcctgcattaaaataaaaaagacacaccttttttttttttttaagaggaagacgctgttgtggacatttttttgtggagaaatgtactatttgtggacccttttggctctctgcccattaaagctttaaagcagcgctatacatggaatcactgggaccctgaccattttacagaggcatttttgcaagctctttgcggtttaagtcccagtaaacaaggcactacgtgtcagatcccttggacgtcaggaccgcatccatcgagaagagctgctctaagagtatctgtaaccctggtatgagggagaacctcccatgggaaacctaaggctcttgagcctgctttgaaaagcttgggcatcttagcacgtgcaaggtgaactccaaagcaacataggggctgggggcctcgggctgactgtctgctgcctgtgtgccccccgcgcagagagcagacaaaccgtccccttgggcgtgcaccttcttccggctcccctggactgtttttaactccatgctccatttcctggttggccgtaacctgagcctccactgggtgaggccttcgcaggcttctccatgagcttcctgcccacgggctccatggctggttgtcctcggatgttagaggtgactcctgaaccttgtgagtgcaaagatacagtaaggaaacagggtgtgtgaaaggagagctatcgggatggtgggttcaagaagcgtggggctggcccgccccgagtctcctgtgggagcaggagggatcgcggagaatatgtcagcatcccctcctgtcctggcctgtacagcctgtccctggggctggccgcagagctcgcagctgccgcgcacacctgaactccgcggcctctgggggatcctcgcggagccattgagacagagctcggccctgctcctgggtcccccagcgaccccgtgtggccggaagagctgtgggatgacagaggatctccccagctatctcagtgggagtcacccggtgtgcacctgtttcggacaatcaagggtgggcactgctactcgcccgcctggatgcccaggggacctccggtgaccccaagtgtcctgtcctgctgggcagccaggcaggagggacccacaccgactccccaacccctgcacatatgcacaggcccctggggctgctcctgggccctgggaaccacctgggcagctccagctctcagccctggcccaccccggcctgccctcagggccttgccctgattcaggccccagacaacgacactggggccatttcctcacaggtcagcctggggcagcccggtgcttcacacggtcatccccaaagggcctcatgccggctttccccgcctccccaccatgggcacaacacctgagggaccccccacattgctccctcagtggacctgcagacgctggcaccacaaggctcctctgagggcctgggtcctcggttctcttgagagcagccagcctgcctgcccgcactcctcgctgattggtcgactcagtgcacatgtgggtggtgggccgctggggccacgccccctgcaggcatgccctccccctcagggaccacccatggtagctgtggactcagggagagggtggctttctgaggtctctgtccccacgatattccagctcctcatcctggcaaaggaagcaaggacccaggagtggggagtgccaggggaccctgccctaaggaatggaggccaagtgaacggggcctaggaccttgcccccaggctcgttccagccacccctacccctttggatgcaatggccatcaccctgagggtggagcccaggctccctcccatgccctgtgtgcttccaacatgcccaactgcattctttttatcaatggattgtgcttttatgttttatctaacaaaattgaagttgcctttggagggtaaaaatatatatatgtatgtgcacacacacacgtgtgtgtgtgtgtgtgtgtgtgtgtgcttaagcaaaggttttccttttatattcatagattacattgcagaggtataatggcatactttttatattcatagatattttatatccttttatattcctttgtatttccttttatattcatagataaattgcagaggtataatggcataaaatgggcatatttaagcctttgggtacttcagttagagaatattcctaaggcaagaattaagatgtattcatgcatcatttctctttataattctgttgtcaagtattatagaaatgtttgtcggtttcatttttatcaccaggaatgattttaaccaaaagctttcaaaaaccctttaattttgacccagcaaaatcaaacatttattcatgtatttatttatataagtttaagggctacgagggcaattttggtacatggatctattgtgtagtggtgaagtctgggcttttagtgttcccatcacctgaataatgtacattgtatcctttaagtaatttctcaacactctcccacccttctgagtttccagtgtctatctttccactctctatgttcctgtgtacacattgctccgttcccttataagtgagaacatgcaatatttgtctgtgttttacttgtttcacttaaaataatggtctatagttccattcgtggtgctgcaaaagacatgatttcattctttttcatagctgaatactattccattttacatataaaccacattttctttatccagttatccgttgttgggcacctgagtgttgattccatatctttgctattgtgagtggtgctgtgataaacatatgagttctggtgtcttcttgatgtaatgatttattttcctttgggtagatacccagtggtgggattggtggattgaatagagtgacatatgctggggagaaacatttagtctatagcagggagtcaacaattttcttagataaaacataaaagcacaatccattgataaaaaggatgcagctgggcgtgttggaagcacacagggcatgggagggagcctgggccccacccacggggtgatggccattgcacccaaaggggcaagggtggctggaacgagcccgggggtgaggtcctagggcccatccacttggccttcattcctcaggacaggattccgagcactccccattcccggctccttgcttcctttgccaggatgaggagctggaatattgtgggaacagaggcctcagagagccacccttgccccctaggtcctcagctaccatgggcatgcctgcagggggcgtggccccacacggccccactacctgcatgcacactgagccgaccaatcagcgaggagcacgggcaggcgggctggctgctcttgcaagaacccgggactcaggccctcagaggagcctcgtggtgtcggcatctacaggtcctatatatatttttttatttaatctttattttatatatatatattttctcaaagtatgtaattttgtggctgaatttaattttatctttgtgcatagaaatctatagacaatcataatgcagggacactttattagcatgacctaacctttgaaatcttgtctaggtgagtcacgaatttagttcattatcagtcagttctctcctagctgggaaacgttcatgcagacacacatggaactcaattagactgggtcagtgtgatatctgcaggggctctagtgatgtgtgaaacacacagggagacggagatctaattttatgatcttcactgtcaataggagagaagaaaaggacttctgaataacatcaccgtcaactgcctcacaaaatctctgaaagcagtgctctaggagttacagtgattgcatcaggagctgcagttttgggggcaattgagaaggaactcctttctctgtataggctgcagagttcctgaaacttctccccaattagaaacatagaaaattattagccttacttaccagtgccatatgacctgggactactcagaggaaagggctgattagttaaagaaaatatgtctagaaagaaaccaaagaacattactcccaaaaggcaccttcaggaatccaactataacatttttgggtagattaatatataatacatatatagtctaatattctaataatatagtaaaacggatgaggtttagaacaaattaggagacacattctgtgtcagatgccaactgcatctgcaattttgggcaaggtaattaactacctggagtttctgctaaattgaggttggcaggggcactgggttgattaatttgatcttgaaagtgccatgaggtcatggactatcttcttatctttattagggagctatttcttacatttataagactcctttactaagttaaaggtgttttccttcctctaccatatacaatttttaaaaactgttcccagctgggcgaggtggcgcacacctgtaatcccagcactttgggaggccaaggtgggtggatcacgggtcaggagttcgagatcagcctggccaatatggtgaaacctgctatctactaaaaatacaaaaattagccaggtgtggtggcgggtgcctgtagttccagctactcgtgaggctgaggcagaagaatagcttgaacccaggaggcagaggttgcagtgagctgagattgcgccactgcactccagcctgggcgacagagagagattctgtctcaaaacaacaacaacaacaaaactgttctcataggccaggcgcagtggcccacgcctgtaatcccagcactttgggaggccaaggagggcggatcacgaggtcaggagattgagaacatcctggctaatacggtgaaaccccgtctctactaaaaatacaaaaaattagccaggcgggctaattagtgtggcgggcgcctgtagtcacagctactcgggaggctgaggcaggagaatggcgtgaacccaggaggcggagcttgcagtgagccgagatcgcgccagtgcactccagcctgggcgacagaggaaactccatctcaaaaaaaaaaaaaaaaaacagcagttctcgtaatttatctctatttctgttttgtatttgaatgaatgacacttaattcatcgagattttttaaagagcattgcagaactctcataagatgaggctggttgtatcatttataaaatatttacagcatctcagagagctctgaataataaatgacttccattcaaataatagacttttaacattttcaaactcggcttttcagtagatatcaacactctcaatctcattccatttgtgagtctactttaaaatacctttaatcaaatgtgtaacttaatagttctattgatagaaatataatttttctctatatgttttgttttgtttttcataataatagtagcaaaagatacaaaccaaaatcaattttctagattaatgttggaatctcctggtttcacttttgagaaaccactcctagtctaaaatgcattattacattgtttgtaatgatatttaaaagctggaggaacataaactccgcaataactgcttcatttttaaatttgacccatcttcggtttgtggaacgtgtctgaaattgcacagctgtttttatttatagtctaactggggaatttcacttgtgaaagatgctgtaacaaaataaatgtccctgtgtccgttgcattctgtggcattctaagccaacaaaatgtcaagaaataccattcaaatcctttcagctacaatgaggctgaattatcattcttttcaagttcttgtttttgagggactgttatagcagaaattcacatgcaaaagaattgctttaatttatgtaccatgctactatttttaacttagaaaaaaaagtcagactcctctttggacctcaatactgacaactttcatcagtaataataggctgtactgttattctgtactacctttattcagcaggaataacaggctgtactgatggatgtactacagtgatgcaaggactccagtaaactggcaggcagtgaagaggtatgcttcaggagtgtcacaaaagtggtgatgactttgcagagaacagagccacccgtttatcggcctgcctctgcttaatgcatgttgctcaaatgcctctatgaaaatactgccccaaatacaaaactatactattggactgcccttcctttataactttgagggatggtcattgccacttgctaattgccaagctctcttacaaagtacatattcaatttatttccctgcctgcaactgtatgatgtatagttgtttccaagaaatgatgactaagaggtactgagagatttttgtcattttttcttcaaaaaaagtcaactggtttcctgctcattctttccatttaagttggccatagaaatcccagtggtgaccctcaggttgtcaaaggcctttcttcttgttgctgtgaggttggcctgctgatagtaacagatacaccccactcacaattatttcaggatcaagtagatccattggccatggagtgatggtcttttcaagtaaggctattttgagaggtaataaaatattcatacacttaatttttcttttgtacttgcttgttttaaaatacagttctgtacataaatatttttgacaagatgagcaatagatctattttttcacattataaaacaaaattattataaagataagtcaaaaatgactaagtagaacattctatttggttattaattttcactggactttcaaaacacttttctgtataacatattcatatattttgaattcagcagtgcagtcagatgtttcatgtaagtggctgggcacagtggctcacacctgtaatcccagccatttgggaggctgagacaggcagatcatttgaggccaggagtttgagaccagcctggccaacatggcgaaaccccatctctcccaaaaacgcagaaaaaattagccaggcatggtggcacacatctgtaatcccagatactcgggtggctgaggcacaagaatcacttgaacccaggaggcagaggttgcagtgagcctcgattacgccgctgcactccagcctgggcaacagagtgagactctgtctcaaataaaataaaatatgtaagtgtaacatgtaagagtaaacataatcttacgtagtgattatctgaattattttttctttacttttattctacatgggtattataaagagttgtgtgttcataataaaggctcccttttctacatagttggtcttcccttcttccctcaacattttaaaaaaattctacagaatttacacaatcaacattcttccttttaagctacattattaatttctccccaaaagaattacagtttttcagcagctgggaaatggaaccaaatgatgtttaattctcccagcagtgaggtgaggaaacatgcacagagcattgctgcccagggagctcccccaaccctggcatccagtatggttttggggcgtgtagtcatggcagactgtctgcatgactgaactcagttgccagcccctccagaggtcaagactgatacaggtggcccaaagcttccactataaatcacattgttagcattaactatctagcataactcaaagctccaggtaaacaaagacattattatcaggcaggatattccaagggcttagaggttatctcctggaaggctgtcaaagagcagatgttctttggaaagtgcagggtttggacaacacagatctgctgagctaacctactactgcactcttattcagctcttattctgaattctctctctctcttcctaaaatgtgcagatccttacggatggatgggaaaatctgggaaacacagcactcactgtaaacacaccatgcctagaatttggctcctcttcaacaacccgggcttttgaactgggtcgaagtcactatgccaggatgacatttttttacgttagaatgaattcccccctggtggctcctcatcctccaggtatacaaggctcctggatgacccatggcctccacggggcacaccacagtctgaatcacagctgattttctggattgcccttggactcagcaggatgattccacatcttccaaattctagatatcctgatatcgcaatattttttatccctgtttcttaatgaaagggtaaatggaggtagaggtgtttctcaacaacctgcaacaacacatgtttctttcaattattcagtacttaattggaaatcaaagcccctttctaatgtatcgataacattgggaattgatgactattgtgtagttgtacttaatctacaccatgctaattcctaacatgggctatggaggcagcagagcggcaggtgacaacatatgcacttctctccctctctgcccaaagctcctggtaactgtcaaatgagcagaggacggggagacaataggaatattttaaaactgtggttttcaggttgggaatatattaatatcatacaacctaattatttccttactttgtctatattgttgtatattacccaagcttcagagctgtcagagcaaacctcaaagatgaggagccagctggcaggtaaaaagcaaaacaaaaacagcccgttgctcaatgactaggatttttagttcaattacatttccttgccatctaaatagccagatgcaatgacccatagatagagccagtgtagaacagatgcagtgacccatagatagagccagtgtagaacctaacataataatgtctaaaggggttagtaattgttctactcaatttgtttcagccattctattggaattcctattaattggaattgatggtaagtatatggaatgtcatgtagtgaaacaaacaaacaatttagagcacaccaagtttcatggacaacaaataacaaatcactttttaaaaatcaataccaaccaggccaggtgtgatgactcacacctgtaatcctaacactttggaggctgaggtgggaggattgcttgaggccaggagttcaagaccaacctggccaacatagtgagacccccatatctaaaaaaaaaaagaagaagaaaaaaatgaataacaacgagtacagtgagatcaaagaacactagctaccatctacccttggtttaatactcttgagaaggctggcatatgtggagtctctccaggaagacatttgaggcagaaaaccagaataggggcaggaaatgtattatttcatcatctgaaatggggactttattaactctcctgagtataaagtcaagaaagaaggtatttttcaggactgtttaattaaatgtcattctgtttatcaaaacagagaaacctggcaggcatttctaaccatatgggatttttggaaatacatgagaaacatgtgattacgtgtttagctgaatattatttaaaatgtatgcaaaatcctgagagggcttttgaactaagttcctaaaatcatcctctgatgcatcctatttgatatgctgctgtgtgcctaaaattattccagtagaaataaagcagagcctcaataaaaccagccccttttaatgagctgcttcttgtaattataattatccataatcatttattttgactgtaagtaatataacaaggcaaaacctataattttctaaagtaatataatcaatataaaaacaaaggtgtttcatactactaacggaagataaatgtatcctgcaagctgaatgttggcagatcagcttgtgctcttctaaatcatctaaatatcatcagtgcctttgattacagcctcgtgcccagtgctttaaaaatcaaagtttgcttttaagaaatgtaatttaaaaactgctgatcatctaaatcttgggaggtcaagggcactcttatttcctttatacttacaagtttaatttgatgttttccaaaatagacttgggtataaatttcacatcaatatgctaagcagagccccatgcagaatatttctgagtgggatttattgaatataaggttatttttatgactgggacattacagttgcaatcatcaatgaataaaaaataaatttaaacaactgtctctagcatcaagttgaaactcaagtctcaatagagcaagtttcaggaagaggtgggatttcaggtaacatggagaacagcagctcagatccttttcttaaaggacgattcccccttgacatgaagccagcaactcactctgcatgcagaacatgcaacacatttccatgccggggagagaagcatgtgacgtcattcattcactcattcagtcattagtcattcccttattcgtctatctaatagctgtcaatactcctagtatgtgttgggcattgtactacatgctaaatatatagaatctcttttctaaactcaaaaagttataagtagatggtagtagtggtcagggtaaaatacatttgtgaaaggaagaaattacagtgacaagtcctataatagatggcaagtgatgtaggatccataaggaagaaggacaaattatttatagtatagatagggaagactttacaacaggagaaattatctgagattagtttggaaggataagaacaaaaaggtactccagtagaaaattgggacaaaaagtagaaaaatggggcactttagtctgggagtcataaaaggtggggtatacttggaaagaataaactttttgtagaactataagagatttcagggtctgtgtgagttatagtttcaggagattaagttgaagatatttgggtacaatatattgaggtatatcataagccaagagagaatataggttttatttttgcaggtcagttgttctcaactgggggcaactttgtgccccctccctgggatatttggcaaggtctatattttgctgttacaactggagaagggggcaggctactggcatctggtaggtggagaccagggatccactaagcatcctacactgtacaggacagtccccacggcaaagactctgccccaaatgttgacagtgctagggtgagcaaccttgctctagataatggagagtaactgaaagattttacatatgggaaagaagtaaagaggtactttctaggaaggtgatgcaacacctcctaggaggtttgccacatcacggtggtcatcaaaacactgggtgtcaataagagaaaaaatattcgcctgcagggagaaagatcaactaacttcttgagcatctactctgtgctggacattcaacgtattataccaatctccccatgatattggcaactgctactttctgcagcaatggggactaccagatgaaacaggatgagactagaggctgggagaccattatagatcaatgttcactctcacatggaaacagtggaggtctggactgtagcagtgtccatggagatggagatgtgagagcaaagaggaaggtcaaatcaaaaggagttttttaccaattaaatgtgagaagggtttaaccaccaaatggaaggtttacagaacgactttgaggtggctggttcagaagactaagtaggtagctggagagactgcaaaaggaagtctcagaggacaggtacagggctacccatacttgtgacctttggggtgcccatgggaggttcagatgtagatgcctggtaagcaaagggaaaaataagtctccagttgtaaagagacctcaaacagatatgtgtttaagagtttgcaacatcacaatggtcatcaaaacactgggtgtcattaagagaacaatatttgcctgcagggagaaagatcaactaatttattgagcatctactctgtgctggacagtcattatgttatcgtctcagtctccccatgatattggcaaggagactgaatgcagacaggcccagggaggtgctcaaagtcaggcagccagtcagaggcagagccaagcttggaatagtgtctcaccaaaaccaatccccatccattcattctttcaagattatttataaagtgaattgctgcgtggagaagagaagccacagaacaggttgagaaagaagaccctgagataggaaaagaaaaagtgaatgatatcatcaagtccaaaggaaggaagagcttcaagtaatagtttcagttctcaattgtaaaaagattcagagtcagaccagaggatgcttctgccataaattgctatccaaatgatatcaagtcatgcacacacacacagagtttatatcagagttagaatgtgtacactgcattagacactgagcatcatcagggtcttgctggagggcaaggagcaaaaaacagaccataattggtagaaaagtacttagagtttgaggaagtagagccaggaagaacagaaggaaggtagggtggttgctaaagggaagatattttacagatgaagattcagacttgagcgtagatgtaggctgaaggacttgagtggaaacaccaaagtttgagtatgtaggagtgagggtctaaatgagagaatgaaggagtttggccttggtgtggagaagggtccactgtttgtttaaaatagtggtcttcaatcttgttgggccagtagactctcttgagaaccttgtgaaagttttagatgtcgccccagaaaaacatctgtaaacatttacaaaactgggtatgatcttagggagttcttgctaaaatctcctaagcataaaatttaacaggctctccttgagagtgaagaggtgctattaatgttattacagaggacaacagcctccatctaagcttcaagcaatcccagattggtgaattggaagtggctggagaatgtgatgaactggatttcctctgtgccggcattgattattgtggcgtgactgaatcacagtaagagttcccctgaaaagagcagtttgagtttgttagaaaaatggcactctggaaattgatttctttcaaacaattcaaccctgtgaaatccttgcaatatccttgtgtaaagccagggttatgtggatgacctctgaaagccattgatgtggaaattcctaatttagaaaagttatcagaaatgtttctggaaatgtttacacctagaagagcaatttggtatatcccgggggaagtatccagagcgaggaaatcaacaggagcccaaagttttgcattctatttattgagtaaaaatatattgattgctagccacatgacaagacctgttccaagtgctttatgaatgaattcattaaatcttcatcacaagcctactaggtaggtacagttattatcctccatttcacagagagggtaatggaggcacagtgagatagcagggttgatcttggtttgggtcagggagtagatttggaacaaggctgtctgtttccagagtctgacctcccacttttactctatattgagaaagtttacatattataatatgttcacacatttactcagtcagttcttttttttttttttttttttttttttttttgagacggagtcttgctctgtcacccaggctggagtgcagtggaacaatcttggctcactgcaacctctgcttcctgtgattctcctgcctcagtctcctgagtagctgggattaaaggcgcccacaatcacacccagcaaatttttgtatttttcatagagatgggatttcaccaggttggccaggctagtctcgaactcctgacctcaaataacctgcccgcctgggcctcccaaagtgctgggattacaggtgtgaaccaccatgcccacccaattcttataagctttcaaatatcatatttgtttaaacacctgtattctttagtgttgtaaaggtaactatccatcctctgacagggactgtagatgagaggaaatgcatccaggaatctaatttatcacaccagggtcctatggatagatttagggttatgggaacagtacctcatcaccggttatagattttgagagccttcaatgagccacctctgaagcctttttaaagatggctggacatgcttaggcagaaggtctctgatttgtgtgctaaagctccttcaaatgaagaagtttcaagtgaacagaaattctcaggtgttaaatgctgctacaactccggaaagactgccaactcctgccaggtgaccagaaactcagtcaacttctctgctaactgacctccaagcaactttacccataatagctaagaataccagccaatacttgctgagtatttcctgtggaccaggctacacacacacacacacacacacacacacacacacacacacacacacacacacacacagatccagatgctcagtttgcacacagtggtacagtagtggagggtcataaaaataagcatgcaagttgaaaccacctgatatggttgggttatattccccacccactctcatcttgtattgtagttcccataatccccatgtgtggtgggagggacccagtgggaattaattgaattatgggggcagttacctccaagctggtattctcgtgatagtgagttctcacaagatctgttggtcttataaggggcttttcccccacttcactctgcacttctcctcgctgatgccatgtgaagaaggtagtgtttgcttccccttctgccatgattgtaagtttcctgaggcctccccagccatgtggaactgtgagtcaattgaacttctttcttttataaatcaccgagtccgggtatgttcttatggcagaataagaatggagtaatacagaggacctgctttgacattggatagtcctgtgagcaagttctgaatttatcatctcacagctcctgcccatgtacaagttacttactctgtcctaatctcagtctccttatctgtaaaatggaaagaataataatattggcttcatagaattgctgtgaggatgtaataggattttggatactaagcacttagcttatagtacttactcaataaacactatttattactactgtgtgctgtatcacagggaagttgtggtggtcagatgagatcattggcattcagatatttagaaaagttaaacacttcagaactttcttctgaaggactttgttgctgagttttcagccccattcagtgaatgtaactaactctcatattagtgcgtttctgcaaaaatgatgaggtcttttgttattactttcattgaggaataacatatatagtaatgtacataaatatgaatgtgcacaaatacagctcgataggtttttaatatgtgaatggcatgttactaccaaccagatcaagatgtagaacatgctcagcaccccggaagagtccctcataccctctttcaggtaatatttattcctcaaaggtaacccttactcttccttctgtcacctaaacaaatctttccttggacaatatttctattattatctctagaattaattgtaatatggaaaatactgttttataagcctcattctctgaatctgatcactttaaaattaggaggtatgcacttcattgctcagacccaacccaagagttccatctgacttcctggctttggacagtgctgacaagtcctcagggcatgccccatgctgggctattcacttggaaggagacaaatgcctaggaggcctggtttcaccctcagagagctagtctaactagagaaagaagccttaaaatggaataccatccctaacagcaaatgaatccataaaaatcatgtctcagggagcaatctcatgttttcttgttttcgaccgtcctgaagacactgtttggtattggtctttcccaagaggatgcccagattaaccacctcccacacagttgggtcctttgctttggggtcactaggatgtggaaagcttgctgccttgccatctgctattgtgtcacaggtgtctgtgaggtctctcatgtaggacatggtttcctcttgacacattagtgaggacttccacaaaagagggcaaagggaggccaatccctatgtgcttattccaagatgtattctatcaggacatgttaccccagttgttcctgcaggtcactgttgtctgtaagacagtgcacacactgggagcagttagcaagcatgcactcatcaccatatgcaccatgaaaacacttctgtgcagtattggtagttgtggagcttgcatttctttaaaagacagaatggcatttaaccacacttattgccatccaaggagctggtggaacataaactgttctgtatggttgcaagcacataagcctcttgagcaagttttctatgctttatgagaacaaaagatgagacattttattcttcaaaaatgggggactccaagacaaaccacagattaatcacaaaggagaagaggaataagcagttgcattgtgcatctctggtcattttgctgaggattttaaaagagaaaatggtgtgctaaagcaatgcttcatttcacattattgcacgtcatccatcattttgtatagttacctattcgtaacattcaccgctatctaattaagtgaaaaaattttgttgtaagtaattaagtgttttttaataggccagcattctcaaagatcatactttgcctgtaaggagacttcaagatgttgtctggagttttggagtttaaagtatatattatccttgtgagattatgtaaactctcatatttgtgggaatacaaatgagcaaaactattttgaaaagcttgattttaccaaataaagtctgagattgcatatacacagatccagcaatgcaacttttacatatacaccctggagtggtggttccagactttaatgtgaaccagactttaatgtgcaccataatcccctgaagggtgtgttcaaacacacattgctgggtgacaccccagagttccagatttagcatatctggagtgggaccatagagagtttgtacctctagcaggttcccaggcgatactgatgctgctggtcccagaactacattttaagaaccaccgtctcagggagacttgtgtacatacacgctcataagaagacatgagcaaaatctttcaaaaacattgttcctaataaccccaagctagaaacaactcaaataccatcaacagttcaatgaggaaatgaactgtggtatattcataccaaaaacccctactatatagcaatcaaaaggaatgatctacagctacctgcttcaacaggatgaatctcatgaagtgttggtgaacaaaataaacaaggcaagaaacagtatccataatgtgattccatctgtatgcatcccaaaacaggaaaaacaaaatcatattctttacaaatgcatgaacagatggtaaaactatgaataaaatctgataattgatcattgcaaaagtcagactagtaattatctggggctaggaggagggaagcatacaggtagtttctcaggtactagcaatagtctacgtcttaacttggcttaacttggctattagatatgttggagttggacttacgattattacttagacagaacatttgtatttatacacatctacatagaatacataagttttaagtatttaagaatcattttatcttttaaaaataatgtcctctatctggtatgtattctgacttttggcaacttgtttgaattttaggatctgcccattggttatgaaaaatcaaatcttttaagctttaatagatggtttagttattctgctgggtcaactattgaaatgaaagaatttttgttactgccaaatacatttgagatatgaactagctatgaacaaagtgttacagagtaaaagacctgtaaggcctaattggagaacagattagaatcttgtacagttagcatgtttatggtctgtgtaataagtcatgacaggccctagtagatcatcttttagatgttgttcatatctatgaacacatacataatgggagagattgacggctgttgccatcaattacattacattaaaactgatttacataatttccccaatacaaattgcgtgactacaagagtgaagattcttatgaactattttcttttggtggcaggagagtcatttttgaaatctttgaaaagaaggaaggattgaatgtgcctgttgattatattgtgatgttctttttccttccaaaaatgaggagtgggggacatctgtaactctgtgaggataccaggaatgctcatttctgtttcataatgcttactctgttttatcctgatattatagtcttgcttttaaatgtattgggctgaatctctttctttacatttttagtgtgtcctgtacaaacaattcttaatcatttttttcaccatatgtttccttgtggcatggtctgcatgtcccctatttgatcacagtgtggattctgaatttgcacctcccacatgctaagttgacagctgcataacctcaaaacgcattctggcaatgatgaatgccaatattttatgatgacagcccaagaatttgattgcagctgcccactgatataagtggtatctttattatttggtgagttaagcagacacattaagtacatttgttgcaaatactagactgtaaaagaatgtatttctgacttattatagtaaacagtaagaaacaaccaaaatgttcatcaatggaggaatggttaactaaattgcagtatagctataccatggaactccccacaaagaaagtagcctgaactgtgttagactccctatgaagagctttatatgtgttgtttcatttaattctcacaacaaccttgtgatattcccattttataaatgaggacacaaagacttgtccaaagtcacatagtaaattgtgcagcaatagttagacctaagttctatggacctccaaatccattttcttatccagttatactctcctagctcgtaaatgtcaaagctatacatgctgttgattctcttctcatggagattaggttcaagatgaacattaagttatgtaaccacagagaagaggaagagacttagataatagtaaaattaaacctatctaaatgtcaaagctaaattacttccaaatgaggtaagtttcctatcattccatgactgaaaggaaattcaagaatatacaccaaaattctggtaatatgtggtatccaagtcaggattttcatgtattctcagagctgttactctgcttaaaatgtcaaattataagtgaagtaagagaaaagccatgcttttgctcaaatgtaattatcgatactgtaaaatatcacttatatgtttatctttataacttctccttttaatatttacagatggacaaaagagaaagaaatctttaagaaagaaactggattcactaggaaaggagaaaaacaaagacaaaggtaaagggtaaagtacccaatgtaaatgcatcttccatggagcataatggttaaatttggtggggttattgaattgcatagatatacgtggttcaactctgttatgaaaactggatttctacagtggaatgtcattaagggctgttttggtctactcttctgtgtttgagcagccctgtactgaactgatgaattcagctggtttgaggagagtgtgacctcggccaagtttgtggttccaattattattttgaccaatcagctatacataaagaggacctgggttgagaagctatggagagcatctctaatgctaaccagctgtctggcaaatccagacaggcagggttagtttaatgagagtttgaattcacctaccaccactactggaaagaaacagtctcatcctcatgggttactgaagataggccattctcagcattttttttttcacccagttgaaaaatatttatttgcaactaacctgaatgcttacattttactttgttacattgcctcagccaagataggttaaagcaaatgcccttaatattttgggggtcacagagccctttaagaatcattgacaatgatgatgctctatcaaaggcctgaaactcacccaatgcccaccctaccaccccctaaattaagaattcccagattagatattcacttgagttaacaagtattttcctttttaaagatccaggaactttagggaatagtcagtggctattagtttttttgttttgttttgttttgttttgttttgttttgttttgttttttgagacagagtctcgctctgtcacccaggctggagtgcagtggcacgatcttggctcactgcaacgtccaccttccaggttcatgccattctcctgcctcagcctcccgagtagctgggactacaggcgcccaccaccacaaccggcttttttttttttttttttttttttttttgtatttttagtagagacagggtttcaccacgttagccaggatggtctcaatctcctgaccttgtgttccacccgcctcagcctcccaaagtgctgggattacaggcatgatccatcgcgcccggcctagtatttttttttaactcttgttttaggttcaagggtacatgtgcatgtttcttatataggtaaattgtgtgttgcaagagtttgttgtacagattatttcatcacccaggtaagcaccatagtacccaataagtggtttttcaattctcactttcctcccaccctccaccctcaagtaggctccagtgtgtcttgttcccttctttgtgtccatatgaacatgtttagctcccacttgtaagtgaattctcagcatttttatgttagatcacagtatactcatcttttgcttcatatgttttgggaattgtttactctcatcttactgttttgtgtccccttgtgcatatatttaggaaactaaaactttagccactctctgaggtatttatggtcatttaaaactgatattcaagctcacataatggacacctgagccccattgacgcagtccaattttttgtgccttttttttttttcaagacagggtcttgccctgtcgcccaggctggagtgcagtggtgcaatctcggctcactgcaacctctgcctcccaggttcaagcaattctcttgcctcagcctcccaagtagctgggattacaggcacgcaccaccatgctcagctaatttttgtattcttagtagagacgggctttcaccatgttggccaggctggtcttgaactcttgacctcgtgctcctcccgcctcagcctcccaaagtgctgggattacaagcatgagccaccgcactttttgctgcttatttttatagtctgttatgaagtggttgctgaatggtatggttgtatgcatttattttcactttatgtgacacagtcaacgagtcttgaatgagaacagccatacacatctcatcttggagtccttttatataatgatagaatttctgctttaaaagtaatggaaggcgatgaaaccaagggtattaaaacatgcattgggatcagtattggacaagagctattccataccattgatctcagtctctacacctatatcttgaacagtcatgacatttggttctttagactaaaaaaaggtgaagaattctaaagaatggaaaaccattgttttacttcctttggagtgaggttactcaaccttgctactgttgtcattttagactggataattatctggggtaggggctgtcctgtgtattgtgagatgtttagcagcatccctggcctctactcattagatgccagtgacaccaccctcaacccaaatatcttcagacatttcaaatgtttatctcaaattggaaaaaagaaggtgaaagtgtcagtgatccgcacccctgactacacaatagaatcacttgtggaacctttaagaagtccaagacccacaccccagggagtctgagttcgtgttcttcagggatacctcaggcatgggtgtttttaagagcgtctaaagtgcaacttctagataagaattttgatccatattaactaggatactcaccaggccacattctgtcacagcagaatctgctgctggaataatgagggctaagggttgtccagctagctattatagtctgataaattgtgttatatttaattgttgatatgtttgtgcccttatttttgtaatgacctaaatattaatagccagcattgctcttttaaactagagtttttgctcattctattcctgcagtagagcacttttatgtctccagattagagcaattttccatatgtatagagcatattaaagggatcactcaggttggtattagtaatgtattctcttttaaacttggtttattctaggatgatgatattgatattgggattcaaatacatctaatgtggactttaggtgatttttcagaaagtgtccatttggctagactaagcagaatgagcatttttgcaggaggttccctcaacagaatgatgagatgttccctcaacagaaggagatgtatgtttgcttgcatgtattatatatacaaagcagcaggaagcaagaatttgaattaacatggaaggaagggctagggaagtaatcgaacaatacatactgggccattatagattttttaaactaaatcatatttacataggctcagtgaaaactctgaaatgttctatagtgcctcgaaggtagctaagtgggaaaaggaaggcagatcctggtggttccaaagaaaagacatatcacccacccaactaaggggagaaatatcaggcttcatggcaaaacaaaacaaaaaaattttaagtagctttaatgtttaaaaacaaactaacctaggcttaagtgaaggttaattacatggcatcttttcagaacataaagccctgtccatgtcaacactgagagtcattacatggatatcctgggaaccagggtgtgaggaggacggggtgccggtctggcacagatgtaatctattcacattatttccttccagttgcgtattagcatttggatttgtaacagctgcacatgtgaaaaacgatcatttgaatccaagagtaaaagaaggaaaacaggaaactctaaatgatctcttgagttaggtcatctaaaaataaatagaagcagccttttagaatcgaattgctctcccaatagtgattcataaatggttgatatgctaccatattaattgatttcatcagaatgaatcatatcctgtatgttatttaattgccttgatatacagcagatcttgtgacactcctatgttcctcatgccacttaggcagtgcccatgtgacttttgatttacatatgggaactaattcaagattgacactgatcagaaaacatattttcatacagaataattccaagtccttaatttctcttagttatatttcttggcaaccaaaagtgtttttaaaactttcagaacttcagaaaatttctgtgtcaaaagtaattttaaaattaagtaattttaaaaatagctactttgttttattaatgtgcttcctaaactgagcacatggggaataggttttactatgatgtaactctgggagattgtaccccccacaacccctgccaggacattttcagattatgccatatatgtatctacatacaatctggaaagagttcaattctggcactgttctttttggtgaaagcatattgtatcatgttttcttttcctcactgtctaggtatgtaactgtatgtgagctgtgaagtaacactatatacaaatagctcatacaacttttaattttgctccacattaaatagcagaataatcaagttatcagttatcactatgtagaaattctcaaagaacatatattgaatgttgtcattgagtgctagtacttctaggataagaagagaagaaagaaccagggagtgtgtggtttctgagaaggttaggaaggggccagctcacacagtactgggccacagcatgacttctgatttggaagttcaggagaaagataatggtaccttaggctagggtgggagtgatcgtggaagtggagagaagtaaatggaaaaaagagataatgtgaaagtgacatgataaagatttgatgacggagtgaaaatgagatgtaagaaggaatgaagtatcaaggatgactctcagatttctggttctcccacatgaagaacaggcaaacttttggaaatctgagtaagacctgataagggaagatgaagaataagaaatgcctttgggacatccagatatgaaggtggaagaagtggttggtgctcaaggaaggggtctgagctagaggtagcaatgaggtgtgaaatatctatggatggaagtttaagttacgggcatcgtgctgtcacttacagagagagaccagagtgatgaggatggttaagattgagctctgaggaccttccacattgaaaacccaggtagaagatgataagccagaaaaaggggcaagaatgtagccagagaggtagagaaaaacccagttagtatatccaggatgcaaaggacagggagcatttcaggaaatggcgatcagggttaaaggctgacagaagggcaaatgaaacagagctgtcaaaaacactgaatttaatgaccctgaagacagcaatgatttagagggagctgctttagaatctaatggaggtaccagctagacgggatgaagtgaggaaagagtggtaggtgagaaagttataagctagaaagtaaagggaacactttagacaattttaactgtggcaaaaggagagggggtaaaccatggagaaaagaaaagagtgggtcgaaggttgtttatttttttaagaaatagctgcttgaataaatttagtacaaaatatctagtagaaaaaaagaggttgaagatacaggcacaagaagatgtaatttatagcaggggtggcccaccagccgtctttgtaaataaagctttactagaacacagccatgcctattcatttacttactgtctgtggctgctttcctgctaaactggcaggtcgagtagctgctacaaagactgcaacctgccaacagtgcggaggctggagtgagacaaattgagcccctaggctacagaattgaaagaaatgccaagtctgcatgctgactctgcacttgccccacgctgaatgcgagcaccttatcattttgcatcctagccattctaagccccagccgtatccacaaagcctaaaatatttactatctggccctttacagaaaattgctgaacgctatttatacctaagagtattaggataatttttttgagctcttgagtgcagtacaccattatccatggtttaaagttatccatagttgaatggcaggtgggaaagcatgggaaccagggagaggcagaaaggctggcaggatgccaagtcacacctacatctcatgcaaaggagggtggtggagggcacaggtacagcaggtgtgaagagttggagcctttgcacctgctggttgctcttctcctgaaacaggaggcagaattatttgctggtggggaagatctgccccagaggtataagaagtctctaaacgagtctggttggttttccttagatggaaaaaaatgactgggaaagggctcagtagtccctatcttatagtaaatccctgccatgcatatgcccacctgagcagacatgtcacttgctacatttatcaatgttcttttcactcttattatcccctctgtttctgttatttcatgtagctgtcagccttaccatccacatgtttccagactcttccaaccttttaaaagtaatatttgatcatttctacagacaagattatatgtatgtgtgtgtgtgtatgtatgtgtatatatagagatatatctatatagatatatgtatatatatatatatatatatctcctcagggtacataacaggaggtctggtactatcccctttggtttctaattttgctagtagtagacacagcctattatcaatagtgagaattacacctcactacactgtctaaattgatcactcaaaggagaagtacctaattattttttattaccatatatcacctagcttgttgctaaagaatggcaagcatcctctgaaaatcccgaaatactaaagttttgacttttttacttcaaaacaaattgcatgctttgatagaaccagaggtgcaggcttttcaagtagcatttctgcttttaatgtagacttggtcattagcccagtgatgtttgaaatattgccatggatcaaggaggaaaaccttttaaagtctctttctacctgatttaatgttagctttttctttcaaagaacaaccaaccttagaattattttcccttgatcattttagtttcattcatagggcttataaaaacaatggagaggttagattccaacttactgctgctaggagacctaatttggagtctaaaaagaataatacatttgattacattatttagtgcctttcagcatgaatctaaaatattgccaataaaactcctggccctaaggatccaaggtacatgtatacaaacagatttacgacagaaattcagaaaggaactctatgtatgtctccaaataaagccattgatttctgcactatgcccctttccccaaattctccttactaaaggatttaacaaattgtttcctgggcctcccaccagatatttagtggctgagtccactctgcatgtggccagtagaatggcttgagtgtagatcacgagagtgacagccccaacatagctggctggaaatagaatgtagggatgaggaacacaacgaaaacagagtggacttcttcccaaccagttcccaagctgctcctctgcctgtcaggttatcatttcacatgctaactcttactgggaacctcaaagtgtattcagttaactaaatttcagccttagtttcatgcatctctctaacacctgatactcactctgttatcatgatttgcatttctgattatccactccttcaccccaacccacactctgaacacctcaggagaaaggactgtaccttttataagctttgcgcctcccattgcctagcttgttgtggcatgtagtaggcattcaataaatgcctgttgaatgaatggatagacttgaaacatggagaaaaactagagacctaaatgtctaagatgtgtgtttataaatactagttttctttattgaaatggaaacttgggccattctgattaacacaaatgtcacctttttgattgatgagtcaattcttcagaaaacattcctttgaatatgtctgttcttacttaggtctgaaacataaatgagagtgttcactggaccagtcagtctctgaaagtgaatgtctgttttttgattccagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggagggtgaggtggccagtatttgctctgacaccagtgctaggaaaactgaagatgtacagttattctttgcgtttttgttcatgtgaaaactggatatgtagttggtgttcaggtatctgtcaacaatgccattaatgaagaatgtgcactgggcacgtggcaccttgcatagcctcagaccttgtcctgactcctcttgaagctgttgggtgtccctcctttgtcacatctttgctccatgctctcctaaacattcggcaatatcaccattaattctggtctcttgtaatctgtcagtcttgccatacttgcccactagactgtgaggctcgagggcagggcctggtgttttagctattaatactttcttcatcaccagtctgagaacatgcctggccaaatgaattggcggtgggtcttcataaacaatgagctttttctttatcaatggagcatttctttttctcaaacagaaccatagaatcctctatatatcctctttcaaatactctaactatatggtaccaattgttaagtactatgttctaggtactgtgctattatttgaattgttcatgcaaactggttggtgattggctgagtcagttgataagcatctctaaagcttccaggtcactggaagatcttctctcccttttgtaaaacaaatctgcattttatttttatcttttattttttgactcagggtcttgctctgttgcccaggctggagtgcagtggcatgatcactgctcactgcagcttcaatctcccgggctcaagtgatcctcctgcctcaacctccccggtagctgggactacagatgcgcaccaccacgcctagctgttattattattatttttagtagagatgtggtctcattgtgttgcccagactggtcttgaaccttcgaattcaagtgatccaaagtgctgggatcacaggcgtgagccgccacgcctgaccctctctccctttttcctctgtcacgtggagacctgaaatttttgccacctccagctgttgaagactgccctagttaaaaccccagacacttcccacttaaaaccaacatttttcaatcagcccctaacatttagggcttgtccaaggtagagggggacctgatccattgctgtttttgcagtattgactatgtttaaaaatgaagaaattacaaaattatggaattcctgaagttgcatgatggaattgttcttctaattctgtcattgtgtctcagactgtgtattgtcgtacaacaataacactaaaactctaaattttagctttctgggaatgtaggactcaggcaatggttttcccaaatgccctctcgtctgtccaggcctggctagccaactgctttctcagtgcttcatcaagtatgggtgcggcaaatgcgactggtgccctgctccctttccctgaccctttaccattcctagcatgccagctcatcttccatctgccaacaccttatttatttgctgagggctttctctgatgccagaggcacccagcctatccaaatggcaggctgtaagtacttaggagataatattatctctctgcccccaccagaggctacccttaagcagtgattcctgaggcctggtgtataaataccccagctctctcacttgatagggatagctctaaggtgcatgatctacagctgtctcctagagctccccagaaagattgagctccagttgcccacaatgataataggcttgataatgctcccttcatcagctgcctttccttccttgtctcatttcccccctcccctacaggtgtttcccaggaccacttctctaataaagcactttgtgttgtttctcgggaaaactaagctaaggctgttttgtggaatcattctattttaaaaatatacttcctagagccatagttgagttttttatttacaagacttctctgactacctcattgattgagtatgtaatttttttcttgtttcaagaaatgaagtggttgggccaaaatactttaattatatgtttcccatcgcttgttcttccatttggaaaatgttgtctattgttgaaattgtaactgccattagcttgaggaaatcttgtagaggttttctaactttttcaaaaggcatcttttttcttttaatttacaaacagaacaattaaagaaatcaagcagtagtatttcaagtgtgataaagagtcatgagcaaaagtatgtattggttagcatctgggggcagctgggttttttggctatctgtactttatgttcacggctctgtgtcacttgcagggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggtaagtagacttgtctgtctaaagtactaaggactttcatttattcaagcatcattcactgaagtacccaatgtcaattctgcttgatcaaatgatcaagctctgaactgaaatttactgtgtgaaagtgtacagatgtgagtgtttgcttaagagattgtggggctaaacaagattggagaagagggtgaatcaacttgatgatattcagactgcttagctcccagtagtcctcagaagttaccttggaggccaagcagtttagggaatgatcagatctgttgggctgggtttgtcaccaggacctctttcaaacagaccagagccacttttattgtttatacataaaagtagcctaggaggttactcacaaagtttcctttaaaaagtaagagtccaacttaaaaaaaaaattggggaatcattgcttaagtgaatagaaaatacatcatttttgacaacaggtttacatattgctatttgcatttttgtggaagctgtccacttaaaatttctccaagccaccctttgcaactcaattctagttactaagttgacttaagaatgatatacagttcttcaaaaatgtttctgaaatttagacttctggcttattaactgccattttcataaactaagtttgtatgctatagtgtttgttagcacgtgttttatatacatgggaaaagcttaattactttttttaactgtaaaaataatatgctcattgtaataaaaaagtaaacgtgaaagcaaagaaaattctgaggctaccatatagatataactactgttaacattctcatctatttccttctaataaaaatggaactttattttaaaatcattaaggatatatttaaatttcttaattcattacaatggaaatcataggataacatatggatgacctaataaaactaatgtagcaaaatcttatttgtttatacaaaattttaagtgtaggttcttttaatttttttcaccttatctttcacttgcctgtgtatcacctatgtatcttgaatatacatctctttctctatacacacacatacacacacacacacacacacacacacacacacacacagtcatgcaccacataatgacattcccctcattgactgactgcataggcaatggtgattgcataaggttataatactgtatttttactgtacctttactatatttagatacacaaatacttaagattttgttacagttacctacagtattcagcacagtcgcatgctgtacaggtttgtaatgtaggagcactaggctctaccatatggcctaggtgtatagtaggctataccatctagggtggtgtatgtacactctatggtgtttgcacaataatgaaattgcctaatttattgcttctatcactttggaagcttgaaaaccggataatcacactatttagaataaaatacaggattatatttcttcatctgcaaaatgaacgtaagtacccacctcaaaagttgtgcaatgattcaattaattaatgtgcatacagtacttagaatagtacctggcatatattattatatagagagaaatagactctgagtgaactgaatgaatcttctatgtacgaaatagaaaacttcaatagtaggtcacagtaattttaattttggctgcatttatttttttattttcacatggtttctgaataattaaaatttctacagaagcaagatatcacataaggacattttctacacaggtgggactattctctttctaccaagagatagaaaacacaactaaaacaaattgagatgtttactttgtttctggatgtaaagaaataatgttataaagatttaaggctgggcaccgtggctcacgcctgtcatcccaacactttgggaggccaaggcaagaagatcccttgagcctgggagtttgagaccagccagggcaatatagcaagaccccaattctatatttaaaaaaatacaattctttctgatttaattatatattgtactagtcataaatttttcagtggcaagagaaaggaactcagaaaaaactagattaagcaaagtgacctcccccaaataacaacaacaatctttatatactgggagcgtgatctagatttaggcacggctggatccaggattcaaacgatgtcatgagtgtcctctgtttgctggctttattctcagacagttctcttcatgtggcttcaaatggcggttagcagctccaatatcccatcactctcataactgattgtctcaaatgaagagaaaatgagccaccaatgaaagaattaatatacatgatgctcatcaatggcaatgatcaatgactggcatagaaaaaggagagccattcagacgtttcatgctcccaaaggaagtacacaatactttttgtgaagtattcttgccctataaaatcacaccgcaatcagagtaatgtctggctctagctatctctttacagaaaataaaagagggagaagaacatacaaatgacactatggagtgtccaaatccaaacaatatgaagatctacagtaggaaatcactgagatttcttcaccaaaacaattataaggaaaaaggagacagagggaggaaacacagattaagagactaaaaggcacatcgaccatatgacagtgtgtgacctttatgtggatgttgactggaaatttaatgctattaaggaactattgttgaaatttctaatatgtgatagtgaaattacttgtgtttttaagagacctaattttttagaaatgagtttctcaacctcagcactgacactatattttcacatctaggacatgatcctaggaaaagcaatcagaaatgtgaacaaaaacgtgtgcacagaattgttcacaatagggtcatttatagtagaaaaataagcatgtatattttggggacctgtgcaccattcagaggggaatatggagtaaattatggcccattcatacaatagaatattttgcatcttttttatatctccatagattttgggggaacaggtggtatttggttacatgagtaagttctttagtggtggtttgtgagattttggtgcacccatcacccgagcagtatacactacacccaatttgtagtcttttgtcccttttaagtgacatttataaggaattgttactagcatgagtgaaaattcatgcgacacgatagtgagggaaggcagtaacattctctctgtcaatagatattatatatatgcagtgtgatctcaactatgtaaaaatacctacattcatgtagaaaaggctggattttaaaaaatgaaagattagctaggcacagtggctcacacctgtaatctcagcaattttggaggttgaggcaggtggatcgcttgagcctgggaacatggcaaaaccctgtctctccagaaaatacaaaaattagtcaggcatggaggcatgtgctggcagtaccagctaccctggacgctaaggtgggagaatcactgcagcccagaaggtcaagactgcagtgagccgtaatcacgtcactgtactccagcctggacaacaaagtgagaatctatctcaaaaaaaaaaaaaaaaaagaaaaaaggaaaaaaaagaaagaaagaaaagaaaagaaaatgaagagtgattatttctgcatcaggtatttctaaaagtatattatttttacatttttccgcattttctagattttctttaagaagcacactttaattatgatcagacgaacaagaaatatcttttagaaattaataaagagttagaatccctataaaatgtgtgtttaggtaataattctggataatggacaaaagctcattttctctgataaggagaagattagaaatataaaatatcacaagaaaaatatttgatcagaaacatttaacgtaaaattctggtgcttaaagggctgacctttaagtatctggataatagaaatagtgtgagatgaaagaagcattactgtatgctgtcaagttactattgctctacatgttacggcactgtgctggcattctgctctgtattttgatttcctccagggtctcaagccatgaaacaagactgttcattttgtttgcttatttgcaggcctccagacagtggggatattccgagttggaagctcaaaaaagagagtgagacaagtaagtgaaaagtaaagattatattttgtttcacatgactttcaattgaattaccttttgcaaagttcaagtttatgcaaattccattttgattatctttttttttttttttaccctccaagctattataatataattgaattccaggaggtaaaaggcaacaactcagaaatgttgttacagttaggatcaaacacttgaaagcaaaatgtctggatgtatctgtgccacgtgcagccaaacaaaactaatttataaacatcttattgaaaattgcaaaagcaggaaattcagagtgactgatcaataaatgatataaagttgtatgtagcacccgcttttactaaaatgtgatatgaaaaatgccattaacattcccttcacataagatgctatgtttatagctttactttatcaaaaataaataattcttatgaagtttccatagaaccattgacccccagtttgcttttcacatagagactgtgctcctttgtttccttcagccctgtgcaacattcctgcaactgaagtttgatattagaccttcaacaataggttcctgtgatgaggcaggtatttgtgttcatgatggcttcataaaaggcaaaccatcctttgagaaaagagttcatttgttggtgaaggaaaattaaagcattattttcttcctgttgttttcaatggaaggagataaggaactcagcaactcaaaaatgaattcaaatgaaaataaattttagttggaagaagctgaagaaatgatatttgttcatattattgaaagtaattgaaataaatacctcatttatcttttttgtcaagacaaaaaaggctttcaacagaaatatgttttctgattggttggttggtttttattcttaatagttacacaagaaacattaaatggatcaacatttaatgtttcacaacagaacttgcaggaagaaagatagtacagtaacatttctgtgcagaattgcagaatatttttacaaatattatctcactgaatctgccaaccggctgtgagtgtagcccctttgacccacttctgtcaaggcttatagagattaagaaacataattcaagatcacacagtttaaccagtcaccattaacttcataggccaaactctttgcatgttccattctttctgcatgtacgtatactcagaaaagaagcatggtgtgtttgaatgatcacaagttggaggagtgccagtggaagtcttctttgttttggctgcctgacacacgctgatggcgtgctgtctggaatcaatgagtagttcaggacagtgatgggtattcattctcatcaggtggacaggtagcgagtgccagaaattactcatcagttatatcgggatccattaaaggggaaacctttgcatggagttgtatttaaggattacccaataaaaatataattagtgtttacttagaagtagatttcaagtatgaaatatgccctaactcactcatcattttactttgttatataaccccttagcaccctgcactttttccttagatcactagccacaatgttaagagtgaattatttgtgggattacctgcttatcacattgtttctctagagggactttgcctctttactcactagtgtattttgtgagcctgtaacagggtctgacacaggaaatgcgtagtaatctttgttgaatgaatggatggatgaaagattgaaaacaaatgaactcttagagaagttttttgcatagtgtaggtttatgaagttacataattatttctacagcagagaacaatgcatacgaaaagttgagctgctagagataaaagtagggtgtggagttattactcccttgctactgtgttttcttgctgctgcaagtgataatagacctagtataatgattaaggcagggaatccttctggtaattgttaataagactactttgacaaatctaagacagcttttatttagttattgtcatcttttaagtcttagtcataaatgtgttatcagggctcttaatttcatttttgcagaaaaaaaaaatctctttgctttcttatagagtgactcagtaaaatatcaacatccaaacatggcaggattggtgacacacagaaatgctgtgtaatagattaattcctccctcccacatttatagctgacctaaattgtcttctacctcttaggtgttcctcctaacctggttgtcattaccaagcccttctgcatacatcattaacaataaatccacagatagttttatttaataatgcttatatatatatatatatatgtatacatatacatatatatgtatatacatatacaatacatatatatacaatacatatattgtatatatgtatacatatatacatgtgtatactcatatatatacatatatatgtatacacacacacacacacatattcatagctggactgtgtcaactcggcagatcaaggtgaggatgttgtttgcttccccttcttggggtctgtgcagtcttaattccagatgctacgtgtcacagcacttctcctgctgggcactgctcattgaggtatggtgttatgtgactgccactcgaaccattgttcttccagttacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctctgtgcgtaatacagccatatgtgggaaagtggccctggaatactaagatgtccaactcattcatcataactttatgcatatgtttcctgataactttttgtccttatttatcaatctctaaagagtgagctatttgagggaatttctcagatttaccctgggaataattagcaagaagaaagttacaataaaacaaatggaaatagccaagaagaatttgagatgctttcaaataacccaagaacagtaaaaagtactatgagttagtgcttagagtaccaacaagagttcacattgagtctgtgcctaaaaatgagtttgtgtttctggtacgaagaaggagggaaccacgagaacccagagtgagaaaggagggcagcaacattccaggagaagcaagatgccatagcccagtgccagggctttcaacatagctgcttctgggctgtagctacagatcccatgaagaagaaaaaaaggaggaggtagaggagagataggccaaacctgggtcaacctccatacatttcttcctccaatgctgccattcaaataggatcacaacggagagagaagacattggctttgctgtatcttggttattgccaacaaaatatctgtcccttgtgaattgctcaacagaaaagagccttaaatccattataaactcaaatttcagaatgttcaccaattttcagccattgttaataaatatttaccaaaaatggaagactgaaatccttaaactaggtgatgagtaatgccagggaaggggggagaagaaagtaagggaaattgagttaccttttttttttttttacctggattacagttatttttctaggtattacacttctcgaggtctaatttggctttatatctttcatagaatcttgctggtaaattgctaaagcaatgggcaaatgagtgaaggcatgaaatgggaattgccttgataatccctttcttaagacaattgagaggaggcctttcctctgtgcctgaatagtatgggctccccttttatttgagtacctctttttgccttgcttagtgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtaagatgcctttgctgccatagatgccgtgactcttcctctcccctattttaaaagggcataccaccaaaatggccattttgcctggaggtaatgatgtctccccttctccaacctagctgtctctgtaggaagagactaatgcagggccttctctggaggcacagttcctaaaagtgcatgggccatgagcctccttatatgtttcaagtatgcttccaaatgaggctgtcattttccatggtgaggctttactcaagactctgaacttccgtttgtaaagaagaaaaacagtgaactacagaagtgcttgcaaccatgtaaaagtggaatgatgggggtgggaggagattgttatccttataattgattttacctgcttctataacttggagcccaaatatgatgtcacctctttattcttccagtttatccctggagctcccatctgcactatgagcaagaagtctagtgtctccctttcaagggatcctttcctttcttaaactctccccccaaaacagggacttgctcgatgcaagggagggtcagtcctgcttccaaaccaggtgtggaggaaactgggtctgatctgctgaccattgccattgtgtcttgatgtcacatggtatcaactgctcaaagcaggttgtacatagtcccacagactctttagaaatgttcttgttggatctgatccccactcaggccccagtgtgccccccccccgcccaccaaatctaagatcttgggttctggttctctttggttacactcatatatttcaagatttttttttttgtttcacccttggacaaatgagatgctggcttgaattttaagttgcttacttatgggcaacgtatttaatcttcaccttaacaagagacacccccttccctctttgataccatgcagttatacctctccctgacctcggattcctcaggaggttttagactccttaataagctaacatgcactgtaaatcaataagaaggggccagaggcattccaaacttacttaaccacagaaacttttttgtaaattcttgttaaacaaagctcagctgcactgcagcttcagttctgtgtttgtcaaatttctttcccaaagaacgtggttatgtataatttttttcactctaatccagaaaggcaattctgcatttcttctcgtcctcctccttacgggtgtgagaatggaactctcctgacttagccatttatctctatagcagttataattagtgaagccccagatggcttcaggtttcataatgtggcactgacaccttatttcagcatacacagctctttgatgggcatactataattctcataattgttaagtagttttattactcatttggatgccaacctctatcaactacagttataacagaagctgtagcatgatctgcctaattgctgggggaaagcagagctctgtgtttaaaggtactccagttacttctctgacatttcttaagtactgtgtgagaaggagaaaattgggtctcaggtaattaggaaggcattgaggaaagcaaaagttccaatcgaactcattgttgcccttttagaatcattttcagacattctttccattcaattgctgaacaagtctccattgcctatgccaaaaagaagaaaatattcttggacaggtgtaaatgaaacagcatgctggaatattagctaccatttatgtctctccttccatgagctggctttgtgctaggggagatatatatatatatatatatatatatatatatatatatatatatatatatgcatgcaaatacatataaatatataaatatatgcaaatatatatatatatatatatatatatatatatgcaaatcctcttaacaggcaaaagagatatcactgtctccatgtttcagaagtgaaaacttagggccaggggagctaagtaacttacctagcaacccacagagagcttccacttaaggttgtacgagtggcatattagtgcatttcacaactctaggggaggtgccatggaccccatagtcactggagatttgcagagttattaggacagtatcccagtggatgatagaaaaagatcttgaagaaggacaatgtcgttatactggttaatgggttgggttggtccccttactagcaaagtccaagctgtgcatagaacctgagccagtctaagagaaaagacgtacagaataggaattagaagaaaaaaaaaatgtactggggtctaggtcatggtttctcagcctctgcacaattgatatttggagctaggaattctttgtcatggggccgtcctgtgcattgtaggatgtttagcagcatccccggcctcttcccactagatgccagtagcagtacatctcctctcccaccaagttgtgacaaccaaaaatatctccaaacatttccaggtctcccctgaggagaagggttcaaaatcacccctggttgagagcgcttgatagctctttaattcactgaccatgtgttgttagaaaaatctattaaccttcctatacctgggtctcctcatctgaacttgaggaatgaaaattcttcaaccagccttgaagagtggttgagagacctagtttactgtaaggaatatggaattatcctggtgacagtgaagttgtaaaaggaagccagggtttacgagggtttctagacactcttgacctgaacattgcatcaaaatgaaagactaatagccaaagattaaagcagcaggagaaatataaggaaagcattgcttccgtgaaatcgttagcagtgacaggagagcaggcagctctcacagccattgtgaactgtagtaaaggctacggagcagtgaagtactgagggagacaatgggaaattgggccatgttcataaattgctgaatgcctctgtgcagggcaggtggttgattcttttaagctgtgaatccttggaaggattcaactaatgggtgatatgatccacgttgtagattggctagagacaaagggagagtgagttaggaggcttttgtatcaatagtaatatggacaacagcaattcctattataaacatttccatgtaagaatggccttggcgggccaggcgcggtggctcacgcctgtaatcccagcactttgggaggccgaggtgggcggatcacgaggtcaggagatcgagaccatcctggctaacatggtgaaaccctgtctctactaaaaaaatacaaaaaaaattagccgggcgtggtggtgggtgcctgtagtcccagctactcaggaggctgaggcaggagaatggtgtgaacctgggaggcggagcttgcagtgctccgagatcacgccactgcactccagcctgggtgacagagcgagactccatctcaaaaataaataaatgaatgaaagaaagaaagaaagaaagaaagaaagaaagaaagaaagaaagaaagaaagaaagaaagaaaagaaagagaaagaaagaaagaaagaaagaaaaagaaagaaagaaagaaaggaaggaaggaaggaaggaaggaaggaaggaaggaaggaaggaaggaaggaaggaaagaaagaaagaatggccttgggatttgaatcatgcatgtcctgagcatctaccctaggttcctgtaaaccaacgactattgctcagaaattttctaatgactggcctcaggatacaatggcatctaagaggtggaggaggtgaggacacaaggcaaatatagaattagggaatgcactgcagagtcattgcagacattcggagaagtgatgagcatgggccagaaaagttaggaatggcttcatggaggaggttgaatttaagatgcacatcaaagggtgtgtagggattgagtacatggaccacataagcacagcattgggatgggagttagccaaaccccttctgttagaagtcaagggtagagggagaggatcaagagaggagttatttattattttttagttgatttggcatgagcaggtagagaatatggaatgggcagactggagtaaaactaaataccaaattgtaaaatatggtcaaaaaccaatatttttcaacttcttctcttccctatttttttagtatgtattatctatttgttagggtgttgtttggggggattgcaacatagatgaaacctgaagcagattgtcaagaagcttgaaagctcacacaggttctgccagcaccttgctgcataacttgtctttatgaaagagaggaagaggaaggaaaacagagttgggatggggggtggtcttagcttcctcatctacaaaatgaacataatattttctctttgatatgtgcttaaaattcaatgcatcattcactggtgagaccttaaagatgtctaaaagaagggcatgagaaaaattgttgaccaatcagtgcttttttgggaaaaaatagcagtattttattgaattgtggtgttttgctatcttgtgtttgttttgttttcttctattttgtttagtttgctatttgctttgctccttagggaaaagagaaattcccaagtgtaagaaacattgcatttcttcaagaaagaatatagcaggaacaaaattgaaacctcctgagcagtggtttttcagagttcaagaaccccctggcactgcctggaaaatgtggtgtgaatatgcacttgtttggtgagagtccgtagctggcattgagttctcaaagggtctatgaggcaaaaaaagaagttacaaatcaccagtgtagggccatgattactaatctctgaggaggtacatgcctctaggaaatggtggttggctttggaacttagcaagacctgtgtctcccctcaccctcattcagccctgttttaaagctcgttttcccgtttccccatgccatggctgggtctgcccagcaagaggaaacaggaagagatgtagcaatgggatgaagagagtagggctgcctagagtggggccaccagcttcgcttctttctataccatctcctggctctgagctttggacatcacttccctcgtctataaaatagggacaacagcagcagctgtttcttaagcttatagtgagaaagaattgaaatggccagtggaaagcccctagcctggtacctgtacatattagacttttaacagatatgagctattcatatgaagcttagaaatgatctaggatgttcatttagtgaagataaaagttttcttgaattgctagctaattaaaaaatgaagtaatggcctggctcgagtgtacgttgtattacctagacacagccgtatagtatatatataaatatatgctgaaacacatggagaaaaggtggatgttgcctgggagcaactcttctttccctgttaaaaaacaataaaacaaaagaaaccccaaaagtgttaacaaaccccagcagcttggtctgcagctggaatctgtgtgcagttttacagatgggttgtattccattcccagaatagcaacaggagaaggaaagagcggaaacagagctctagattgttctcgtatgaaacattcttttaaaagaaaacaaaatcttccatttgttaatgttttttttaaaaaatgagaaaaccctaatatgactttacaggggtaaggggaaacactccaaatacctctgagttctaaagggaggaatttgaaaatgacacgtatttgattttcaccttaaccatgaatttccaggaaaagaaaaattaaatgaaaacttgtcaatgaaataaaaaacttaccaatgaaataaaacaaagaaaaatgattggacgatcctacataaagggcactttctttgaaattgtcagtgtttatcacatgaaatgatatcccttggaggccaatcattcacctgaaaacagccttgccttctaaaaataatacaactcgtgtaccaagctgggattgcagggcagggcagccaccagctcatgacgccacaggatgagagtggggttcagagggctttgtttcagctgttcattgggactcctgaattctatgctgggcacccaggtgtttctcaaaatctatgtagatcttcccaggcaaaagatccccaccaagcagacgcagttcccatacttatcctgactctcaactgatattgacaagagaaataaaaattcacatagaccagtggttctcaaccaggagcaattttaccccacaggggacctgcgaccatgtctagagataattctggttgtcacaactgtgggttgagggcaggggtgctcctggcatctagtgggctgaggccaggggtgctgttccacatcctgtaatgcacaggacagcccccacagcaaagaatgatctggtattacatgtcactagtgtcgaggtagagaaaccctagcctagagaaacttactcagactctcccgttcacctgaaagaaagacaagtagaaaaaattcccaaacctttgaaaacgttcatattccttattacaacaattcaacttgtaggaatttactcctaaaaagtgctcacccgagctcacaaaatatcttttcaaggatattttttgtaccattgcttataataacagaaaattcaagacgacatcaatgcctattagttgactgtggttaaaaaacatcatggtttattcgtgcagtgggattctaggggccaatgaagcctgaagacaggattttttttttttttgtagtggaaagattattgtagcatgttgttaagagatagtaagcaagttacaaaataatatatggatgtgatcccagttttaaagaagaaaatatcaggtgtacatgtatatatgtgcacaggaaggcataggaatggctgattcttggcagtggtgaaattatgggcatttttttttcttttggcttacctgtgctttctaattattaatatattgaatgtgaataattttttatgcttcaagcaaaaaatagttcccttccttcaccccgtactcccctttagctcctcctacatttcttcttcctccttctctgtgatatcttttgaagaaagtgtctacattcactgtttccacttctgcaactgtggctcattcctgccacaccactgacatgactcttagctgggacatcagaaccatcagagagtccattctggagggaagggtcacatctcgatgaccctctgccacagttgataactcacttgaaactcccctgtcatttcttcttggacacaggtttcttttatggtaacttctcacccattattggcctccttcatcagctgctccttaagggtgctggagtctccaggaaccccttttcagcccttcatgttcctcacttaactgtccttccattttttcatttgttaaaacacaagatccttaccctctgcattatcctcttcaccccctccgtaactttggaagctgctcttcatccctacttcttccttcctagttcagatgctagctgctgtggcctagactgttgtggtatgtcccaggtagtcctacttccttgcatcccccatcccctgttccatagattgctcttcctgaaatgcagattccatttccattctgctctgttcagaatcctcttgcccttagatcacagtttgaattccttggtctgacacatgaagatcatctcacctggcccttgcctgcctttcctgcagaactccctaccacactgagcttcctggggctccatgacgtattttagatgtttctgtctttgcatgtgtggtgctttctccattgtaaaattaccccctagcccagatcctttgcttttcagcctagcaaactctattcttcttttgagagtttgtgcaaatgcttccgcctctgtggtagtgaccctggggcctttggagttgagagctttatactttgtactcattacctgtaagtgataggtttatttcctccctagaatgagagacctttaaaataaggactatgttgtaatcattggaaaaattttaaaataattacaatatatgaaaaatgcccagcctatgataggtgctgagtggatggatcagtggtgagattatgggttgatgaatgaagggatggatggagaaatggatagatggatggatgggtgtcaatatttcttaagtgcaaacaggatagaaattttatgtagtacccattttacaataaacaacttagagttgcaaatttttattcaatatgctattgagatgatcactgaactgtgagcttcaatccaagatattaaagcaaaaggaaaataatgatgccctccatggattctgacagagaggatggcatccttgcaggattaaaaaaaaaaaaggagagtaaaaggtttcattgattgttgaatcacccagtatcttgaaaggcaaacataacaacagtccttgtgttctgttctcttataggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggtaggtggcccttctgtggcaggacatcacagcaaactgcctattggtttcctctggaggcaggatgaaattctagtagaccaccctctggggtgcagtgctgctcactgaattcattggaagtcaggcagtttcagcaggagtagaaatttgcacaactatgatgtcattttgagtttgtgactccatgtttaaacaaacatgccaaattataattttcattttgttgtcctctaaaccatggtcacattttggagtcacttaattataaagcagtgtccttgctcaagacattaataaaacccttctttatggaattgtgtccctcatgaattcatgtattcataagcatcctcagtggtttcacctcctccaaggtcaatcttgacattttacctcctacatgaagcttcacctctccttcctttgtccttcccatgccacttctctgtcccctgaactccattactgttcttactgatgtttatcttgcccaacattgtgtatagtaatttatgaccatttcccctagtagagtataaatgcatttaaaacaaggactgcaccattgttatctcctctccatatcctctgtacacttttggaaagccctccatctggcaggcactcaataaatatttttttgatttgtattgaattaccagttcctgttttccttcatcaaactgcattgcttgctacaacttcccttgaaacattaaaacaaatgccaactctcttctatttctgttcaccactaatattgcatgtcaaaatttacaggaaccttcttcatgttttttctcccatttctcttgtcaatttgcaaacgctataaagcctgcctattccactagagccttttgtggctccttccttcaaccgagaattctagttacctcttttaaatttctttagtagtttgtctacacttatcaagtgctttgcattagatttatgtccatgcttgtcttatactaattactttttgtaaatttgagacccagcagtttagagtatttgccctctgtgtcttacctatgtgattgtgaccaagtaattcaatactcattatgcatcaattctagctttagaaatgggaaaaacaaaatgatgatgtaattctcagggtggtgaccagaatcatttgatacgtgaaagtattgtgcaaactgtagcagtttatgcaactgttaattagtaattatattagttgggtaacacgtgctgcctcaaaagtcagtactttaacacaaacataaatatcactctgacataaagtttaatcaggtgttaagtggacagccttccaggtggtgatttaggaatcccagctccttgtattttgaggctctgacattttttagagttttacgggcaaccccagaaaggtcatccatcttgtccactcaaatctcattggccagaacttatgcacaagccacacttaacttcaagcgaggcttgaaaatgtatcctggttggatccccaggaggaagagcaaatgaaaagttcactgaggtagaatggcatcttgttcctgtttgtgtctctgaagcactgtccctgggttgcacatgctaagctctcaaaaaatgttgaattaataattgactctatataaaatttacacatcagcctaaatcctcataattaactacatatttggatgaatcaaatgtctgaacttttcaacattttcatcaagtttaagtcacatatcatcttgccaagtagtcttggcattacttcatgttctctggatttttttaacaaaataatacttctcatcaaacttaattctattatctaagcaaagttctcctttatatgaaaccacatatcatcgagcatttcttttcaactcagataccaacaaaagttttcctggcttctttgaaaatatagctgctgccattttaattgtgccatccctcttctttccatttcctgccacctgaattactaagaacagtataaaaacatcagtattctaccttttccagcttttcccaaatctgatctttgtttgccattctctgtagggattgatgtcggcattctctcatatttttggtctccagttatagtctttacttctcatagaggcctttcctggccaccttgtctaaaatgcacctccaccctccatcacacacacacacacatcatcactccctatttcctttccctgctttttccccttagcactcaccactgttaacattgggtcttacaaatttctcgtttatgttcgccactccctagaaatgtaaactacatgacaggatgatttttttggtccatttctatctatagtactttctttactgcattacccctgtgcctgggacatggtaggaacacaataaatattggttgaattaatgaatgactcaatggttgttctgtgacatatgatttccatattaccaagccttactccttatacgtatgaaaagatttgggcatggagaaattaaggatacctttcttggagtaagttaaccattaatgtaatcattcttgacctctttagaaggattctggtaatcatatattcagaaaaataacagtggagtgggaggaagagggagacaaatatctcaagtcttggtctatgaaaagaaactgactctggaaccagaaaatttactatcgtcctgtccctgttatatattggctacatgacctcatcttcttctatttctttagttatcaaatactagatttgaatgaatgatagccaagaccccttctagttgtaaaatctgcatggtgctatgccctagcactgacttcccttccttcctttttataaagcacaggagaaaattaatctcatcacattttagattatcttggcatatttggcagttgagaaactagtcggctataccaaggctggtggtttgtcagcaaagctgatctgcatgggtggacaaaaatgtaatcttgtatgtcgctatgttgttttgttttgtttggctttttaaagaagctttcagaattattataattccaaacaaagaaggatgaagctagtcagggcctgatggttaaaagtagttagtaattgtgcagtttcacagtccttgggtttaagagctcggaaagggaggtgtcacttctattagcattagaaaggaagacttgttaggaaaggtagctgtgagcttgtcctggaaggcagaacagacctggaggcagtgattccataaaataactggtggaagggatgtagaagctcacagaggcctggcagggacccaaaatttgttctgggtgttctaacatccttcatttcctgatgctgagactgcctctcccaagtggccactctctgagttaatgggaaagggcggaaaagaacctggcttcgtcctgtaatacagaagaggaacctagatgcagaggttgacacacaatttaagagtctggctaggacagtcttttgcattggttgtttgcttttcaggtactggtttggaaatccttgagctggaaatagatcataatagcagatatcatgaccacagatatcaaaatacgaaggcagtagattataatggtggttctcaaacttgagtgtgcagcagagttgcaaggaaacttagacattcagattcctaggatgcactcccgagaatcagattgagtagcactgggatggggcccagaaataatctgcactttctagtgaagacctccacagagttctggtagtttcctaaccacacctttggaaaccatatcttgggaaacactggtatggtagaaagaccatgtgcattggaatgagctaccaaaattcaaatccctgctcagccacttatttgctatgtaatcttgggccccacagttaacttccctagccaaaagatgaaacaatgtgacctaatttacaggactgttataagaattagaaatgacattttaaggcacctagaacagaattaacatatattaggcattaaaggaagatttctgctattattacattaaagggataaggtgcctgctctatcaaagcgtgtttgggtgttttcttggaaatcaagcccactctgcccactgtgtataatgctgtgacctgatcccacacatatatactcctaggcccttactctgctctttttattccatagcatttattaccttttaacccactatataatttacttatttttatgcttattgaaacctaacagaatacaaaccttataaaggcagagatttttgtttgttctgttcactgacattcataccacctagaaagtatatggcaaaagatgggtgctcagtaattatttgttgaataaatattgcaattctgtattactagaaaaaaaatgtatttttgtttcgattttgtccagtgtccatactgcttatattcccttacctttaaatcatgaccctccacttctgatatcaacacctgttgaaaaactggctaacataaaatgatactctgtgggagcactggaaatcaaggataagaatcattaatatctacacaaagtcattggtattatcctaaccagaaagttctcactgactaagtcattgatacatgaattgttctgaaagttgttacttctgtaactaatattgggaattccagagaaaactcatcattgctcttgggattagtaagaacttcagagcagaatggagaaaactgtcagcttcttctaagggctgatattaaacgattcttactaggacttcttcttaggagaggggcaagaaagagaagacaccacccttgtaagctgatgaaaagtccggagtgcagtggagacgtgggaaagccagtgtgttcccaccccactgagttgtcagcctgaactggggaccagcttagtgcacgtgggaaatttcaaatgagcactactgggagcaagggtcagaggctgtgatgaggattccgagtcagaagccaagctttgctttgtgttctcttcattccctgatgaaaatcgcattttcttaaagccactttgcacaccaagtcaaagagtcaagcattcatccaggtcatcaagcaagaaaccacccctcccagtatatccacataattatatatgatttccatttccttttctatatatcacaaataccactgtctacgtgccagggttgggctactcattacgtacattattggcttgtttaaatctcactaccatttcatgaggagtaagccaagtttgtttgcccaagtgatgcagtgactaaatgaattatttctacagcatgatgcctccttacacaaaagaagaggcattttgatgtggtatctcagatatggagtccatttgtggggaaagaacaagaaaatatgttttagccaatctggaaatgaggaatgaagacctttaacagcagtaatactgctggactaatcatagcacccctgatgttcaggccagcagatggcttccagagccagcaaatgttctgctatagtctgctcacttggccctgtctgtaaagacagaacatgtgtactgtttgtgtcccacaaaggtggaaggaagcagaagcaaattatgcctgaacctttcccactccctttaacctgttgccatggagcaaagactgctgatttctttcatctttgcttgagttatcctccaacatcgttccatgagccctggacccttccactgtatttgttcactaatgtacctgaattgccaaaacatgctgcctgacatgtatcaagcacttgagaaatatttgccgaatttaatgcatcttgaccctcccgtgcacccagaccccttaaattattaaaccacctgtcacaacagagccacgccaaaggttctaagctgggcctgtccttgtttgagcttttgctcccataaacagccaaagtgatttcttttagtgtgtttgttaactacaaaatgccatcatgatttccagtgctatttacttttgctgggttttaaatgctaaagcatccttcttggtcaagtgcaaagtggtggattggtgtggaacatccagtgacaagtgcagtagggctgggtcctgggaatagctcttcaaaaagcccttaatggtttattgtggtgacttagtaaatggagaaaactcaactcataccacttttctctctcagtggtttatggaataaactacctcatagcagttataccccaggcaataattcaaggtttcatttttaatttgatcgggtagattttaattgtgacagttttattctttcatatgtgcagtgtttacatttttttctctgaagcaggaggggccaaagttcttttgatttttggaacagcattatgctttgaaggaactcattaaaatctaaggagttgagtctccagataaacaagaccataaatggtacccttagaaaatatctagaattgttacaaggttgactaaagcccagtagagattttgatgtgaaacaatgaattgtaaatgaagaatcactttgggctgggtttcgtttcttctttttaacatgcagaattgcttgattttttaaaaaatgtaatatgtctttcactacccttctccttagttcccattttgctatatacaaaaatcccagaagcagaaaatgaaaacgttgtttaattattgagctatctttttcaaaaagttttgaagtttttgtattgataagaaaaatagcttaagaacttagaaaaaatctgatgataatcagttgggaaagaaaatgtattttcccactctagaaatgaacagcaagaagactgtgctgcagcatgacataggtaccactgataagtagagagaaacatctagacaagggcaacgtaacacatgcagtccataatcctgggtgattttagattattattatttttagccatttcagcaacattcactgcacatccactgggtagaaatcaccaccctagcttgtattctgaaagagcataaaattgagcaagagagtgtgtaagtgaatgacggggtgagggtcatagaagtgcaggtaagaccttccagagaggaaagagtaggaaggcaaagttagaggaggaaaatgagacatcatttaggaaacatttgactggcaaggagaacaataatcaactgcaaatggctttcgacatcagcatttattatgtgacacagtaaatatgggggggggggcacagtttcagtagctgggtagcactttgctctctctctctctgctctgccatcttcagctgcaaaatggctacagttgataacagcatctcttccagccatcattgcatcaattaatgaagagatgatgtttcttttcatgtacccattttcaatagggaagataaccttttccagaagctcctacatgccccacttcaggtaccagcatgtgcatacgtgatcttgccctagctttgagggaggctagctgaaagaaaactacaaatttctgagcctgtttcagttctgggtaaacaaatcagataatccctgccttcaggaaatttaccttctaatgacttgaatggtgggaagattcaaggtctagccaaaggaactggaagggtgaggctacacagagtctgacttcaagaccattgcagttgaagggccaagaggtcataggctgtaactccagaaattcagagggggattagaagcagaggcatagcaagagaaaatcccataactgagttacccaaaagaagtgttaagcaaaagagaagagagtgcttcttctctgaaagcgaatggatgactgttaataaaaactaataactgcagaataaatattgtccatctccatgttatctgcttttattttttcaagtgtttaacttacttatttcatctatttctaataaaacattttattactagatctctttgcaattggtaatctattttcatttttttttagcgcttttgattcccgtaacaccccccattaagtaaaatgaatatgcatatgttttcagatgtgggaacagaatcctaaagaaggtgattgatgtgtccaagtttatattaattataaacagcagagccaaaactggatttcaggggctgttgcctcagtcagatttttttttacagcatcctaattcctgaaaaggtatgcttaagtcagtggtctacctagatatttctttcttacttatttcaagctgctgtttcctatcagtttatttacttgacttttatttctccattaagtacctaaattaatagagaaataagtgttcatccaatataactgagccagtagtttgaaatttttattaaatgttaggaaacgaaatgtgcagttatagccaaagattagaagaattataggaaaacagtactgggtgctgttgtatgaacattaaaaaatcagtttcaggcatcatttcaaattttttacctcattttcccactgactccaattttctgaatcattcctttattttttagaatgtggtttaatcacatacattttgaagctgccttaaatcactctgtaacaaaatggattataaataaactaatgaattatatacaactgtagttagttttgcataatacataggaaaatattatttgccttcctgtaatacatggatctacaattttaaactatgtcttttttatgcatttgtaaatagtgtctccaagccaaaatggtaccatgggccttttaaaaggaaactgtagatagatttataactgtgacccttcctatttgcatttgttaccaagtaagagtcacatatgctacataaaatagacctcagtaattatgattgctcgcctagttgaatgaggaaaacctctgaattgcagactagcttgacaaaaatttatggaaagttattttttaagtaatgatacttctgaaacctattctaataatgcatccaagttgataatttatcttagacatactacatactctcaaagaattaatattgtcatgcttgcaccactctgaagggcttgcactctaactgtttattctttaattaaatccaagaatggattagtgcttggagcgaaattttttttttttttttgagacagagtctcgctctgtcacccaggctggagtgcagtggcatgatctcggctcactgcaagctccgtctcccggattcacgccattcttctgcctcagcctcccaagtagctgggactacaggggctcaccaccacgcccgactaattttttttttttttgtatttttagtagagacggggtttcaccatgttagccaggatggtctcgatctcctgacctcgtgatctgcccacctcggcctcccaaagtgctaggattacaggcgtgagccaccgcacccagccacgaaattttttattacatgtcaaagcctagcaagttttaaattaaactaactggatgaaaatgcaagtacttttcctaatttgtttatggaattttcttctaaaaaagagatcgggacatacatttttgtcctatattattttttgctctgctgttcattaaaaaaatatgagttctctttcctctcattttcaccctttaggtgttacgtttttaaaaactgttataatagcacatggctgttgggtgatgatctttggaaaaaatacagtaaaaatgatgtctttctgtttaatttatacagtaagagaataatctcacccttgacctaaatatcctgccctttcccttctccccattttcatacccaggccactgcagctggtcacagggttttaaataccatctatatgtgcctcttaaatgtctatgttcaacccagacctctcctatgaactctgaatccttattgccaactatctacaagatacctccttcatttggatgtcttgcaaacctctaaacattatcatatcaaaaccacactccaaaacttgacccccaaccttctcctcctgcagcttctccaaaccagtcaacagcaactccatctttctagttgcctaggccccaagcattgaggtcatcctttcttctccctctccctctcttctctctctctccatccaataaattaatgctattacctctatcctcactatgtccactgtggaaatatttctcatcacctcactgccctggttcaggacccatcatcttatctgggtagatcagcaggccctctctgctctccttgctttatctctggctccatgcattctactctcaactcagcagccagagtgatgctgcttcatgttagtcatctgttcaaaatctccagtggatccccacccactgcaagtaagtgcagaagtccttattatgacccataagactccatgacacctggtcctggccctatgaccccttcctaccacccgcctcctttcctactctcttccagcctcacagacctcctcatcactcttgactcaagacctttatcattggctttcttttccttccttctacctggaatgattttctccaactccttcatcagtttgagttttctgctaaaatgtcagcttctctgggactgacaatcctattgaaaactgcgtcttcccaagcatttctcattgcccttctttgccttgtgtttctctatgtttttcttgtatgtttgtttaatgcccgtctttccatatttgttaccagcttcatgaagacaaggattattgtctgtttggtttgtaactgaattcccagcatccaatacctggcactcaggaagcattcactcaacatttatgcaatgaatgaaaggaagggagggaagagaagacctgagggagaagcacagtggtgctgaagtagagcttgtgtggaatgactgctaggggagaagatgggaaagacagattgaggacagtatgcaagtggatggcttcagccatgggaataaaaagagtttccagtaaatgagtgtcttgaccatggcattctgacaaccacatagagaagaaatgtgctgcacatgttaaggaaatagcagacaaatttgaaagctgttgtatcaaaggttcatcaagtacgtatttttctttgcaatgcaaaactcaaactagcttaagtaatttgaaggctcacatagctgaacaatccacaagcaaatatggcttcagacatagcttgtcccgggactcagatgatatcaagacatcccttttatctctatttcttggtattgtttgctcaattgtcagcgcaatcatcaggcctcatatggatacaggccctgtatcctctcttagaagtctcagggaaaacctccagggttttcattgcctctgatggagtcacatgcccattgctcaggcaactatgatgatctgggaatggaatgctcaatagactttgactacgatacacacttcacccttgagctaaggcttgggtagcagttggtttaccagagggaacgtggggtataactattataagaggagggaaatggagacttttaatgatgaacagatgaccactacaaaaggctaatgagggcttgaacttgagtctctgcagttggaatggaaaagggagaaaagaagtaacagagatgaagtctagtaggcctcctggctctgaatggagagaggatgcagagaagctttagtacaattctgagatcttgagcttgcgtgattagaagttggcaatgtcattaatgaaggttcacgataaagtaggaggaacagatttgtaagagacagaacacatttccttgctttctcatccctgtttttattaataaaattgtttccagattctcagagctcaagaactgtagagttctgcaagaggcaagaagcaaattcttccaccaaccacttattttcagaagacttaaccctgcagttttaaaaagtcttctctctgagctcatgtgtgagagaatcagactgaaattttattttctctcaatagttttgagtttcctttggttgagctatcagcttctatggaataagaaaccacaagtcagagctgggttcaatcatctcttatagaacatttccacacagatgacttagggttgtgaggccatcttctaatgtactgtggatggattaggcttagagaaatatatgatgctcatctatagaactctactggatgcctaacaaattacaaagtgagaaacttttcatcactgatggaccaggtgcaagaaaggagtaaaggcaggcaccgaataataaagtgacatatgcaaatgtagtagccagcaattttttgagtatttaccattgaccaagtactgttttaaagtctcaacatataataagtcatttaatcaccatagcaatgcttcgtggtgagtactgttgttatccccattttacacgtgagcaaactgagatctaggaagatccttgtcgatgtacgttgtcaagggtcccacagctagtgactggcgtggctaagattcaaacccaagcagtctggctcaagggcctgccttcttaataaactgatcatatattccagaactgcccaatacagtcatcatttctgcctgctgccttggcataattataaatgtgaactctagaaagtgcccccattgggcaataaattatggacactatttctctgaaccatgatattttccttattcaaaaccaagaaaatctaacctgagcaataaaggcatccaagtggttcagttgtatctccaggcatatgaggggtgacattttggattgaatatgactattggtaatcatccagttggtcctaagaattaaagcagctgcatgggttggcgtaggtttggttttaaccagcaaatcattctgctgtcttgcagcttttagggctctgttttgtgctacagtaaaattgtcagtgaccatatgttgcctgtttctggaatggttttatttatgcctcaacatttggctccttcaggttcccccagatctccagaacgaagtgctgatcagcctgttagagaccgatcctgatgtcgtggactatttactcagaagaaaggcttcccaatcatcgtgagtattccagtgttccatcttctaaagccgcattggagatttctatttccatttctgagaaattggaaaggtttacataagtacatgcagggtgacctgaagtggaattttggcaactctttggcaattctgatcagtccatctaaccagaaaatgcttcgggtcccatcaatccacttaccaaattagaaaccacattacaagatttttctgttttattttcagctttctctagcctctcagggtccttttgacttcatttacagggaaaaagcacaaattactggcaagggactataatacacgtcaatgattctacttctagaattctgataagcgtgcataggggcccttaaggctgcgcctggatgcatcttgcttgtgcagctttaccagtgggattaacccattatcaaaccacaagacagaccttagctgaggcctaggtgcccatttgaaattagaggtgtgcaccttcttggctctcccactttttatagctagtattattttgataaaaatgcacatgggtttctacatgcactcatgtttgcaattagtaaaatgcaagccatgctgcaggctatggcttgctgccatttttgctcccaaaagaggagcacagagtttttgcattagtcagattttatggttacttccaatctttgctgcagaggcagagggtgtggggatgctgagcatttggcataaccagttaagggcataatatagcatcattaaccaggagtagtatcatcaccaggacaccaaacaataaatttgtgacaggaaaagttgttgctatgctcttacaaaattatcacttttgttatacttttaacctactaaatttcagcaattctaagatacgtttctcccatgacctatgatctctgaaattgagactaatcttataaccaatgataagctcctaacgtaatcccgtacctgtaaccccagcactttgggatgccgaggcgggcagatcacctgaggtcaggagttcgagaccaacctggccaacatggctaaaccccctctctactaaaaatacaaaaattagccaggcgtagtgacaggtgcctgtaatcccagctactcgtgaggctgagatgggagaatcgcttgaactggggaggtggaagttgcagtgagccgagactgcaccactgcactccagcctgggtgacagagtgagactctgtctcataataataaataaataaacaaataaataaaataatggcatgtcttaatcgatggtgtcttataaacagtaacacatgttaagttattcctgtatattggtgttgaacttgataaattaattttcactcatgattattgcagatacttaaaaagttatattatttagaaaaatttggtgaaaaggaattccatgttgttcaacctccttctttcccaggtcattacgttgatagcacagctaaattcagcttcactccatttccagcttagcagggaagaccttttaattggattatcctttcagatctactttaaaaaatctgtgtctgggccattcattatcaggccaaattctgattcaaataggaccaaattctgttgaaagtaaggcctggattcaagccccaagagccatgagtgaataaaattatattcaaattgtatagatgagctagtattttatggtcttgcttttcatatcagagaattaggcttacatttaaatttttcctagatttctaaccctcatcaaggtataagtcctaatttatattaacaaatggcttttcttttcagcagatcatgcaccaccataattttgataaactcatttatttccctcccttgtacagaaaagagacatgctggcatttccatttatgagcccctcatttaaactgcacttataacatatggttggtactgtgtgggaaagctacaaaacacacacttttgaggaaaaccactgatttttgcctggccaaatttctgcttttgtgtggcattatgagatagataaatactatactttaaagaacagttgatagaagtttttttacatggttttcaaatacactctttgcatataaatgctgtggtaaaaagcgaacctttctttctcttctattaggaaaaggaagaagcacacatattaagcccattccaagctgtacaattgtccagccccttctgttccctatccgtaagagtaagaagtagaattttaaagtgtaggtgagcagaccctagaccaagatcttaggtgagtgtcagggcttccaagaaaatagcaaagacttggaaccaacccaaatgtccaacaacgatagactggattaagaaaatgtggcacatatacatcatggaatactatgcagccataaaaaatgaagagttcatgtcctttgtagggacatggatgaagctggaaaccatcattctcagcaaactatcgcaaggacagaaacaccaaacaccgcatgttctcactcataggtgggaattgaacaatgagaacacatggacacaggaaggggaacatcacactccggggtctgttgtgggatggggggaggggggaggaatagcattaggagatatacctaatgctaaatgacgagttaatgggtgcagcacaccaacatggcacatgcatgcatatgtaacaaacctgcacattgtgcacatgtaccctaaaacttaaagtataataataataaaataaaaagaagaatgagcccataggagctctgtgtatgtcagagactagcattatcagtgaacagaaaacactgggggaagacttacttaggagaagaaagtgtttggtttttgtttgtgttcctctaggtacaggccaaggaacagcccagaaggcagagaatgatgtcatgaagtaaaaatgcatatgttaataaatgagtgtttacttttagtggtcttttgaggcttgagctccagagtgctacccctctagctgtagttgcctttttttttttttttttttttttttgagatcgagtctcgctctgtcacccaggctggagtacagtggcacaatctcggctcactgcaatccccacctcccgggttcaaacgattctcctgcctcagcctcccaagtagctgagattacaggtgcatgccaccacacctggctaatttatgtatttttagtagagacggggtttcactatgttggccagactggtctcgaactcctgaccttgtgatccatccgcctcagcctcccaaagtaggtggtctttttgtgttttaaactcactcactcatgcttctcaaactttactatgcatgggtatcaccagatcttgttaaaatgctctttctgaatcagtaggactcggggaggtagtctatgaatctgaatttctaacaagctcccaagtgatcctgatactactggtccatgatccacactttgagtttaaaaagcttaaaatatcaaagtatattcttgcttttaggagctttcagacttgttggaggaggcctccaagggtagaatgccaaacaataggtgctggcccactggctgtcagactcaccagccccttggaatcacctgggagcctgaagaacaactatgcctgggccacccctcagagattctggttcattttcataggctgcaatctggacattcggatttttgtttaaagtctcttgcatgattttaatgagcaaccagggttaagaacctctagcttagatctaccacgttggatatcacaaatttactatcatgtgggagtttgagctgggtgatttttgacattaaaaaggcatccttgtgttgacaaaggaagggaatcaatgctccagaccatgaatccacttggagtttggagaaggaaaagaggtgtgatttgaagtctcagagatagcttctgagaagaggaaggatttgcagtgaactttgaagactgtggaggatataaacaagcctggatatttggggagcttgcaccaggacctggacataacagtaaatatgttggctagctggggtcacaataaagaggctggccagcagtgaaggtagaagcccttaaatggcaggctgaggggtggtgcttaagtcaagaagcagtgacaatagattactgtaaggctaaattatagtaaattacagtaccctaaactgccagatggtgctggctgcattggcaagtcaattatccatcagtaacacatgtttgtgtagtcagttatctgtcaataacacatgcttgtgtagtttaatagactggttaccatttcagatccagagccagattgcctacgtttcaattccatttctattgctattatatatgcggtctattagttaagagttaatatctgttaatacatagatagatctctctctctagtttcctcatctgtaaactagagataaaaagtagcaccaacttaaatacagaattatgctcttagtgtatagtctggtatatcataaacatcaccaatttgctcatttacaactacttaccaaaggcgtggccatcactagattctactttggttttcatgagatagcaaccttccaggcaatatgacacaagagagaacccgttcactttaagttatagcattgtgtctaaaagcaaacactatatttgcttctaaccctttgatttttttttcctgaagcttctgttctctgccaccagttcacatacctaaacaaagctttacattcctgtgaggccaagtggaaactgcacaagattttatttggaggggaaaagaaacaagtttcaaaagagtgtaaaaccaagaacaagaaaatattataatttctgttttgaaagagcaaacatttagtgatatttgggaacttaatattttgttttgatttgggtttttcacttctttatgcaacatcggtattggaggagttaaaggataattccttgttttttctcgtgcttgtctgcttaagtatttggcttcaaccaaaacgggatgccagagggggattagaagagatttttatgactaagaatgcaagaccaggagtctgtgaccagcctggtcaccacagcaagaccccatctctactaaagaaaaatttaaaagttatctgggcatggtggctcatgcctgtactcccagctactcgggaggatgaggcaggaggatcacctgagcccggggttttgtggctgcagtgagccaagattaggccactgcactccaacctgggcaacagagtgagaccttgtctctagggggaaaaaaaaaaaaaaagaaagcaagactttgatttttaaaaatatatacttgtcaggtatgtttactagcattatatatgctcttttcttcaaaggtacttaaaatagttcccctaccctttgatttaaggatgtgaggaaatagggaatgagaatgggaggttaatcaaacaggacaggatatgttgaatgtgaatatttgcaacaaaacaaaggaatcacagtaggactgggacttagtgagaggcaagtgagacgcttgcctagacacagaatttaagggaatgccagaaaactcagtcagcaaaattgattatattgcaatgtaatattttttaaaaatccaagctaatgccaaaaatgtttgataaagaaaatatcaaaattttaaaaagactagccatgcttagtcatagaacctgaaacaaaaggtaaaatatgtgctgctgccttaaatggaagcaactcataagtcatatttattttttgagacagggtctcgctctgtcacccaggctggagtgcagtggcacgaccatggttcattgcagcctcaaccgcctgggctcaagcgatcttcctgcctcagctcccaaagcaagattttcaaaatctactttgtttatcttggttccaactgagagaattgctatgtttgacagtttctcttgaccaagtgacaatcttaaataagttctaactaaattaacctgaaataaaataataaggaaattctgtttgggcatacataaaacatttaaatttaatataaatattataggttcgaatgtatcttcttttcaatttttcaattttttcaactgctttgatgttctgggaaaaaaaaatatacacaaaaccatgtatatagaggtacacagttttcttttgcctgaggcatctcgggcccctaagttccgcataagggatgctttgcagaactaagcatgattaatgtgaaaatcccccataaatccagagctcaggagagctcagcagagctcagatcatctgtgacacagtaactagtttcagcaacaggtcttgtaatttttaaatataggcttgaggaaacatataaagatttgctcttattctatcaaacctcaggggctccccagaaatagaatattaattaaataaggctaagtaaagtatcttcccttctatactctggaaacaagatcaaaatagaacaaatttaactgcatttggagagaaggcagatatggatgaactaaactcaggtatatatatttaaatttcattgtggttaattctattagtagccttcacaaagtttttactggaaaaaaaattaaactaaaattaattttaaaaattagcaaaactggtgactagtgtatcaagagcatggttgaagatctgtactagtctgaaaaaaaataaaatttcagtactgaaaaataattgtattgtttagctagatgttcatcttattgaatgacaaatctgccttcttcattctgggggagcattaggctttcttctaatttaaaggtatcacatttaacttaccaaatatcacatagatcatttcttttaatctttcaaagctcatcattaaaaatatcttttttcacaaacatggagtgttatgtgacagattataatttctgtttttcttttactaggatttttcatatcagaaagggtttcaggaaattttcagacaagaaatctaactttaccagtacaatgtaacagcaaagagtcctattgagtggcggtagctgttggcctcaataccctggaaattatgaagcattaactgcccctgcccccctcccccaacacacatactccattcaagaaagtctttccagccagatagttttagaaaaagcttatgtggaatagagaattccataatgaaaaattctaaaatgtgtgcatatatgccttctatggaaaggcattcaagatggagggagaatgtatcacattaccccttccttcctcacaccttcactatgattcacagcttctttataaatttgcagaatgttaatttgaagatgtttttatcaggccctctgtaaataatgaaaacaacactgtctgatcttcacctgtcataagtgctccatttgccagagacattaggagggaattaataaggactaaaaatgaggggaaaaatttcaccaaaggcttatgcccagggtgttagcttcatcatccagtggagagtttagagccatgtcagttcctctttgaagtggggtacctttatccctagcaatctgtcaaagggaggctttgtagaactgatggtgattaatgtgcacattcttcatgattccaaagctgctccagcagtggattcctttcccagtaccattgatataatccaagatggatgatacaatgctttcagttccaacagactggaacttatcagtcatatgattaagccaaggatgaagccaacacacatttgaaacctccacagttcttcttgctggggtagctcagcaaggtgctgggcgggccccatccggtgattgaaccggagttttccatttgtccccagaacaagttctgtgcttccggctgcagtgcaggcctgcccacagtaccctgccagcatgtttacgccctgacctggagggaccagctaagggtgagaatgtgactcgctctccatgcccatcccttgcttgtctggttagctgagattggccatgcatgctgtatgtagatggtcctggggtttgggggtctaacggggaaaccctccatgcatggaggcaaacccatgtagactggtgacctgtccacccaacctcaatccatgatgctctgagactggaaagagaagccaccaggcacttttggatgccaacttatgtcaactggcaactcattcacccaacattctgaacctcaatccatcaaactccaagacatacaaagagatgtcactatgtgcttttagactattcctcatctagtgaatcactgatcagagtaaaaatttcatgtaaatagatacatgagtattttaatgcctttatttgggaccctgaactcaaaactatcttcttagggttggattatcctagagtcaaatctgagagaaaacattgtggttgcttatctcatttttcggacatatccaaaagatggtatggttttctagatttgacactgagtgtcctgtggaaaatcactaaaacctcccctcctgggcccatttctccaccagtgttcagaaattagagtgctgccaattggaactggtttgtaggaaggtaatgcccactcaagaagctcccagagctgactcacaatgatgggttttagccaccatcaggcaccctggtcctggcagacaaccacttctctgacagttgtagcctgaaaggtagtttttctttcttttctcacttttatctctaggtttcagggtcagagaaatttcctttcctataaacttttaccatccacatttccactacactacacccggatttattcacaccctgtcttcttgcagaatttctggattataagaatttgttttttgatttgtgatttttatatggaaaatcttacagaactttatagattttacctgatttataaatttgacaagctgcttttacaatagcttccataaacttagaaatgtttcagaaactgggatagaatagaaagatttagaagtggaaaatggaaaatggacagacacaggaagcacaggtgtgtaatgaaggtatccacaatgactggatgcccagcccccattacaggagagacatgctctgaaaggccctcacaattctgcttccaagtctctggaaatttctccggactccagcctccattcagcaatcctactctctctctgttctgtgtctttacttccaattgtatcacctaagtgggtgtatgtgtatatgcatgtgtatatagttgcatttatgtgtatatgtaatatgtgtctgtgtatatgtgtacatgtctatgtcatatttgtgtgtgtgtatatgtgtttatgaatatgtatatgtgtgcatatgttgatgcatgtatatgtatgtgttcatatgttgatgcatgtatatgtatgtgtttatgtctgaatatgtatatgtatgtgcgtgtgtgttgggtatgtatgtatatgtgagtatgtgtatatatgttgatcctggatttgcttctgacagatataaaacaatagaatgacactatttttttaaaaaatctatgaactgcctatgttgttatgagagttctgaggagtgaataaaacagcttttttttttaatcggtgtgctttcatgtgagaagataattcttggacataggttcttaggcaaatttggctgccacttcctgacctctgctaagacaataaaatgatagggaaatattttaaacattttaaaaggctattaactctaagtaagaaagagcattttactactgatttgtaataatgttgaacactatctaccaaataaattctagaagaatcccaaccctaactgcctctgctgctagagagcatggtattcagcattcagtcagctccttgtttctttcactcaatcccagactcaggtcaggaaaaaggagagttgttaacagtagcttagtacagtgcctgccacataattaactctgtataaatattaacttttactctcctcacaggccaaggggatatttcacataagtatatttcccaaactgcttgccatgtgtactcacactgtatctcctcccatggctgggatacactggggggtggggaaactgtgaaaagaagacatcgtctctcattggatgccccctctgtctatgtccctggctgtgaccccagccatcccaaggaggttcagagcctgtgtctactatgagacacctcatctacctctacctccagggattcgcttcagccacccccactgtttcctccctgatggagggcccagctgtggtcactttgccggcttgacttaggagactgaaccagaagagcagagaacactacactggtacttcctacccccctttcacttcaaaatgttctgatccacaatgggactacactacattcagttgtctggatcctgcttaaggcagacagaggaggtccaggaatcggctgggatggggacacccttcctccttctcctaactgtggcctcagtcaccccaaggtcaggaccaccacattcactcccagggcagccaatgctgcagttttggctaccatctttggtttccctcctgatttggctcttagcagacctttagcccactgtcacatctacagattgagagaggaaaataaggtttggttattagaggttcccaaacatccccgtgcatcagaatcacctggagggattctttaaaaaatttgctggccccaccctgagtttcccttttaataggcagagctgactttcagggctgtgactccacactcagaagaagcccacatttggtttactgatttgcagtggccatcttgaaatgcttaacgctttttaaacacggggcatcacatgttcattttgcactgggctccacaaatggtgtagccagtcctgtcagtaggtccagaatggagctgtagaattggcattgccaacaagttcccaggtgagacagatgcagccaccctgggatgcacttcacaaccactcaatgagatcttgcagacctggaaaatcatcctcatagcagtcctctggctccttcccataagattacgtgatgagagttcaaagaggaggcaaggaaggggcttctttattccatgttggtaggaaatgtcctcagcaaaagggttcaggcccgtgtttgcctcagttacggctgtggcagtatcacagaagctgggatgtttttcccggcgatattaacccctgctggaaacctcagaggaagctagatccctgtgaatgcacttcctccagtttgcatgcacaaaaccatttggttaggaaagtgttgttcaggcatgtgtttaccttctttaagaaataaaaaggatttgttttgaaaaattaagccaaaagagagcaaagactagtaaagagaagtgaagtaagggggaaaagatgtaggttctggaacttttaatcaatctgtgattgtttcccttcaagatgttgtcagggccagttttgaggagggtagaaaagaaagatgtttccaggtaagacttcccatgctcttttcacgttgctcaagttctcatttttctgttccacatacattttcactgttatttctgtttctgtgacaactcatgaacacagaactatgataatggtatactaattagtacatcatatcagtttgtaaaagcactagtgccttgtagaatcattttagatgtatttgaataaaatggagtctagtgagggtcatatatttattgtttttgtcactactttatacatgaaacacttattcccaccggtggcatcaacatctttatcacatgaaggatggatttatttacactaagtacagtaagtattttggtgggatggaaaagttgtccagaaagccataatgaacttcaagcaaagtgtcaaccatagttttatctgaattatttttaatgcaggatattgaggaaagtgaaagagttatctactagtgtatccttacctaatagatagtgagcatcagactttcacttaaaaatggaagcaggaatgagtccctgaggcacttagcgatgcccattggcaaatgcagggctccttgtcggtttcattctcaccgtgccttctccatcattgccttttcctgttatatctgttgggttttactgccctctgctggtcatatcgttgaaaccctttcacgtcatggatgtacatgtcttggaacattgctcaaaatggtctttttgtttcagcccgtgtccacgcatactcctccagtcatttgtgtaatagccatattgtttaaatctggtcactacttgttaacaaactcacgcacctgtaattgtctcattgtgccagaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaaggtaactggagcctggccagcaggcgctggccaaaacaagcgaccctcctcttgttgcatgtggcatggtgtggggctcttcggaccttctcttcgtctctcccttatttgatgtttctgtaattcaacctgcatttaccgagtacctgctgaacgcctactctaggaagaggaaggtatggcgagcccagtcgttggctgggagggtccctgcaggccacactccaagtctcagatatctgggaaataaacgcatgcccagaggagccactcctattcccagctgattctttttccctccagcatcctaggaactttatgtatactggatttgggttgcatatttgctagtctgaggtgccacccaattactgctgttacatttctaaagaaaacaagctgaacctactatatgtatgaagacaaccttccagaaccaaatagtgttagtatccaatgacaagagagcactatactgggagtcacaaacctgctctgccactttcaacctgcaggatctccagtgagcgattgagcttcccagagtcccatttcctcctgctgtgaaaactcagaatgataacagtatttaattcattgagtttaatgaactaatccatgtaaagccctcaacgcagcacttcaaatgtaatacgcactcgataatacttgctgtgtaatcttgtgtgcatttcttacctgctccttacgctagttgcatcgtctgtaaaatgatctgctgggaacctcctagggatgaagtgagataacgcatgtgaactgctgaacacgtggaggcacccagtagacgtctgctgctataaatcgtaattataatcccatcatgggattgtagtgaggattaaatgagatggtgaaaaagcctaatgtagtgccttactccataaatattgatggataagctaaggggatttatgagtgaatgcatgcatgaagaaatccagtgataccaatagcaaagtattcctgaggatagtacagaaactctattgttcctctagttctgtgttaatgtgtttagcacctataaagctgttgtcacccatcacccttctattcatttcctataacatgcaaacttattattttatggttctggaggtgagaagtctaaaatgggtccacagggcctctttcccttctggacgtcctagggcacaatcgttttcttgccttttctagcttctagaagctgctgcattccttggctcgaggccccttcctccatcttttaagccaacagtctagcaacatcttctctcctacccctctcttataaggacccttgtaattatattggccccatccagataatccaggaaaatctccccatctcaagaaccataatttaatcacacctgcaaagcccttttcgaaaataacatctttgtagatttgtgggattatgacacagatatctttgggggggcccttattctgtctaccacgagcatgatatagaaagggcctttttgtaaatcccaagtagaatgaacacgctgaaaggtggatctgaattgtattctgttttgtatacaacaggatcttgaatacaatactttgcacagaagagatgttattaaaatgttcattgatttttaattttccttttgtgttatatacctttttatacactttttccctagatctgtcagaggagcctttcgatatctggggaacttggcattcaacattaaaaagcggatccaaagacccaggaatgacaggtgaagtattaattttaaactttattgcatttacttttaaaattattttctaaagttttctttactatcattatattacatgcttgtcaaacattacttgggaaatgctgaaaatgggaggggatgaaactatccttaggctttccacccaaatatgccaatctttgactatatttttttccatttcctttgcaaaggttttcatagttacagtcactctgtctgtgcaactttgtattattttctaacttccattttccagttactctccattatcctttttaagggccaggggtattccacagagtgcataatcatagcttacaaaccaatactaagtcatttgaaattttttgttattgttgtaataagttacactttcaggagcctcttttatgtaattaatttttcaaattattaatagattcacaaaattttggaaagcaagtcaaaggttataaatcccaaacagggaagtgcgtcaaatataacaaggctttccaagaatctggaggtacagtcacctcctgtgctgtatgggacccactaccttacattctgtaaactgtggatggcaggagattttacactgctgtgtgcaaatctcatcagtattgcaagttagtgggttttcacttttgctaacttaaaaaacaaaattgcatttgttaatttgatttgcatttctttcctaccagtatttttcagtgtttctattaatttgctgaacttccccccattgaattgttacttatatcatttcctatttatgtatgccagtgttttttaaattcttatgaactctttatataataaagatgttaactctttttccatattgtttacttacttgcattttctttttttacataattaattttatcactgtctcttctctgtgaattctttcataaaattaatcttcagttcagcgttggatagtcagtcatctgtatgcgtttctttttaatgtcatttcattgtttcaaccttaatttttttaatccatctggaatacatgttatatatggtataaaatgtgtaaattatttgtttggttgttttatatttatatttatattccctttctcattgttttgtaatatctcccatattacattttaaaagcacagtgcatttttaaatgtaatgccctctagtgctgattccttttctaactatatctcactgtatcctgtgaagagccttactccattttccttttccagtttcagctgtcacctgtttcagctatcatttgtttctttgtaaatactcacatcccccactcccctgtccccaacatggccttgttcttgttccttgtctgctttttaagaagtggagggcagagcagattcataggaaaatggtagtctgggtacacatgccccaaggactcctcctttgccttgcaaaatgcactgttatttctttcccttcagtttcctaaagaaagttgtatcctttagggaaagctaactgctgtaacaactccgaaatggggcagtggcttaacctattacaactggatttctccctcactgtcccagtacagtgtggactgtgaggggtgaggaggggcgggagtgtgtgaggggagggaatgctgtcttccacatagtcactaaggggcccagcctaggctccacatatccagtggctccaccatcctcagagccccgggagtcttccaagagtttcagagcctagagagtcttcatgctgggctggtagttaagggaagggggaaagcaaagatcagtaggaaggcattcgtttagttttttttttttaatttttttttttttttttgtgacggagtctcactctgtcacccaggctggagtgcagtggcgcgatctcggctcactgcaagctccgcctcccgggttcatgccattttcctgccttagcctcccaagtagctgggactacaggcacccaccaccacacctggctaattttttgtatttttagtggagacggggtttcactgtgttagccagggtggtttaatttttttttttatttttttttttagttcaggcctagaaatggcttacatcacatctgtccacatttgttgcccagacctcatttctgtggccctcctaactgccagagaggctggaaactgccatgtaggaagtaaaggggaacgattgggtgatcaccaagtcagcctttcctgcattgatggtaggagaatatgcatagtggctggcctgccttctggcatggaatggggtacttgagattcaagtaacttcattgatgcaatagaaacatgaaaacattataatttgtatctctcctggattacagattgcattgaacaagaagggaatgcttctttcaccttctggattctgaaaagttttcccagccatgtagaggggccctttcctgaaacacaaattggtggcaaagccaattattaatatagtctgacgtctcagctaacctgtcagagtctaggcatatgaattgagccgataatcaaaaagcatttgtctttttttgttttgctgggaaggttgttttcttcaggtagcagcagctaagagcatactgtgctgtttcagttttagaagtccggggggacgtcgtagaagtgggaaggaaataacaggatttgaatccccagcaaggattctacaaactgattccatttcttgggctttctctctggcttccaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacatttggtaaaaggcctacagctttgtacttacattgtgccaaaggctgaggaaatgttttctttcgtaattttatgtgtattgtaaaatgttctaccgtactttagtagtttgaagtttttcaagtgcataactatttttgaccagcagatggcgatacgcttcagtattttatgcaattttttttcacttctgaagggaaagtgtattataaaaaaagattttttttttttttataaaacatgctactcttaattttcatgttggtgatgaaattcccagtggtgtttcttaaggttctatcttgtgccatgatgaataaaaagttaag
